United States Patent 7,868,149 (PLANT GENOME SEQUENCE AND USES THEREOF) - sequence listing, part 41

SEQ ID NO: 21401 - DNA, 31851 bp, Oryza sativa
  unsure (1)..(31851): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccagcagagtcaccaagtatacaactttctttcagccatcttcagtgtgtactttctcacaagactccgctttataccagttgaagaaatcgttgaaagataacggcagcttgagctgacgattctattctaatcgtttgatctatggcctatggctgaaaagccgtagaaaattaaagaaaaaacatccaaaaataaatatacaagtaaaaatttcatatgttattagcaatcgaaaagtaaatactagtagaaaataaactcggaaggaaaacaaacccctcaaagtcaacataaaatcaagtttgaaataatttcaaattttggtcgtggctgataagaccaacgagcaaaacgacgaaaaaaattgttatctggaacgaaaaaaaaaacacggtagagattaatactgtactaaattttcaacggttgggtcaccttcaattaccaaccgaagcaagcaactggtaaagcaaatcaaagcaaaagatgctagtagtagatacccaccaacgaaagaagccgacgctcctccctccttcctacaccgcgtccaccgcacaccgcccgagggcccaacacccggtccacggtggaccgcgtccacagatcgatccctcgcctcgagcaagcaaaaaaaaaatccgtactactctacgtggcgtggcagtcgtcctcctccctcccacgtgagcctcaccgacaggtgggcccggggagaccgtggtccccacctgcagtggcgcgcgtggtcccatctcccaaagcgagatgagtttgctgctgcagaataaaaggcacccagaaaaaaataaaaaggcagaaaaattcggcggaattcgctgttggagtgagtattcatcgaggcaaagctcgaatttttggtactatccgattggtggcgaagcagcggcggagcgagagaaaatcgctgtaggaatcgggggagaaggaggagtagatagagggaggtggattgagctgtgggaggttaggttggtgattggtagaggaggaggaggaggagatggagaggaaggtggtggtggtgtgcgcggtggtcggcttcctcggcgtcctctcggcggcgctcggcttcgcggcggagggcacacgcgtcaaggtgcgcagctacgtctctcgccgccgccgccgaggttcccggcggcggtttcttgaactgccttgttactactactactttctggatgaactcgctcgcgttacttttatagatctcggtgtgtctgctaagttgagcttttgtttggatctcgctgtttcccatcggggatttctgacctggtgggagtagatgcgtgtagcttatccgtggttgttcgctaggaaaatgcgctgtggcagaagtgaatctttgagcctttttatgcttttggttgattttcgctagagctagtgctgcgatcatgttaggtgtagagtggatgtttagttcaatctgattcgactagtgcgtgtaaaattatatggttgaatcagaatctgtccaagttatttccttttctggcaatgttcatcttgtttgtcaggatatagcactattagtctactatatatggtgaagctttacttattagaaatctttaaactcgttattctactgttcttttactcttgacaatgcggctagaacagcttaatcattgtgaaactcattacaaaccctagtgcctgtaagcacattgcagatattttcctctttgaggcttgaggatagactaattttgcactgaaatgcatgtaaaatcatgccgcgatgtaggaatataaggtggtacatgtttatagctttacataatgcaaatgcaaacctcaaaagtgtcaaggatcttatgctacgcagaaagttcttctgactgcaagtgaaactttactatagaataacttaaaaaacaaacagactggacatattaactgtggggctgtttggcagcgcttgctgcagctgcgctgcacggacggttagaagaaatatgagttcggttcctttagtagctggctgtggtgcagccgcagccagggcttctgaacaggccctgtagtattaactgtttcactatgtatgatcttagattttacatatagattcttgcaataacagtcataccatcgctaaagcaatatataattatcatgtcccttactctttttagagtgctagattgtaataattggctgtagctcttctgagcaaaggccgggatgttctattccattatctaaaaaaaataattatcatgtcccagttataatgcacattgcttaactcatgcaggtttcagatgtgcaaacttcttctccaggtcaatgcatatacccaagaagcccagccttagccctagggttaatatctgcggttgctcttatggtcgcccagtctattataaatacagtggctggttgcatctgttgtaagaggcatccagttccctcagacactaactggagcgtagctctgatctcattcatcgtgtcttggtaaaactctacccttgatgtttattgtgttattttacctttttcctctatcttgacgggtttcaacttatcttaccgatctaagagaattctgaatattattatgttatgttgaacctaacttagccttgacagtttgttaaacagtttttatggaaacaagggatcttggttgccaaatgcgttggagttcttgactctgtcattttggcactacaaaggttccttgcagttgatgccttatttcagtagtctttattaaaacatgtgtgtttttctgtgagatagcgtactagcattaggctgctgtttgttttattctttgcaaggaattcatatgagtggttcacatgatggctaaatagaataacttttgcatagatttcaagtgcaattagtaatgtgaagtgcaattctacctttttcttggaacatctttggggggttagctgtgctttattctaaggtagggttcagatcagaatgttgtggcttattttgcggaagtcctgattcctgaatgctatattttagcaaaatactctgctatttgttatttgccataacgtcgtcctggatattgttacattctgcagggccactttcataatcgcgttccttctcctactgaccggagctgcacttaacgatcaacggggtgaggagaacatgtactttggcagcttctgctacgttgtcaagccaggggtcttttctggaggggcagtgctctcacttgccagcgtggcactggcaatagtttactacgttgccctatcatcggcgaaaagtccaccaaattggggtccccagcagaaccaaggcatcgccatgggccaacctgtgatccctccacagagcagcgaaccggtgtttgtccacgaggacacctacaatcggcagcaattcccataaatcatgatctgtgcaagctgtttcgagggccattctgatacattatgtttggtttgtataggcctccaggttagaacagtagcagtaacaattgttgttaggtagagtcatgttttttgctttcttcttccccctctttcttgagcgctactgtcgcacgttctgcttcatcacagcggatattcgattttacatgaaccgggcaatgttgaagaaagcttgagtttcttgctatttgcaaattctgaaggttttacatgataattggatcatggatgtggaattacaatctgtcttacacctgtgggaacttgatgagcagtcattcagcacacagtggatgctagctgctccctgaaccgagcaatggtgtcgtggacgatggcgttggggcgcaccgtggcatcgaccacggtgatcccctccgcctcatcgatctgcagcaggtcgagctggctctggagcaagctcgccggcatgaagtgctccccttccattgatctcctcctgatcctgtcagcaatcacctctgctgatgcctccaggcacacaaacttcaccctgcagctggagtagctccctgaacctgacctgaagctgcagtctccttccctgaggatctccctgtacttctgctgcaatgccgagcagctgacggcgacgtcctcgccatgatccagccgctccctgacagcgtcgcggagggcctccagccacgggatgcggtcgccgtcggtgagagggatgcccttgctcatcttggctgttgtcagggacagggaagagcagagaagttcagaaacgaaaaagggaaatgtaggttggttggttgtgagatgatgaattcttcagagaagtatattgatcttgatcatgccagacctttgtttgcctgagaatggtagtcgtctgcttcgatgaagctgcagcctaaggtttcagcaagcagtgctgctactgtcctgcgaattcacaatgaaatgctaaattcataagaaaatgtgataaattttgctgaggacaaaaaaaaaagaagtaaattcaagatttaaagctgaacagtactattacaaaatctgaatgtaggtttgaaagtcacatcctaaaaccaactcttcagcaaatgcagaggttttctccgaggaaaagacacagcaacatccatttgacatcacaatgttgaattgttgacaaaatgcatatcagtgtactgataatgtctctttctgcttgcttctacttaatgtgcctaaaattgaccaacttgaccataatattaagcatgaactgagctgaggacttgaggttggtctaaaacaacacaatcagtttgaatacttgacagggtaatcagaaagaaagaagtaataatcttacgatttaccgcagccactgactcccatgatcacgattgccaaacctgcaaccccagatgttgaacaaagatgaattagcagacacccaagctctgctgattacgattagtacttgtaatgataatcccattccaagcaattccttgaattaagctttaacacttcaaaaagaaaacatcaattcagaaatcaacacagcacctattctgtcagaccaaaatcacaggtatggtcgcaatacatgtttgggatccatcacttcagttcgcaagaacaagaacatggtgaacatgcacatgaataacaggaaatctgaaccaattcggtgcagcgaaattgcgagaagaaactaaacagatcaaaagagttaaaaacgaaacaagcacgcactgatcctggtcactgacctggtcggtgcgtgagatcggaggcagccatagatgagcttggtggttcgtctcgatctgttcctacgacaaggagtacgacaagagcgtactaaacctgcgaataaacgaggaagaagacgacagcggcggcggcaacaactctacttggcttgattgctcttcctttattttatatctcgagattgaagaacaaaatctatcattttttgggagaaatttatttagtctagtctagaaattttgacttgcatgaacactgcaatttggcatttttgacgtagtgagtactatggccatcctcataaaaataaggagaatttttcacgaatccaaacatagaaagacaagattgttttaggattggacggcgaagaaagagacttgaagcgaattgtcgtctgatgactaaaactaacaaagatgagacgtagacgaaagcgtcttcagttcaaagcaagaccacctgacgtttcaactttcagttcaccgtcactttagactgggacctggtgtttccaaagactcttttacagttcattcatgtccatgctgtcgcattgttgttgctgctgactcagagcttatcacacatccttatccaagaggaacatttgtagtatcaacagaaatcatctttcaaaggatattgttgttatacaggatcctcccaagaaaatgacaactttctatagagaaaaacaagttaggacgagagttggtgatgatggaaataccaacttctctcaagtcttggttgattggattcaagttgatgctttcatgttcctctagctcagcaaagaccttggtggtttctactgaacttgtttctggtctctgaatctttcagcattgcttctggtttctgaagcaaggaagaaaaaagctgttgctaccggtgagaacaaagatgttaagatgaactcaaaagatgggggcaaaaacagaatccgagatatacataatcacatacagtaccaaattcatctgatctagtaatgtagtcacgtaagaacatgcaaacagctaggtaactatggctactttctgaaaaaccctgaatcctgaagtgttttgcaatattctaagatgacaggagatttcttcaccatgtcccagatcttcgctgagctcctcaaccagtcacgctcggtgagattcttcgagaatgacctcgatggccttgataagatctgcacccacagtaatatccacaactaagtgaattgtgtccagagtaaacgtagtactctgaaaagaatcgtttattctgcctttacatcagaatcaggacaagagtcatcattgtgttcagggtcagttctgcaccatattatttttatttttccatataccatgatatgcatctatcgattaataaggatatgcagaactattccttttcgttacttgggaaaaaaagaatgcgaagtgctaattctgttaaaatatgaaagagctcaacctgctgagcgccaacaaccagttaggtaaagctgcaagcatacctgatcacgaagcatccctaacatggatggacatgtccgatactcaaaatttgttgagttatcaggtgttcttaatggaagaagatatatgtcctgctgattggagctcagatcctcaatcttcatgcttgaaggaactgaggagtcagaaacttgaggtgttgctccagagcttccaatgctaaaggaggaggacttgaagtgtttttcaagaaccctcttcagaaccatgagctttgaaggagaaaagtcttgttcccgcaatctgttcagttagaaaaccacaccattctaagattatcaaattaattggtataaaagattggattgtagaattaagtgcaaaagtgttgtgttcatatcacaacaactaacttcactgccaaaataccggaaacaacaaaaggatctctttgttcatcaaaaaagaaatgagcatatgataacataagaaaatgcaaacaagcatgaaactgagcagtgttacctagcatgcacaaaacagagatcagctatgtaatcttcaatgcctgattggttatcatttttgttttccttgtcttgggtagttgaggaggtcaataatgatggatcaggtatgttgtgcttcagtaaatcaacctgcaaaaattgtattaaatcaccctttcaactttctgccattggcagaaactaaattcatcaacacagcataaccacaaattttcataagtacaatatactaatacggagtttcaggtctgagctctctaatacgctggaggatataaatgtgttcttaactattcactgtaagaaaatgtgatcaagtggtatggatgataaaaacaaaggcataaacaaatatagacagacaacttaccgtaagaatgaggtcccacatggacaggtcattaatcccctccgatacaaccaacaaaatattgcaaacagatgccaagaaaacaccaagctacagcaattccttgcagaacaacataaaacactgatcaactattcggtactgtcaagctcagttagcagtgggtacaacccagtgcgagaattgaagtatagcatttacctggattcccattaactcatgagccaggtctgctgataatggatcaccactgaggataggaattgcggatgaaccatctggcttcatcatatcaattagtacggagggactgaatactggctgcaagacaaaaggtgattgttttttagaacgttaccagcaatatgtttaacagctctggcatttggaacattgcatagcagaaactgagttaaataactcttatcacctgagtgtctagaagtataacccgttcattagagatcctgatatcaatgccagcagtacagtgcttagccattgctttgatttcctcagtttgtgtagcaaaaggaggaagcattcctacaggcaatactcaactaaatgagcttcggtttgatctaggtgtccacatggaacaaattgctagccaaattacaactcttcactacgctttttcagcaagccaaaagacacaaaagaggttaggggaaaattgatgtatggaagaaaaacagaagcttaaggacttaatagagtgcatattatcaacagcagagtgcatctacaaaataattctgacaagcgcatgttttgtttgacacatgaaagtaacaacaatgaattgaactgaaactattggaagactgaatgctgaaactattggaagaatggatgattgtaccaggtgagcttccatcatatccataaagctcgttcatgatggttgacttgcccacaccagttggaccaattactccaatcaccatgaaatcattgttctcagtcaaatactgaaaaatataggccccaaaagaaacatgaagatctcgatcaatcaccggtttgacatttcaagaactctagaagttatgttatacaaaaatactttcatcaaaatgtcacaaaatatctgaatgttttgagggatatatctacagatacttttaaataatcttgtcatcattcaaatccagtttcatgcacaaactgtaacttttgacgtgctagacaaaggtcgcattggcatatatcatattactgcaagatttaagctttatcatcagggatagtattagaatgcatctcaagagaacctaggaaaccatgaactaaactgtataagagctacgagcctacaactaacaactgcattgaacaatggattattgcattaaccagacacaaaaaaaaaaattgtcaactgaatctagttataggatctcacacaattttatcacaatgcttgcatcgaaccagtaagtaaaccctgaacagcaaaaggaaatgaaagaaacaagaagcatatcctcgtagcaaagccacttgaggacgcacgcaccgggaggatcttgtcggtgtggacctcccacgcgtcggagacgaggctgagcgagccaggctgcgtggcctgccgcgagcggcccgcgcctcctccgccgcgncgtcgtcgtcggcgccggaggacgaggggggcggaagcgggggcttggcgagaaggatcttgggagggggaggcggaggcgggtgcgaggaggaggaggacgagccccgtctccgacgccggcgagcggcggcgctccggcggccatcgcgcgcggcgtgctgctgctgctgtgggcgtctctagttgaggaggaagccgtcgcttaattaatcggaataagttcacttgaggtcccttaacttgtcagcgaaatccggttttgtgtgggcccaactgtcagacgcggtgctaggaggcccggcccaggtaagcgtactctttgggccatcctactgggccggatttttttttctatactcttctgtttataccgtggtagaccaagaaataaacagagaaatttttactacggtcatgaatatcccgtccgttcctccggagcattttatgttttgcaagtacttaaaattaatttttattcttttttaaagttattttattagttaaattttgaattttgattacgtggattctcctcctcagcagcccattggctgaaaacgcttgatttccatgtatgagaatcggtctcataggaatgtttattttgggtataaaatttgaatacttaaaaatgcttagtatttaacatttcgataaagattcactcggtctttcaaattttggtcataataatttctaaaatgctcttgtagcacagtaataacactgttaacagtagtagtgcaggttcagccatgttgctccacgtaggagtatgttggtgtagtagggtgctgggaccgagacagctcatcgttcccctacctctctgctgcattctggaaccctctctctctcttcctgtgacccacaacactccaaccagacaggcagaaagcaagcaaaaggataggaaggagccaagaacaccaagaacttgttggagctgagacagcagcaccaagcaagaaaccggatccaatccatccatccatccataggtaatgatcgtcccttattaccttccctacttctttgaaatcttactgtcttcaattgctcttttgcccgtgaagttgtagcagttcgcagtttgtctgtttcttggggagtgagtgtgtcgatccctaaaaagttcatctttttttgccccctttcccacgcaatttagatgaactggtcaaggagagcgcgatgatacagccactggttgtacaaatctgtcccgattcgttcttatgttcgtggtctgtgctgtactagcgctcgttttgttcaagcgattcagaaagtgacaaaactttggggcattctcttcggccaaatcttttgtttgcaccatgcggtagaatctatcctagcttgacgattctggagccctgaccacgaacttgtaagcgaacaacctagagggaaaaggaaataggtggttccgcattgttgaattttgagtgaaagagtgtacctgaggctccacaattcactgctgacagccgtgttcaatccccaacatgctaacaatttcttttttaaaaaaatgtttggagagacgtctctccctccaaatctcgttttttcttttaattcattgctgaaagataaactgaaatgctgctcacatggcccggcttctctgatgttcaaaatacaaaatgtgattctaagtgttctgaggtggatcccatattcagaaaagattaagatttgttaacgtgggttggtttgacatgcatattgcatttgcttcttactagggggttggattgtgtgagcttctcttgttttagccttttagcttaactcactacatgtggtgtcctcaagtaagcatcacagttggggttaacagtcagataactaaaccgttttgcagatgaattatttgctaaaccagtggttgtagagatgaacccgataaattcttttgtaactgaaaccggattgctactcatttgacaacagctttttgcaactgtaaagggcagccagaaacaataaacagagtgtgtgcagacttaaaaccatattccctccatttcacattataaaacgttttggtctctccatccctcgtctagattcactagcatccatatgaatttggacacatatatgaaacacatacatggattcatgcagaatctgtttaaaacccaaaaaacgtcttataatgtgaaacaaagcaagtggcttagatcaggtttgttgtcttgtgttcaattttttcaactgaataatagtacttggtagaaaatcttttaaaaaaacaatagtaccaggaaagatattatgaatgtaggcacggttttgctttgccttgtgcaaatgatagtctactaataattcttccacgtagaccatacctaacatggctattttttaccatgtaattccctttttgttgttacaagtaaagcattagagtgatgatatttcatcgttcgtgtccgtaatctatagaactcttcagtcttcccctgataactagtgtgtacttaattttgtagtttccaatggctggcaagtacatcgccgctggtcttgttggttcctttgccatctcatatgtttgtgatcattttatcgctgagaagaagatatttggaggtatggaatctgatcccaagtacccgtttgtaaattgacagcacgcttaacatacaccgttggcaaatctgtctgtataaagaatatgtgcaaaacaatcatcttacttcttgatcaggcaccacaccacataccgtgtccgacaaggaatggtggcaagcaactgacaagaagtttcaagcctggcctcgcactgctgggccaccggttgtcatgaaccccatcagtcgccagaacttcatcgtcaaggatctcgagtcctaaggtagcactaatcgcgcaatatgcgccgttgcacccctcaatcaaaacaagagcccatttgaagccacgtttcatctttcatttgaggtgctgatgctaaagctcctttgcttgttcagattgtagtgggagcatatatgctgaaggttgcgccgtgactaagatggcgatggctgtggctacaaactacctacctatgccgtactcccgaaccagtacgtgagtacttggtctcaataaaacagaactattttgcctagtgcagcctgaacagaacctgaagcatatctgctttagacattgtcatcttggtgattgttcttatgcagtaacaacctctactttgtgcttgtgctattgtgagtgaatggaactatctgtctgtcacactggaatatgtgccttgtctactgatgcaagagattttaggccacttgtgtcaactccagaatccaggtggcctctctaatctcagtgtaggtagcaacagacagcatctcgccgttttcgtgaggcttcttcagtgattctgaagcttatgtgttttcttgcacacaaaagtagatcagctagcagaaacgtgttgctagtttggtcaagatttatgtgcgaaacatttgacactgctgccagtatttgtcagatgaaaacgctgagatctcctctatcttgggagattttgcacgcctgatttaactctgggtcgttttcgttttcgcatcagcatttcatcaaatacccatctgggaattttcccgagctttgagctgctttagaacaaggttcagatgctgatcatcagcagttcaggatgtgatctgaagcacggacagaaattaagaaacgaagtcattggaaacgtgtcaaactgtgggcaatacacgtcactcaccctgcatcgtagtccgtacacgatgtttatgtacatactcccaggtagtcatacgtggtgcttgcaaaatcactgaaaaaaatcgtgactttccaggtggccgtctgaatcaacagatactagttgacgtacggaaaataataaaattgaaactggtacggaaacacgtccttgatataccactattatagccccatcatttggcctaaacagccaaataataagccaaaatttaaatttttaacttgattttgaacttgattttgaaatacttataacgtaatttttgttaaaattggcttttaagtcgctacggacaaatctacaaaaattttacttataaattaattttaattttttataagctaaataagccattttggctaaatggacaaccgatggaagctttatattctactagtacaaaattaagggtcactttcgtaggtggtacctttttcatttttgactgggagaaaagaggaacaaataaacaatactatgtgcctttcaaatataaacatttgagggcatgatagttacaaatgaacaaaaacacactaaataatactgctctatataagtatttatgtgatcaaaatttatagtacccatctcataatgtataatgttggttagttcaatgtcaacaagtagtagaggaagtactacacaataagaagttttaattttgagcaacggcgtcatacattaaaatatggaggtaatatattttatgaaaaactttatgtataaatgttggcttaaaatattagatgaatctattttttaagtttataataactaaaacttaattaatgacattatcattttacatgccatctccatcagattccatcgaccattgggaccaaaatattagaacgagtataatattctctctgtcctaaaaaaacttaacctatgatatgtcctctcctaggttaagtttttttggggcgaagggagtattatacttgttataatattttggtctcgatggtcgatggaatctggacaaatagtagttcagattccttatcttaggaggggtcataccccttcccaggttttttttttttgggggggtggggggacggaggagtatttgtcattagattctgtgattgtgataggatgatggcaagaagggggtggcaccatgcagcagcattccctagtcggtcggtccttctgccgcaccgaccattcgaccccccgtcgccactacaaatccaccacgctcccctcccgcgtgtcaccacgccattacttacttgatccttcttccccttcatcacagtctagtacttcttgcacctgcatcatctgcattggcagcagtaaactaagggtgcgttcgttctgagagattgggtgagaaatggatatcgtttttcacgctgcttcctaaactattaaacggtgtattttttataaaaatcttctatagaaaagttactttaaaaaatcatattaatttatttttaaagtttaaaatagttaatacttaattaatcatacgctaatgactcatcttattttacgtatcttcctaatcttttctatctccttctcctcgaacacaaccttggtagtaactagtactgatctgaggataagctccagccattctgaaactctctgctctgtctgtccgtgcatcttcttcctgcagctgacgacaccattgcaagctcggtaggagtagcagtagctctgttgttcggttgttctgctcaatggccgctcgagcactgtctgctgctgccgccgccgccggtcgccggatggccggacagactggcttccctcttcttgcctcctgcaggtaactggctataactgaaagaatgggagctctgtttcatgtatttctcctgttttttttttttttttgcttcttcattggattgtttctgctatggtttatcagtgtccagtacgtcagtttagtgtaggccgtgaatcgtgatgagctgatggcgacgccagtatcttgccttcgatcttctctttgtactatttttttttcctctttggtttgcaaccctcaatcgatgataaacatgccacctttttatgtggaactctgaatgaacgttcatttgggctgatgaactctgataaactctgatggagaaagaaatgagccaagcaagttcaagttcctttggagatgtttctctcttctgtttttttactgttcattttccagacagatcctgatccttctagctgttatttagttactgctccatctctaaatcatttgggctgtgtttatggtttagctgttgattgagctgtcatgttctttttagatggattgagagtgttgttgtcttgtagagtagatgccatattttgagagaaaaagaatgttcattttctgatgaaagtctgtgtgagcaggagaggagatcaagctcatcagaattactcgattagcgcacaggcccagccggaggaggagcagaaggccatccacgacggcggcggcgccgccggagcgcaggtggaggcggcgctgaaccgcaagaacgtggaggtgcacccggaggaggagacggtggaggacgcgtgggtgcccgaccacgagaccggcgtctttgtccccgccgacgaggccgccgtctccggcaccgaaaaccacgaccactgcggagcggcggcggcggcggccggcggctcgccgtcggtgcttgaccaggcggtgttcgtccgcgaggaggacatggaggacgtcgagaggccggccgtcgacatggccgctgccaatcacaagcccaaatgagcatcaactcagcagtagcagcaataaccaataaagccaaataatgccttctgaaatctcatgtacaactagtactagaaaatttccagtgaaaatcttgcgtcgttggttgtatgaatcttgttatctacagtgatcaatcggataatctgttctttgatgaatcttgttgtggttttatcggatggaatttgctgggattgctttgaattcgtgcacgacgccgtcgatctcgatgaggctgcagccggggaccttgtcgatctcgttcctcctcatctgccccctcaccttcaccgcctcaccgtgccggccattcgacgcgtacgtgttcgacatgagcacgtagtcgccggcgtccgcgtcggccacgcgccgtcgcatcacccgctcggcgcgctcgacgtcgccgtgcgcgcggcatgcggcgagcagcgagctccagatgagcgcgtcggagtgtactggcattgccgcgatgagctcctctgccttgtctagtctcccggcgcggccgagcatgtcgacgacgcagccgtagtgctcgatgcgaggttccggcatggcgttgagttgctggagcccctcctcgacaagtccggcgtgacagcacgccgtgaggacgccgaggagggtcacctcgttcggcgtcacgccggctcgttgcatgccggcgaatagagacagggcgtcctcgccgcggccgtgcattgcgagccccaggatcatggatgtgtaggtgtacacgtctcgccgcgccatgccgtcgaacacctccgtggcctggtcgaccgcgccgcacttggcgtacatgtcaagcagcgcgttgccgacgacgccgtcggcgctgtgccccatcctccccatgtatgcgtgcaaccacctgccggtgtccagcgcgccgagctgcgcgcacgcgccgagggcggcgacgaacgtcgcgtcgtccgggcgcaccgccgcggcctgcatctcctggaacagcgcgagcgcctcctcgagctcaccggcgcgcgcgaacgcggacatcatcgtgttccaggagacgacgttcttcttcacgggcatcctcctgaaccaccggtgcgccgccgccgcgtcgccgcacttggcgtacatgtcaaccagcgcgttccacgcgacgacatccatagcaaccttcctctccgcgacgcgccggtgcgcctcccgacccagcgcgaggtccccgatctgcgcgcacgccgagaacgccgcggcggcggcgacggcgtcgatggccacgcagcggtcatccgccatggcgaagaacagcaccacggcctcgtccaagaacccgtgcctcgcgtggccggtcaccatggccgtgcaagagacgacgtcccggccggcggggaacccgtcgacgagcgcccgcgcggaggcgagctcgccgcgagcgaggtagagctcgacgagcccgtcacggacggcgcggcggcggtcgaggccgagcttggccgcgtgggcgtgcacggccggcgcggcctcgccgtgctccgcggccaaggccttgatgagagcccggaggcctcgggcgtcgtgaggggcgccggaatccacggagacggtgccgttcttgtagccgccatgggagcgatgaggcggtggcctcctcggcttgctgctgctcgccggaggaagctgctgctgcggcggcgacggcggcggtaatggataaggcgccatggccggtgcccggtgatgaggtgagaatgagtttgggtgggtcaaaaagtcaaaacataagtactgacaggtggggacggatacaggttgggacttatgtgccgcataagaaactaaggcccataaaccaaccggcccaatacatatgggcctcacgtgagaagaaatccatgagctacgagccgactaacatgggtcggactcaggacttcatcaagattcagatgaacaacatcgcgtttgatttcatcttgattttcagataaacagcgtcatgctgaatttttaccttcatcatccatctgatcctggaaagcctcagggccatcgaaatcatcttcatgtatccaggaatacaaaagcatgtgcctctggacatgcatattttcagcaagctggaagagctgaaagcctgaaaatgctttttccctttggaagaaccaagctgtaaatgcatcgatcacatccaaaaaaacatcgttgcacacatctcatgcataataaacatgttggaaggaaaatcaaattgaacgcacaagtaatactgcatttaacacggaacaggatgcaataccatttttccccttcacaacaaggtaaatattatttcttgtagagagataaaacaaggttcagacattcagagtaacaggcacaacagtttgcctccagaaaactaacccaaataacaaaacaaccattactattatttctaacagacgataattaaaacgaacatggcagttcaccaaaaacataaacatcctgcaagccatcccttgcagcctgttcagaattcagatgccatcatagatatagtagcttgagttgcaaaagcccttctgctctgcagcacttgaggagagaatttcagcagaagataaacccaaacaaagcttccttgtagcagctaatgatcgcaagagagtagcatcctgggcttcacccagttgggcagcaaccctctgcgattgccttgatttggcgccaaggatgacacacagtatgaatcatagccgatccctccccatctctgtgggttcttgcaagacaatggtggccgtggcctgaaagcctccctcttctcatcgaagaagaaggcccattccttcaactcttcctcttccatcttcacccacattgcaggctgggatgacaggtcaaggcagaaggcctcgccgatggaggcggcgagcaggatgagcatgtcatcacacaccaccagcgatggctcgcagaggtcaggctccgacatctcgacgctccagacaacttgtacttcttccaggctgagctggggttccagcttgacggtgtaaagctgctgatactcgagggcatagagctggcctttgaagggcacaaactgctcaagagctttagaattgggcgggcaactgcactgcgaccaatggtcgcttccaactcgccatgcgaacagggagtgcttggcctcgacaaggaaatgcgagttgtgataatcaaggggagctgtgagggcacaagagttgacaaaagtaaagaatgggcagggtggaggtgaaacactagtgccggtgaacacgtcgacgatggcgaaggttgtgtccttcagcgagggggcattgccagagaagatggcatggccataagaacagcattcataatccatccccgccagaaaatctggcggagtcacgcggtgtatgcagatggttggcttggctggatcaaagagctcccatactactggatcatcgccagaggaagcgcagctgcggatggcaagaggacggaagagggtggtgcgtaaggtagattttgcagacctgaaggcagcatgccaattggggcaggtggcaatgaaggcagcaaggtcactgggtgaactcaacagagcaaggacacactgcagtaggtcatctgggaggtctgcccatccttggagcactggcatggagttgggggtgttggagatcctcttgcaggtgttttccatgatagcaggctctgcaagtcaataatgaagtcaatgggagcaatcagaacaaagaagttctggttaaaggacaagcaacatagtccactaattcactacgtcatgtgggcgcatgaaaaaatgagtattagaaatcctagccactaagtgacaaataagaagtggagtacagtggtgctacaatattttgcaatgttatgaatgcagtatgtagttacaagactcgacaattgaattcattcacatttcaaataacattgaagaaaacggatagttaatgctttatttcattctataatatgcatgaatttagtatcgacacattgcatgtgtgtcatgttggtagcaatacatccttgacttttttatatcgtttataacttaaaatattacacacaacatataagtaataaaaacctgtatcgttataaaataactcgtgttttagccatcaacatacatactaagaaagtatggggtacccccttctaccttgcttgatcctcaaccacaataactggtcctttctttgttccaatcataccaaatatcatggtaaaaaaaaaacatatttgataggatgttagtatttactatgagaacctaaaacattgacaatttgtgatacaaaatagcctaatccaaagatcacacttttggtggagacgtattaagtattaactgctgaaaaacataactctataagtatcttcagtatttctaaaaaaaatcttcaataccaagacatcagtggaagttctcttatttgggatttgattaatagaaaattaatgaacaaaaattgcgtacatattattttgttgataatcaaatattgtctcaccaccacccgagtcagtatagattttgaagacttatgatgtactcatagtccttaagaattcccctatcctccaagatttgaacgtacatcttagaggagttagcagactaataaatagaaacaacgagacaacacaaaatgggtggacaaagtacgtggaagaagaagtttaccgatgaatgaagataacaacgatagtgagggcaacaaagaagccccaaaatggttgccgtcgatgttaatgaggacgtatcgagggtctgcaatggttacgactagcgagtagggaagacgaagcggcggcggaactagctaatgattagggtttggggggaacgaggcaaggggattcaatgggttttatatggtatgacatgttaagagataagatgcatatgtccctcctcggaaccagttcacatacacacacacctcctggtaccagtacacacatagacccttttcattattaatttggtagtaaaccctaggctttgctattccggaaatttctttggtaccagttcacacatagacccttttcattattagtttagtagtataccctaggatttgctattccggaaatttccttggtaccagttcacacatagacctttatcattattagtttggcagtgaaccctaggatttgctattctggaaatttccttggaaccagttcacacatagacccttttcattcgaaatttcgttttatctgtgggtaccggtagggagttcttccgatcgaaattttcaattcattcgaaatttcgttttatccgtgggtaccaatagggagttcttccgataaaaattttcaatatgatttgaatttagaaaaaaaaaatagccgtgtcagagtatagaactcctgtaatggggaagctaagtactccccctttgtgagttcggccgaggtgcaagttttgagatcgagtgtttgatcgcacggtaaagataaacacaagcacatatacaggtttaggccgcggtggactatggatgattggaggaattataaggtgacgtaggaggagaaactcaactccttgcttgctgaattctcggtggcatgaattctacttatatacatgaaggagagtccacaataccgttgcatgcatggagtggagcctactcctctaaacttgatatgcttagtcttgtaggtcttgacactcttcttaaaaccttgaagatgtagatattgtagatctcgataatcttcttgaaaccttgaatatgtagatcttgtaggtctcaaactctcaatactcttcttgaaaccttgaagatgtagatcttgtacatctctatactcttcttgaaaccttaagtgcttggtggggctcgcagtgccccaagcccccctacaccttgagctctccagggtaaagggaacccctgctcccacttctccgacaagcagaattcctaaaattttgccaacaccgcccctccccctaggtttatgctttttgaaatagtgaaccctagtacaccttgttaatgcttttttttttgtcacatcaccaacacaattggagatccacctaaagccttgtggtgtgataggagtcaccaaccaccttgaccttgagaatctccttgatatccccaacgagctgctcagcgaccttaaacttgtgctcaaatattcttccattccgctcttttcaaatgagccaacaaaccatcaggaagaaagaatcaaaagcgttcctatagcttggccgaaaaaagcttcgcgcttgctgcgaacactctgctagctgcaaaccgctgtggcccagtgggtcaaaagccgcattaggacaatggtattatttgtcatgcacagcagatcttgcaaataacgtcaggtttagtttagtttcaaggatttctgaaccagcacagttacaacaattggtttctactctgtatccgctaaaaacttatgggcagctgcttccaagcgtaaatgggggaaaaaacttttcgtgtgtcttgcaattcagagattgaatgttcaacatctgaaaatctaagcaaagagtggtcgatttggtcaagttctggtggctacaaaacaaccagatgtgtgtcatcaaacaagaaaggtgcagaagaacatctcaaaatgttaatcatatgttcctaaggacataagaaatctgcttttgataggtgcaacagctttttgttggtccatttggctaaacagaaacggggtaatttttgacaacaagatggtgacttctcctttgcaggttattgctttagtcacccagtggctatgcatctggtctatcctccacaaaccaggtctttaggatactattgtggtggtatcacgtcgtttggatcaagtggcacgggagttttttttaccctggagcatgggtggtgatctagtctacggcttgatagtcactaatttctttgttttgtgttgagggtctagttagatcatgttttgtagctgtgtgcatttcatgcagaggccgggagtgagctcagttagaatgtatcatcttggtgtatttgactgagttttaataaagcttccattatcgaaaaagaagaatatctcgaaattaagatgatcatgcattccacatagaaggcgatggtcgaaaaatcaatggaatagttcagagaaatcaccttttgctcaaccacatatcctgattgcaggtgcattcccttcgtccatgtgagcaattgagcatatatcgacacgacatggccgttttctgtcgaaataatgatctgagagcaatctagtagtgagaaacataaagcacgcaaccgatgaacgcactgatcttcagcaaagtgtatagttgaagagcttttcacaactgattcacaaacatactgaaatcaactcaactggatatattgcagaacagtatatgttgagttgggataatacctcccctcattgaagaagaagaagaaggtgcatttctccagtttgggattccttctacaccttcactcgcgttgcaggttcagctgataaagaacggcggaaggatcccgcgagattcttcgacgaggacccggccacactgccgaggaagaaagatcttgcgccatggctgacgcatccaagaaccagtggtgcctgactgcctggaatggccggtggtcaccatcccatcccataatgcccctgtgctcaacaaacagcgcactcgcggcggagcgcctcggcggctcggcgccctcaggatgccgtagtggacggacggccgcggtggccggcgaggcggcggagctttggctgtggggttgagaagcggcgggtggacaggtgggggccagaggcagggcggttgacctagtgcgagggattcggaaacgaaggtggtacaagcggacggaggtgccccatggcgtccctgaggctgagggtggtggccgtcgccggccaggacgccgtcgccggtgaacgcggaagcccggaatctcggcccggtccaagccaaaaaaatatatgggccgtacgtacgccggagtcacataaatgggccgcacgtaggcggcactagaggtgaaaactgttggaattgttagcatatcttcagaaatgatgctagatcgatcgataattaaccatatttactatttaaattactcagtattgatatttatatgatgaaaaataaattagaaaaaacaaaaattataaataataaaaaacagcacggtcggaaacagtgttaagtcgaacgggaattttcatgaccgttttcaccccgcaccactcttccgtccgcgctgctgtctccatttcccaactccgcgcgctggttgttcacaattgctaactatttatttatgaaagacataccggaaattctcgatagatcgagcgtcatttctgtataagcggtgagacgtcatggtactgtttttcgattccattcatgtataaaatttgaattttctatttatttttaagcatcatatttttatgcacgctaaatattggtaaatgtggttaatttcatatcaaccaagaatctctttttttaaaaaagatgctcaacatgaatcttttttctaccgatctggaccattctgctagccgatgtacaagtaggttgctgatgcgacgacggcatggatgcagcatcacatcacaaagcttgagacgaatcatggtgcaaaatcccactcagcaaattaatggaatagttctcttacattggatgtgaggatcctctcaaattccccacaggcactgatttttctcaattatacttctgaacaagcacaaaaaattggaattgggttgcagctagcgatcatcgattcttgagaaactaatctcaagacgtgaaagaatcaagttgctagaagcggacggaggtgccccacgtctggacgtcgcggagggtggaggccagccagtcgaggccgccgtggaggccgtcgccggtgagcgctgaggctccctgacagtgccacctccggttcttgagctcctcgtacgcccccagccgctggcacacctccgacgagctcatcgcccctttctgcatcatgcatccacatgtcaattgttgtataactaatcgccattggcaaattgttcattgattcgtcaagcttttagcaattaccaggtcctgcttgttggcgaggaggaggatgacgctgttgagcatgagggggtcgcggatgatggcctggaactcctccttggctactcctatcctttccctgtccatcgaatcaaccacgtagatctgcaactccccacacattcagtttcagacattcagatttcagaagcaaagcaatgatcgatcgagagagagattcagaagatgagatttaaccagggcgtcggcgtttctgaagtattgtctccagagaggtcggagcttgtcctggcctcccacgtcccacaccgtgaaggccacgttcttgtactccaccttctccacgttgaaccctgatggaattcgttcatttcacaggatgaaagaatgtatgtctgtcaatgcaggtccaggaatggattatgtcatgcccatttcggcgatgaaataaatgacaatgaacacgatgtatcactaccgattgtgggtatggaggacagaacttcgccaatgtgcagcctgtacagaatcgtcgtcttcccagcagcatccagcccaagcatcagaacctgattaagcatccatcagaagagaaaaaaattctgaacctggttaagcatcagaaaggatgaaaaactgagaatggtgaacgatttcagaatgctgacatgatgttaccttcatctcctttgtgcagaagctgtcgaacagcttcctcagggactgccccatgcctgaatatgatatatgattatgatctatctaccattagttctttcctcttgattaatctctgcttcttcttcttcttcttcttctgattcaggctgccttttattgctttgagaataggaggtagttctcatcgtgcaaatcagcagatgacaccccattactccgattgtttttgcaatgcgcgcgttgccgtttgacttgcacctaccgacgaactgaataataataataatacttgctttgtgttgctgggatgctggtcgatctggagatgatggaaccaccagacagccacaaccgacagtgtttaatctaatttatttattgccggattctacaacattacaacgtaccctgtttcaactagacatagtaaacttttgtttggatctaagcatggtgattgatcatacctcttagtgaaaccttggaataaattacactccatgccggtcgaactattagtatttttaccttcatcctgtacaaaaatgcaatttactcttcgtaatcatctgtttatgaagtataaactacactgtgaataaatgattaacggttaatttaaaattgatatattacataatcaagcaaggtcgttgtagtatagtggtgagtattcccgcctgtcacgcgggtgacccgggttcgatccccggcaacggcgattttactcctttttttaatttgggccatattagattggagcccatatcgatcagcccacgggccgaaccgctatatggcgcccatgttgcccatattagattggggcccatactcctatcggcccacggcccgaagagccttatagcgcccacgacaaagcgttgggtcgtcgcttgctgcttctagacagttctacaacggtcgaggctgctccgtgctctcctccgctctgctttcattctactccccggaaaaatgtcctattcactttggtgcccctgagtccgagatgcttgctgattctccctctttttgtttccacagtttggctttattttgttgcttttgtgttgttatgaaaaggatctactatacttctttttctttccacagtttggctttactttcctgcacattgagtaggattaaaagaagagctagtaatgatgcaatacatgtttatgtacattatcacattgggtttattcaaaagagctaactgctgcagcgctgcagcaatagctatagtggctatattagtcagccagcaatgggctacaaccaacacaaaccatatgcatatgtaaaagtattgtatttaattttattcaaaatgcagcctagcctaaatcgctgccactgaacggttggatgtgcaacacagtctagacaactgctattaagagctaccgaacaatcattaaggccctgttcggctgcacatgcttcaactgtggtacagccaattcgaatagtactatgtgtctgtagctgcagcagcaagggctgcattgtagtgcagccgagcagaacctaagtgattttgtacctatatacttttataacttttgctctatagtttttcatcgagagtataaaaccttaatagtagttccatgtacggtattgaccaagtttaaagatctagtagaagaattcttaatttaaccatactatgaaatgaaaaccaaccactgggtgtacatgttacataattgaagcttcatactacgagattttgtacttctacacctttacggtttaatacgttctatagtttttcgttgaaaaatatttaaactttattagttttgtgtacgtatgacagagttttaagatcttatagaataactcttgttttaaataaaccccaaaccaaacgttgagtgcacatgttacatatatagtcaaaaacaaaaacaataaattgaatacgatttacaagtaaacatagtgtatagaaagttactagctcagctgtgtgttgctgcggctgcaaagcaatgacaactacggtatcaacatgagcaccaccaatgctaggtaatgcagctgttgcgtttgtgtaaaagtagctagcagaacctagccatgtcgtgggagcttttggcaaccgtactgctatagcttctttcaaagtatcaaatttcttgtacggtctaaattatcacctgaactttaataattcatatttttagattttataaaataaactacaagacaaaagataggaaaaacaaactttcgaaattctcatcgtatgcttctcggaatttgagctgctacaaacattccattttttgcctataatcgattatcatttcagacttggaaaggtattataacggcccatcgtctctcctgcttatttaacaaccattatttttaaatcttatatacatatatgtgtttgtgtgttttttagcaactttattaacttttatgtttttttaattcaaatttaaattatggttaacacgctaaaaagaaaatgatgaacttgtattgtgtatcactttatttgtttcaaattatgaggtgtttgttcaaatttatatgggtgtgaataaatctagacgagagataaataaaccaaaatatcttataatttagaacgaaggaagtagttcacaatcaattctcccaataagaaaagaagtcaatactcatgttttgcatgcacgagagactgacaacatgatcacacttagactatgtttaatttctaatataatgcacacttcttaaacggtttaacggtgcatatttttgtaattttttaaatgcaaataaacccttattcagggggtcagacagaaaggtagcaagcgcttttgcaaaaccctggcgtgtatttaagacctcatcccttcccctcccccttcccccaaacccctcctcacccgcagcgccccaacccaaccctccccgaggtcgcagccttatcctctcctctcccctccgcgaggtcaggtgagctcaaaccctatcccctcctcctccacctccgccgctcctccccgccccggggcgctgggttctccctcttccggtggcgacgtggtggggtgtggtgtgttgacccccgcacgattcggttgccgcgtggttggaggattcggtggatagttctcgccgcgcgattcgtggggggcggagagctcgaggtcgcgccccccgcttggttttgaggggggccttttgatggttgctcgtgcgggctaattttgcgctagaactgttatatcagtggaaattgttggtttagttagcacggggactacagaatgtatcagtggaaattgttggtttagttagcacggggactacagaatgttgttggctccagcgttctgttcgtctggttgtgacttttggcatggggtgttctaattcagccaagtagagtggagtaggagggtgcatgcgatattctgtttggcagttggaatgctagtgttttcatgtatgctagtgatggccagccatttgaagctgacgtaactgttagggtggttgaatggcaaacatttaaatttgaaggtgtagtttcaagtgctagaatgtattggttggccattcatgatattcgagaaggaatcctggcagcagagatgctttagttggtctctttttcgttcagttttagctatctcatacatatgcaggttatcaactcactgtaatataccctgaagtccagttgttaattaatcttctaccttgacactgtaagagatgtagtcaatgataatatgtggtaatatgcagagagagcacaaaactatgtttagcttggaaaatacatttgcacagaatgcacaacaattttaagctcttagctttggttggcaatacatgaactttcatgtgggacctccacctcagcttccattttctgaatagaagcttaagcatgcttatgattgttgctccatgttaatgttgtcattgctgaacaggaaatcatggcttcaacattcggtgccacttctacggttggcctcatggctgcgccaaccggaattgtatcagacaagaagccatcttctctatcttcggtgtcatctgtttctgttgccagccgaccacgcaatgcacgccttcagaggaagtgcaacttcagggtaaaagctgccaaggagttgtacttcaacaaggatggctcggctatcaagaagcttcaggtgagctccaaagttcttggacacatcttatcaaattttggtcactatgattcttagccttgaccaggcactcattagttatttctacatgtcagactggagtaaacaagcttgctgaccttgttggagttacactgggaccaaagggaaggaatgttgttttggagagcaagtatgggtcccctaggattgtcaatgatggtgttacagttgcaagagaggtatattacagtgtttattgcgtcaaatagcattgaatttccttacaatttgcttgtttgctgtatgctatacttccacagaaaaaaaatgtttgttttgaaaagtaaaacagtctgcacatttgctcacaagtttcatgcgcaagtgtatttctgtttactattgctggttgcatttttgcacaccatgttctatcataattacctttgtgggttctaatatatgatcctctgacaagatgaactaaagtttgatagctggtcattgacttaactatagtgattgtgcaccatttgttttagtcatgatataaagaatttttcaattttattttcttattgaacaagtcaactggaggtttctggattatctgtgtaacctagttccagaatttgagcagaattttcaagtaacgatctctgtactgcaggttgaactggaggatcctgttgaaaatattggagctaagttggttaggcaagcagcagcaaagaccaatgatttagctggagatggcacaactacttctgttgtgcttgctcaggggctgattgctgagggtgttaaggtatgctattagttgagacatgagacctctattacttgtatggtcaatctgttaagagtcgttaatttgtgaactaagtgaaaataattcatttgctctttttcaggtcgttgcagctggtgccaatcctgtgcaaattacacgtggtatcgagaaaactgcgaaagcactagttgaagagctaaagaaattgtcaaaggaggtaaaataatcgtcaggctctaatgctttcagaatgttttagttgtggttgtggcaacctggtgtttgttgcaacaatgcttagctagactgagtcaaatcagatgatttatctatgtagtatatgcttttttttgttctacttataaaaaacattttcttgctttaggttgaagacagtgagcttgcggatgttgctgcagtcagtgctggcaacaattatgaaatcggtaatatgatagcagaggctatgagcaaggttggcaggaagggtgtggttacccttgaagaagggagaagttctgagaataatctctatgttgtggagggaatgcagtttgaacgtggttatatctccccgtattttgtaactgacagcgagaaaatgtctgcagaatatgagaactgcaaggtagcttcagcctgagcacacatacccctgctgtatgctgctttaatctgtttcagtttcttattgcactatgtttccactatttttcagcttcttttggtggacaaaaaaatcaccaacgcaagggatcttatcaatgttttggaggaggccataagaggtgcatacccaattctgataattgctgaggatattgagcaggaggctcttgctactcttgttgtcaacaagcttagagggtcattgaaaattgccgctatcaaagcccctggttttggtgagcgcaagacccagtacttggatgatattgccattctaactggaggtgaggtggacttgcgatctggtgcatttggttgggtgatcattaatgctccttatttatgatgattctggagcatctggctggatgattaatgctgcttatttataatgattttttttctctgcagcaactgtaatcagggatgaagttgggctgtcacttgacaaggcagacaaatcagttttaggaacggctgcaaaggtggtccttaacaaagagtcaacaacaattgttggtgatggcagaacacaggaagaagt

SEQ ID NO: 21402 - DNA, 11476 bp, Oryza sativa
aatgctaccaaggttagtctgttgttataactgctttgagatagaaatagattaatgtttgcttcttaaggaagaaaaattaaggtagtttgttgctcactgagttgatatcaacgttcttctggctttggatctttaaaccgcttcctctttgtcaggctgctgttgaggaaggtattgttgttggtggagggtgcactcttctgagactggcagctagagttgacgccatcaaggacaacctggagaatgatgagcagaaggtttacaaccatgatctactttattcattgtttttgttcgagtgttctataaacctcatctctcaaaagttctgtttttgtgcctgctactatgtatatgggttagaaatgaccatctcgaatttgttgtcctttctaattgacttgttgtatgtattgcttgaactttttaggttggagctgaaattgtaaggagagcgctgagctacccgcttaaattgattgctaagaatgctggtgttaatggaagcgttgttaccgagaaggttagatcttgttcactaacagaaaatcatatgttcacatgtacatctgaataacataaaagatgatgttttaccaggttctctctaacgataacttcaagtttggttacaatgctgcaactggacagtacgaggatttgatggctgctggtatcattgaccccactaaggtctgttgctccccattgatttccgatatttttgcataaaaatttagattggtggattccctatatttagctgaaataattatagcagtgtggactgtgcagttacttttgtgttcacccttcagttcttacacatacagccattgttttgtgttgatgttagtagtttctaatgaagttctagatccaaggcttagtgttgtggtcctagaaagattgaattggatgcaccatacaatttgctaggtttgatttagttactgcaagagagtgaaattaactttgggaaacgctaaaggaaaagcatgaacacaagtaaaagaacatagaattagactgtagcccttgcacatggttgacacactacgattgttgattcccttttccctaccatgcttcatgagaactgcgatgagctaaagactatgctttcctgatgatgggcacaggtggtgagatgttgtcttgagcatgctgcgtcggtggccaagacattcctcacatcggatgtcgtcgtcgtcgagatcaaggagcctgagcctgcgcccgtcaccaacccgatggacaactccggtaaatgatattggccaaacgcactacacttcaatttcatgtgatcaaacactccctgaactgttgctaactttaaatctgctccgtctctttctgtccaggctacgggtactgatgactaagttacagttacttgttctccgggaaggtcactggccgtcaatttttgggtagtaggcttgaatctgaattttggtgagatttgagtagtttcgagacaatttgatttgttcccatgggaagtgaaataaacagggtcactatagcaaaatttgtggtgtaactggaacggctgtcaaattacgaaggaagatatttgaaagatttcatgctctctggggtttaccgttgacattcatccatttctggcgtaatttcctacagcattttcttggcaggcaggcaaagcagcgcagcatgggcttgcacgtcttcaactcttcatgctttgtctggtgactcgtgtgcatcagtaagaatttcatgcgagtatacgtttgtgatgacagcaatatccgatgaactcctgtattattacacggaccgatgactgataaagatgccgccggcgacctttcaccgctagtgtagggcctttttctttcaccgccggcgacctttcatcggacgtcgccggagcgagagaaggtatcgttaagagaaaaaaaatcggatgagtattctatcaaatgccatataccaaatccgttttctctaatgctgtaagaacacacgcaaattaattttagttcagtagaaaaactattgcgctccatcagttctcgtcgagagagaggttaaaaggcagtcactgaacatggggcccacatgtcagttagaacccaagaggagagctcgtcgatcgattcccccgcgaaacagaaatctcgctctcgccgccgccgccgccccgcgtctcctcctcctcctccctggccggcggcgtgaatttgaactactccgtccggccagcctccgccgctccatgccatattcatcccctcctccttaaatcctagcaccctgacacctccagtcgccttccctagccctatcaacccttgtgtttgtgaatggttggatggattccatctcggtgaatgatctcgcgggatttttttttgggcacaattgcgatccgatccgggtatcccaccgatcgaccgaagccgggagggcacgggcgatcaactggttggtttattccgcgacctccacttcattccattccacttaattcctgtacggaattgcttcgttttactcagtctggccgatcctaagcatctttcagtttgttgatcttgatttgtctatgtctactctatttcgggttatataagctgcagtttacctcccaggatttttaactgcggcttatgctttctagcaccctccgctgttagcatttggatgtgtatgtcgtacgtgtagccagtacctacaattaatttctgaggagatggattttggtgctatttttctagttaagagatggattttggtgctatttttctagttaagccgtcactagtaggttgtccttgcttcctgaaaagcaccggtagattgtttgatacttctgatgacttctcctggtcagtgtctctgaacattgtacatggtagtcatacgtctgaactttttgacacagcacatgtatttgctacttggttttgtttgtttcattctccattgcgttatctgctgtctattgcatctcctgcataatctcacttaatatattactctactgtatctcctctgtagtcaacagtataggctatagctgtattaacatggtctgtctatcttacgtaagtgatatgtcgtgttaaacatttgttcttggcggtgacagaacatcgtctttgacacttcattgtgatcccaattagagactaaaggaatgctttccaatgcaaaaggttgagcttacgaacgatcttgtttttgccactaaggagattcagctatgcttgcctacaagatgatttctgacggcgttgatatacaaggcattacatcaaatactattctgtttacaaaataaaatgaaattgattttcagtaggcggatactgctggagttaattcagtagactacttgtgatatcaccaaactgcagaagcactagtcactaaacacagatagatgtccgatcatgtagattcttatttatggtaaaccaataaatctgtacctctagttaaaggtatatttttatgccaatcgtctaacttttgctgcccaagtactcccttaattccgtgaggcaaatgtgactacttccggcatacttgatgccagcctggttttaggtctagtatgaggcttacactatgtgctgcatcagcacttaatttaagtcgatctgttccagatggctttatgcctcttctgttatcctgtgaacttatgaatgattctgttatcctgctctagtactcgtatctactttgtagaaacaaaaaattgtattcagtttatcggaatctggtggtgttgcaggtccgaaacaatgtgcttgctgatgtcacaatgtatataggattggcaacatgatcagaggctatgagcatggttatgtgctgaaaataacctctgttggtgatggtaggcagtttgattgggttattctccatagtttgtaatagttagtgaaaaatagatcagttgagcatgaaaactacgatattatcgtctaactggtattatcttccaattgcttagtcgcagatatcagtattctggaaaatggcataaaatgtgggcatccagttctgttaattgctggtaatattgatcaggacactgtttcaatccagtccttgtggccaataagattggaagtgtatcggagtatggagactgcaagaaaacctggatgatatcactttccaattggaggtgatatgagcttcaacatctatatactgtttttttctttcaagaatacaactctatgtaatgtgaatagtcaagtggagatacactctaaccccccccccccctacactctttcagtcagattctgtatctatatttctcaatttctgatcttcctgcttgcacttattactacgattggcatgcaggctgaaagtgagctcaaaggagaagaaattttgggtggaagatgctttgaatgcaatggaagtgttatggttggtacccactatagtccatatcagaaggtgaatgttctttttagatcttcaatccatcactcgtggtgcatgtattgttcatcagccgtcaaattccctgtgtcagcatttagcagtgtcagttcatatacttctggcacttttatgaactgcattattgtcttagttgcactactttcttttgtaatccactgctaattcagttagttgtttgctttcttgctaggatgcagtggagaaagctattgctgttgctggtgtctatactcttttgaggctggcatctaaagttgacttcatcatagaatctcgagaatgattagcagaaggtgggtgaatgaagctatcatttttgcgacacatcgaaagtgattatttatgggttcatcttattttctttggtggagattattttcatggtggcatattgtagaacctttttggtcaattaacaacagatcgtatcgcccttcctgtaggttgaggttgaaattgtaaggaaggccttcagtataatccctgaaaaggtttgaagtttgaacaccattttagttactccaagcattattaatgcatgattcaatattatgcggctgcgtactactgaaaataatactattagatctctacagtcaggttcttgctaatgacaacttaatgctgctactggcaagtacgaggacttaatggttgctgggactattgaccccactaagagcaagttttatagtatagtccattgctagctctaattcatatatagtcaatttaatagccaattcatataatatttgtttactatactattaatatctggtcccacctaccatacgcacattacgttttggagtccgtgctgtagctggctacaaatctatagtctgctgcttttctctatcttcttttatctttttaaaatatgtttacagctagtttatagccttctattgtacctgctctaaggcatgccattatttgatgaattctagttcctggttactgtatggatcttatcatttcatttaagccatgctcaaatactcacaataatttttgttaactatttttctcctttttcttttattagtcattttatttttcattctgatgagctcattactcattagccccgtagtagtgttttcttggtcagtttaagatgtttgatagtacgaaacattaacctttcacttacatatccataccctaaatctttttacttattatttgtgcttagagagttacttttgcaaaaggaacataataggcggtgagttgaggtgtcgcttggagcattctgcattggtggcaaattaagacattcctggcttgagagttgagacgtggttgtcgacgccatagagagcgagaacgtacacctggtcttctgcaacctgcaaaccaatggcagctagctctggtaatctctgcacctgatcccatgcacgcctttgactgtgctatcttgcaaatctagcatagggataccacgttgcagaatatggattctgattgagcaacggcacttggcttttctgtgaaactgtggcaactaaatcttttgcttacatacagataggacggctgcacttagcaacactacacccgtagctaagtgaagtgatttcatgaatgggtgtagcgttttctttaaccttcagtaaaagaatacttgatgccaaataggagtagttttcaacttaacatagggatagaaagtaaagtaaaatgggggtgaggggttcattggatactcaagagaagtctgtgattatgtaaggcccggaattttaaacaggtgcgtgcgcatttggcttgtcacacacacataggatgcccccctctgcttggctgcgtgttcgcttgtttctgcgtgcgcctgcacagctgcaaattttcaccagtgccagcagttgggaggtagcagtagcagtggtaaactagcaaaggcaaattcacagtggggggcctggctatccatccatctccttgaccttttttacctggagcatggaaggaaattccaaaaaccctcttgagctctttcgtgcttagacaaaaagaaaataccgtttgctccaagtccaaaccattgtacttttactgtaaggcaacccaagcacacatatagatactgctacattatgtctgcgtatgcatatagtgaccgttgttttgggtctttgtggttggtaaccactccttgcactgacagtatgactctacttattagacctgtgctgccgtgcattagatgtagtagtagtataacgttactgctagtagtattttgtttgtgaaggttagtaaaataattgatggattgtaaacaaagtctaccactatagtagcagtagtaatacaagaatagtaaaaaaacacaagatccgggtcggccggcctaggggtggaaggtggccgtccacgctccgtgcaaatgtgatcttcttcttcatcctagagaagaggagaggccaacggccggccattaatattccctcttcgatgcctgcataaaaagctgtgtactgtactactacccctctctctctctctctctctctgcctcactggcacctgtagtttagcgccgttgcacgctgcctctgtgtgtgtgacctggctggctggggctgtatgactttgcctatttggtgcctcgctgtactcttgggcccggggtctacttgcgaaaaaattttttaaccaaacaagatggaggaaaaagggcaaggattgaggaatatctctgtggtggagatgggtgattatacttgaatttgctggtgtttttttttctcattacttttgcacctccaatctttgcaactttcctaccttttggggaagaattaaatgtctgttcaagtctacaggggaatttaggccctgtttagttcacaccaaactttccccaaacttccaactttccattacatcacatccaaaactttcctactcacataaactcccaacttttttttccaaactaccaactttccccaaacttctctccaatttcagaaactaaacacacagttagtttttttttctatgcacagagttgaatagaaatttcagttaccccaagatatactattttaccagccatgatttttgaatcagtagtgcattagacatatcccaccaacaaatgaatgtagttgtagattatcccccaactaataatgtgcgtgtgcaatgattctgtcatttgcaaattgcaattgccgcctcaaaacgcaaatgccaatatgtgacacctgtgaagtgaaaatggtgttggcatcataaaatatttaaccaaccccaaagcatgggtaccttctaagttagccacacaactaatttaacagtgtactgctatcacacagctgtacaactggcatatcattgctatacaccagtacaaagtgctcgtgcccaccgttttatgctgtaatctctctcaacaactgaatagaaaatcaaccacaaaactccagctggtcaattcttagggatattcttgatgcggcgaaaatctctgaaagccaatctttggtgccacctgggtattgtgcactttgtactttgagctggaacgaacggcttgtgtcagttttggccgttggtaagggacaaacaatactggagaagagtattcatttccctcctgcaatatcttctcacagtgtagtagtatggtctaatgcgatccatacggaattgtacacaggagtacatccacatacatagaattgggtggtggccccaaaagtactctccatctacttgtagtagcctagtataatactggaatgtgatgttttactaactttgtaagcaaatcatgcatgtagccatgtaacttaggctcctttggcacatggtaattttcagaaagttgttacattcatccattcatgtaaaatccatgcatttctagtatcttcaaaaggaatatataggagtatatttcacaccattgatgtgtttatcttgtgtcttacaatactcctacctaaactagttcagttggttccagcgggggatgttaatacatgccgcatgagctatcagtcatgattgcagccaacatgtaattgtatgcttctccaactgaaattgtcgagttgggaggtgaccctgacctgcacaaaaaggtgaaaaaaaagaaaaacaatcttgcagagaaagttctgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttggagcttgtgtggagctagctcttgcatgagagccatcactccccacttttctttatctcttccacataagcatttagcttgcttatagctcaccattatcctttctctcagagattgttgcaagggaggaggatatgcattgttttttatctttagttttttctttaagcaaatagggtagtgtagtactttgggtcatggggaacagcaaaaacagctgtctggggttgcatatgattagtagggcaaaagctagtgagtgtgtgtgtgtgtgagagggagagtgtgtgtgcaagagggaggaggggccttttgtgaaaataatgataagttttggggagcaaaaggtgagaggggagagggttttccaatccagcttccaagtcaaaagggtcgcccgggaacgaagaagaaagctcaaagctaagctgggctggctgctgcgggcatgccagcatcattgccgctcttttctgctctgttggcatccgagacgcctcctctgtaaaggcacaccaaagctctcttcttggaccctcaacaaaaattcagcaactgcaaatactattagttattatagttatgtcagttagtagtattagatacagggatcaattatcccttatttaattctccctaatgatccttttctgtgttttgtttactttctctctggatatatggtgtgccattcacaaagtgattgacttgctttatttcattgaggattctttccaaccttgtttaggctctggcttgtttgcccgttgattgagttggtccaagaatcaggatatatgatattcatgacttactggaaagctgttaagcaacagcactaacactggtactaagctaggcatgttcttttaccagatcagataattttcatctgtttactttctgttatgtgaaaatgatccgagatttattgctgtggagagcacacaagctggaaggaaaagatgagtatgggtgccatttttgggcttggagggtggtccttttctctgctgtacattttttttctacaggatccctgctgtacaatggtagtagcttcttgcttcaatcagggcaaatggaggacagattttagcttgagctaacatgtgagcaggctgctggccacagtgcatgtttgcacacatggtaggcccttaactgagtggactgaatgggggtaaggtaaggtgaaaaccagactctcaaattcactttcattttttccagttccattggaagatgtttcacatgaaatccaactgcatgatcctaaaaggcacttattactcctgtagtacattgcttgtaacatctctaataatgcgcgggtcattgtcgccgaaatcttaacccgattcccttttatgtgtctgtactcctattagtatatactaaaacatccatgttgttcatgaaaatggctcattgctggtgacatgctgatgatcgcatcacgggcgtatcgctgtccgcagcaatacgttttgatgcgaactgaaaacattttatctgtactcgcatgcctgcttcgtaatgtaatgtaatgcttgtgatgttattgcaagcgatgtttgatataattgcttggttttatgtcatgacagggaagagagggaggtggtcgccgtcatggactgatgagggccgtgcgtgttcgttcgccaggccaggacaacccagcaagcatgctaactggtaagcatccatcaaagcttttctctggaaaacaaaacttggcctcagaaagtgggttctgatgaagaaaatgggtaggaaaaacagaaaaaaaaatgggtaggaaaatgaaaggggagatggttgtaaaacccttatcctcccatggctccatgccagggaggcatggagtgatggacacaggtcaagaggagaggtgcaagtgcaagaaggctgttttctttgtaaaccagctagtagtaaaaacttgcaattctctaatcagtgagccagtgacccctcctgggtgcaggtctcctaggagatagggcaagggaaatgaggccaggtatccaaaggcccatgtctctatttaccaggaaatgctatgggtccccatccatgcccccctaaaacaatcactgctttcctcctggaacaaaacatactattataactttataagggatgtaaacatgttgtatggtaaatttagctagccagacatgattaataaggatatgcgctttacaatacaaaggggtgttgtgtagtatgaaagatgactatattgtattataatttgatgatatctttaatgcaataggtttatatttaatcattaacaagcacaagtgattatagctatgttaaaatgactagttttatgatcttctataatcgatacgagaagacagggcagatgtcccttttgccaaccattcaaactcatctcgtttgataactacaagattgaccaactctactcttgaacttatgcatatgatccataaaaacccaagcatatgtggtggtcactattctaga

SEQ ID NO: 21403 - DNA, 8558 bp, Oryza sativa
atcacaagggatgaagtcacaactcacaagtcataacctcccagcccaaccaaggaggaaggagggacttaggccaactcatcaacaccaaacagtgtccaccctctcttggtccccctagcagatcccacccccataaaactgcccctccattggttggctccattggcacaagcacaaggccctccacttctctcttcactcccttccagctccccccaaaaccccatttcattccaacctttcaaatccgccatcaccacctttttttccccacacacacacacacacacacacacacatatacacattgacacatagcagtagtgtgtgtagtactagtacaaacacacacaacacaagcttctctcttcccttcttggttttgcccaagaaacgaaaaccaaaaccaaacccaagaactctcctcaaaagaaccacctcacttcatagctctcacaaggctcacgcacacatagagcttgtgagagcttcttctttctctctctcttgtccttgtggtagctggtgcttaaaggaggaggaggtgaggaggaggcgcaatgtcggagcagccattgccgcagcctcggagcagcatgcgggaggcgctggagaaggaggacaaggagaaggcggcggcggccaaggagaaggccgccgtccccaagaacggcggcaacgggggaggaggcaagaacggcggcggtaacggcggcggcaacggtggcgccggcgcccagcccggggaggagacgacgagggagattcaggtggtgagggaggcgtaccggagggagccggcggcgccggcgtacgtgatgccggaggagccgccggccatggtggagctcgtcgggtggtacctctacggcttctgctcctacttcatcacccacctgctgctccccgtgctgttcccggccatcatcacccaggtcgccttccccgcctccgacttcaccccggacaccaagtacatcgtcaagggcgccacctgctccatccatgagatgtccatgtaagagagactcagctcccttccctccactgtttgttcaaatcttttcacttcttcttggctgttttctctttgtttttttgagggggtttggtggggttttttggtttgagttttgaaggggttttcagtttgtttccttggtgatttgttttgttttcttctgggtgtatttttctcactccttttttttttcctctcttcaaaatggttgagaaaaatacttgcatctgtgtgagctaagctagatttaccaagttactatcatttttcccccttgtgtttgcactggaagtagtactattagtatttattctttcctttttactagaactttgagcaacttgactagtgatgactcttgcagtgaggtttttcttctttcctagtgtttcccctctctagctcctcttgtttaagacctctacaagcttatgtctccgctttttgaagtttccacctgatgtcttcctaaaatatgcttcttgttttgtacatcaaacgaacaggcatagtgcacttaggaaaaaaaaacttactcttttttctctgtagttttcttgctagtctcttctctgctcttgttcttggtttgaaagttttgagctcgttttaactttacatcgtccttcatcttgtgatctgtactcgtagttctctactccacctttttttaacctcttttacccacacatcttcaaggtaccccaaatgtgaaaataaactggtgtatagtacttcaaagattggatttttccgggctgcactttatatgtggcgtatatgcaaaatcctaaaaagaaatagcccgtgattcctgagattccatgtttctttgctctccattattagcagataagagattcttgtgcaaagctccaaaagatgctactgtttggtcctagatattgttcagtgaggctatttcccacatcccacatttctcttttattaatatattttcgtttttcctgagattttctctacctagacacgtaatgaactgcatctttttttgtcagtttctttttgttgtactactactagctgtgctcttgtgactgtgagagacaagatttcttgggaggaggataaggtcaaacaagaaatccctaggggtgcctttgtaaatttgttttaaaaatcttccgaacgttgagaaacattaggtggtgagatcgaaaatgtagtactgaatggacagtggaagccataagtatgaaatttatgaggtaccccaagccgaggcctgtgtgtctcattaaatatggcctgtgaaacttgcttccatgcttcagataactagccatatttcatttcaactactagtagtactgcaaaatttcttttgtgatccatgcagtgccatatacccctggagatggtagtagctcatttccttggctgatagatctagtttgtgtagctgagggttacattgcttttgtctcacttttgatagaaccaagaaaaagagtgcgcaaaagcagggccatgcttttgcctattctctttggcctgccctcctccctcccttttatttttttctcttttgaacaggaaaagaggcccctaaaccgttgcaattttgcctttaaccccaaatgctgttgagggctagccgcatgaccagccaactggtaggtgcaccacagtatggcatgcttaaattgcatcaggccaactaactgcccttgattgcaagggagattgttgatgctacttaaatgtgtcaacgttgacacctcaacacacaaaagttaccatcttttaacgggttaatctggtatgaacccctggaattctagcacggtgactttcagcaggcaatgcatgtgcttcttgcagtttatgttcacgcattgtttgtacaccctggaagcttttactgcataaatttcatagcatgcaatgtttacctgtacatgttcatgtgatgcaaccaaaccatcatggtcacaccaagtttgtgaaatgttggcaggtaccagaggctgaccaagcattcgattgccattgatggatcccggctgtccccgttgggctggagtggcctatcatgggcgattggaatcctcattgcggctccgatcctcacccaggctgcacaccaccttgaccgtggccagtatcagtcgctcatcctcattgccgcgacatcgtttggctcattcttctgcctcctcactggcttcttcaagacagtctgggtgttcctcttctacatcctgttcattggtgcatccatcattgttgctgaggctgtgcatacacgcaatcttggactcatgatccgtggccttgcagcacatgactctggcaagcaccttgtccttcgccgtcgtgctgctgccagtcagctcaccctgtattgcactgccattggtggcattggggctgcgctcatggctgctttcatgtaccacatgcttcggcgcactgaccagctcacaggcctttgggtcgtctccatcttcagtggccttatctggttcattggtatctgccatggtctcttcacaaaccgacccagcagctcatcgcccaccacagcatttgagcctaacttcttcaccaagctcagctacagcatgacccttgtgcgatacccacaggccatcggaagcttggttgcagtgttcctttcatctttcgccacaatgtgcatcttcaccagtggcacattgtatgctattggtggtgtttgcatcaagccagtccttgtgctcgtgctctggatactctacttcctgttcccgttgatctcacttccgctgctgcacccaatccagatcatcatccgtgctgatgctgttcgcatgcagctgcttgggttcatcatctgcctatttggtctggtgctggtttctacttcaagagccacaggtggagagccgctcacatcattgtgatcgctcttgtccagagcacagccaatggtgtgctgtactcatttggtcgcattctgctgctcgatgcctcgccaccagggaaggagggtgcttttgcggtgtggtatgcatttgtacgctgcattggtgctatgattggcttcgctgctgcatccgctgggcctgggcgtgctggaggatcgtttgctgctgcgttcctaggcagcttcctcggcatcattgttctgatctttggtaatgtgagcaacatcggggcgctgaaggctgctgggcatctgaagggaatggaagacgagaagaggctgggcatggagaaaggggaaggcatgagtgcggttgccgattccggcgagggaagggggagggtatgatgatgattaaatgggcttgtgggaaggaaagattggaaaattgctgtggaggttgtgtttgtgagagggatttgttcttctttcttgtttctttcttgttcatgtttcagtgacactgttaattcggtgctttgccccccttggatgcatgatgatgatgacatagtggtagaggaagtgtgctagttgttaatgtgttattctttgcttggaagacaattgtaactgatgatatggttctttgttcatcgccaccgaaattctctctggcagtcatgcttcgtggttgcttttctgttgaaaatgtgattgtcaaagtgaaataaaacccttatataatatttctattgcattgtgcaaacaaatttgcgcaatcttgtcacctgatttctggagggtgaaatgcaagatactattgtcactatttcctgtcaaaacaagaattattaaaaataagtccgggagctggaaactgaccggtgtaccaggcaacattgttattccgggtcaaattctattattttttttccctgtactctatttgaagttacctttgaattttcaactttgcccagcaggttctttagggttagggtttagggttaaactgaaagagcactgaggcttaaactgatttcgtgttcttgaaacctggataagggctcttttagaacgcaagagcaagaatttacaagaaaacataaaatccctatataatttctctatatcaaataaaacataaaaaaaaaaacttatgctaggtatgctggataggtcatgttatatcatcctatgtattttttctttttcagtaattatatcatcctatgtatttttttctttttcagtaaatctctattctgaatttttatttgcacgtttcccaagctcttaaacgtcatgttttgtgtaaaattttctatataatttttttagaatatttttctaaagcaactttccaactttgcaactagctaattcattacttcatatcctcaaatagctatcacaggagtcggattatccataaattttagctattttgttgttcggatgaaaatatagatattatcaactgttagagacacatggattttggcatcatttgtgatgccatcctaatgacttttctgccaaatgataaggtttgcagtagccgttgtaaactgtcgaacccttgaggataccctccatacctttgtcgaaggatgcatccgggcttatttccagacaaatgtgatgtaatccttctgactttatcagctgatcattgcacaaaacattgtacttccaaccatttgtttagtgtaaacatcagcacaaatagttgaacacaagcagttactagttcttacttaaaagctctggataattttttctatgtgcattacgaatgatgatcacctgacacatcccctttgcatgacaggttaatgaagggtttaagagaacaacctcatggcaaaatgaagccttaatttctctttcagagtttgttgggatgaaatcagctttgtacattaaatagtttgtattattttttctctaaaatcataaaagagtttgtttttgtgttgtgttcttctacctcttgcaattaaagaaaatgtacctgctcaaagaatctctcacctcatcaagacatcaacagcagaaacacatcacaaaccaggagacgacttatccaaatcaacaaccaaatgggactgcaatttagctcaagttgcagtccatctacggcagaattaacaataaaaacaacaacaaaaaaagagaaaaatttaaataatggtgattaggtcaagaagcatacgtacaatgaggtttacggagccgtccatatcaagccgtctcgacgtacacatcgggtcatgagtaattagtctcgtcggctgcattaatatactaccagtactactactaatgacttcattattctcattgcgcatgaagggtgtgatggtcaactcggttaattaattactatttggacagatcatttggagaatttagaaaaaaaagtacactatgatttatgggagttcatatatagtccaaaagttgcttatgaaaatactctatttgacaatttgtgccaattccatagtccaaaagccatcaataaagtggactattgtgcaagctctagatgcttgagtggccatgaaatcatccatgcatttttataattttatttagtggtagactttggatgcgtgaagagcaaagtttatgggggcgtattagagaagattaattgtgattttgggggtccataactgtgactttttcctacccaataaaacaattattgatggcaaagactaaactataagccagggaggcaagttgatcttcccccctattatcaggatttgttttttttttgaaaatagaatttgaatttaatctttttacatatatacacccggctacatatgtactaactacaagtaaagtaaagatatatacaaagaatttgtattattcgaagctgaaatcatgcttgaaaatttctaagttccaaacaaagccttggactaaaactcatattattgtcacttcaacttaaaacaaagtagtcaagcattagctttacagaagaaacatggttagccatgtgttgatggaccacttgttgagttgagaataattatactagtttatgatggtaaggttggttaacctactcaaggagtagatatttatgtggtgttggcatgacatatttagaggcagggagacagggaggcaagcagcatgggttgggcatgatgatgagcccctgtttcctaatgtgcctgccctggccctgccagtggccagtagtaggtaacccatgatttctgtgggttgcacaccattgcttgttttcctctcatcacctcaagaatggagtattcttgtttttaaaatatcaccctaagttctttattattttctttgaaaaaaagaataaaatggccatgagttattttccaatggagtagtgtttttttctactgactccatttcataatagtgcttggcaatattaactgactaactaacaaacaaatggttttattgaccactgatatcttttaacccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagtctttactgtaagaattttcttgcaagttgagaagaaacagacaaggggagctcttctttcataccgttgccagcacggctattcaagcaaagtctctttgactttgacctccacgctggcacttgccctacgctttgctatcccgtcccaaacgtttttctcctgtttctacatcactccatcaaaccgcccgtctaacactccgaagtacataatccgtacttcacgtcgatgcctaaaaacgtactactcccccacattccaatattaatatacaacggactataggattaggtttttttttttaacagagcagtaatatacaaggttgcacttatattaatatggtgggattaagtatttataaccatgacttaaattgagatgtacataaatcattttcttatagataatggattgtttcattagtcaataaaaacatcctacacctttacatcaactcatcaaggatgcacacatgcagtaaaaataaaagtgaaagaaagatgaaaaaccgtagtaggtaacatgaacatgtcatgttgtctagcgatattttgctctattacaatcatgaagagaatatcgggattatatgctatactttggaacaacgccttcagaaataaagatcttttgatgatgtcaatttctaaaatgtatttgaatttaatggcattgccttctaaaatcaaagtgaccaaagaatttttaaacttaattttgatttattgtatttcaccgtagtttatttttttagcattgacttttaaaccacgaatataaatataaaagctttatctataaattatttttaatatctttgtttgtttttctatgacataccagcctagcttaactgcttaagtgctcaaccg

SEQ ID NO: 21404 - DNA, 541 bp, Oryza sativa
  unsure (1)..(541): unsure at all n locations
tattattttcagtagtacgcagccgcataatattgaatcatgcattaataatgcttggagtaactaaaatggtgttcaaacttcaaaccttttcagggattatactgaaggccttccttacaatttcaacctcaacctacaggaagggcgatacgatctgttgttaattgaccaaaaaggttctacaatatgccaccatgaaaataatctccaccaaagaaaataagatgaacccataaataatcactttcgatgtgtcgcaaaaatgatagcttcattcacccaccttctgctaatcattctcgagattctatgatgaagtcaactttagatgccagcctcaaaagagtatagacaccagcaacagcaatagctttctccactgcatcctctagcaaagaaaaaaaanaaagggccccaaaaaaaaaaaaccccccactactgaatacagtggatacaaaagaaagtagtgcaactaagacaataatgcaagttcataaaagtgccagaagtatatgaactgacactgctaaatgctgac

SEQ ID NO: 21405 - DNA, 35184 bp, Oryza sativa
aaacttgagccggcaagattccttcctgcatcaggttcagttcagaattgtagtttaagaacaagtttcagttgatcagcagcagcatcagctgaggccaaattctcctgtttgtcaatgctctggccaacagtttcagatcatgatattattatctaaaaaagatagtttcagatcatggtcagatttcagagggtaagaaaaaaaaagtaagtgataataataatacaattggttaaggacagttttaacaagtaagctcacacctgaccttgagagcaaaagttctagagctgctctgattcaaaaggccagccatgctcagattgctttatgatgtccttttgattaatcaatccaaactaaactgatactagtactgcaaagtcatcaccaacacgaacaaaagaaaataagaaacaagaaagcaaattaaaggacagaacagtcaaagcgagcgcgccaactctttttgaacggcggaaaaaagaaacaaaaaccagcacaaaaggtgaaggaggaagatgaactcattcctcaatcctccagcgtttacctgtcgctgaaattggggcgaccctgcaaatctctgaagaccaggatgatattcagatttgtccatacaaactattatattgtttttgtaaaaaaaaatcagattaactgttgaattagattgtggtggtttcaactttcaggtgtggagtcaagaacaagtcatgtgaatgcaaagtgcccaaaaagcctagatttgaagtcacataggacacctatcctgagcactaactgaaatctgttgtcacttgatgcataagatttgtgtacccatgacagccaacaatggctggataatgttagacatattggttgacatcacaccaggccacgaattcctaatccctaatccttcttccttttagtgccaaagttggtgtaggagcagtaaacagcaacatgagtatgtcctaagaattcagaggtactgtagaaatgattaacatatcttcatttattttactgttctactaacttgtattagctcaaattaatgcctagcaatcctttgatgggttttgcaaaaattaaaaaaaaacgtactttttttctgtccaaactatagttgttgtaggacaatagtttataaacttttcctatgtgcgacatgattattattttgaaggtgattggaggttacaaaaaaaactttctcatgcagtagctttcagtgtgaacagtaagagaacttacacatgacatcttccatctagaagtgcaggtatcatgaagaaaaaaaaggacatggcaacaaatccatttatttcagccaaaatagattatgtaagcagcagccagccatctctctgcaatctagataagaaaagagaaaaagaaagaaaattaaagttgaggtgacaagtgcacataaaagtcttttaaacgtctaggtatgaaattatgtgatcctttcgcatcttccaaactccaatccgtctcatctgctcctcctcacatcattttcggttttcctgtgagcgatgcaaagtctactcttgtgtgtgcatgtgtggagactcagagaccacgattctcactgcaaatatatcattttctttctctctttttttttcaccaccgttcaactctctctttttgacacaacagcgatctccctgtcgtgttgtcaacttgtcatttaggaatatgtgtgtgtgtttttcttactggatttcacctatatattttgttcattatgatctgtactttttccatgttatcaatttgaaggtagccagggtttttgggattcactgatcttacttaccatctgagtgcacactcacaagaaccataaaaaggcccttgcatgatgcgtcttccatgtaatcgaaaaaaatagctcctgcaagacgacaaaccatttagttacccatactcttttcgtacatggtatctccaaaccttgtcacataatatttaattcagttctagaaccggttgaccccaaaacataaaagcggcaccctccatttccatctagtggtagtcaaatacgatgaaaaatccgggtgcaggctagacttgaatttggacccggcgtacatatctacatacaatttggtcaatactctcaatcttttccatgaaaaaaatcaaaacttgtccaactcatgacgacatagaagctgcatctgatggtcacattcagctggctgggtctggaagtacaaccgctgggccagtgttgatttcttggcacaccaaagccaaagaaggccacaaggttatcttcaaagtctcaagtctagtcttgttccatatgaacacttgccctgtttgtcatttctcttttttttttctcacttgatgcaaatgttgcaacatcatcaagatgttgaggcctcacagggctccaaatgatggggcatgctggagagaaattaaaaggtaaaaaaaaaagagaggacaaaagatgatgctgatgagctttattccagtcattgttaaacagcaactggccggctaggtgtgccgtttggttttccatattggcaactaggtgagcatcaagccatttttgacccaaaaaagggatcaaagtgatcacatctacatgtaaaagaagataagagttgtagattcttacggagtacattttactttggatgtataattggagtgatcttttttaaaagcatgccttcgaaaaaaatcttgctgatgaactaggcatgtggttggtctgagaaaccacacatgtttggctgcaagaatacctttttttctctcagtgagatttttttgtccacatgaactgtaaacattgatagtgaaccatcattttgaggtcatgttggttacaggtaatactgtagcaaattttagttgggcttgcaagaacaggtggtgaacatcaaatgattagctttatgaagctgtctggatggtgagattaaaaatagttagtaaaagagacgaacttgtctattgtagagtggatatgcatgtactattgattactgccaataaaaaggacaggacagccatcatagtgggttaatttagaagactagcacaagtgctcagtgatttgtttgtgattttttttattttaaaaaagaagctgaaagtgagaggatggacacaggacaggagaattgtctgctacttgaagcctgataactacagatgctacaaacatagatcttttggcccagcccaacataaccaacacatatgagctttaggcccagcccatgtagccaaatagcccagatggaataaccagaaactggctaggctgcaccagtggtctactctgctgccaacgatttgtcttgtaaatttcaataagaaatcttttactagacaatcttttctcttgtaatctaaattgtaaaacaactgaagctcagataagtacaaggagcagcagagcacctatacattctgcatttatatacatgatcagtgtgacataccattgcaagaattttcactggaaatgggtttcagatatgtgaactgatgacccatagatagcataaacccccagagaagatctcctagcgtatatattcttccctaatgcgtctgaaaatttgatcagagatgcataagtcatgaattttatttaggccatatgataattcagaaggagcatgtagagttggagataactaatagtgaaatcgagactaaaaatatcaacaaaataatccctaacccaaactgcatgcataaacaatatcatggcccgtggaaattaaattcgataactgtatctcacgagataggtaggtacctgagtgcctgaatttcaaatctgtcgaaattaaaaaaaggaatacccactgatgaacacacacctgaatgtcatatgctcgtcagaaatatatttttccactgcacatctgcattcgtcatactgctcgatcaggtggccggcttacgtcatcgtggatgcaggatgcatatgcagacatggccggagaaggcagcgacggaggctgctcgtcgccggagatccaagaaggcgggggttccccttgcgcgactaaacaatacaataggagataattgtagggacttttaaaaaaatagaccaactcccggtttgatagtggatttatgcataaacacccctgttcccgttcgaatttacataaggaaacctccactgaactgcacgcaaagtttaagaaacgaattcaacttaacagttggattccgtttcgaattaacaaggaagcaatcggttcggaataacagttcaaattagatccgattcaattcaattcatcatgcaataaatatatgagctcatggcacctgatcggcaatcaatcaccaaacgtgggtcgtctcagagatcgatcagcttcagaattcgccgtcgatcaatttagacatctatcagctcgcgtgacatcatcaatggcggcggcggcagaagagaagaacaagaagatgatcaaggtgatcagctccgacggggaggccttcgagatgacggaggcggcggcgagcatgtcgcggatactcctccacatgatcgaggacggctgcaccggcgacggcggcgccgggatcactctccccaacgtcgccggcagcgccctcgccaaggtcatcgagtactgcaccaagcacgccatcgccgccgccgaaggtagcagcagcagccgcaaggcgaaggaggagctgaagaagttcgacgtggagttcatggaggtgggcatcgacatgctgtacgacctgatcatggcggccaacttcatgggcgtggagggccttctcagcctggcggcgcagcgcacggcggagctgatcaagggcaagtcgccggagcagatcagggagatgttcgggatcaagaacgaccacacgccggaggaggaggagcagatccgcaaggagtatgaatgggccttctaggctatcagggtttaaaattgtggaacgaaattccagttttatcggaggggacccctccgatatgatattatttcggccgaaattttaattttttttctttctctttatgtactaaaaaagatgtccgtgcgttacaacaggtgaatgatattttaatcttattattgttatggtttggctagcgtgaaattcactgtggaaattcgcttggatattttttttagaaaatcatgagctgtaattaggagtctgacattaatcattaggagtctgacattaatctcaagttagtatgtaaatttttttaaaaaatatttcttatacgactccttttatattttcaaaagcaaacaagtttaaaatccgactcaaacacaaatatgtattttcaaaagtgaacgaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttagactcgatattcgattgaattcatggaaaaaaaaggatgcgcacgtagcatctgatcggcaatcaatcaccaaattaacataggttatagagatcggacagcttcttcgccttcgtatcgatattttacggtgccgatcgaataaattattttagttaggattgaataaattattcggagtcatgtgaccccgggtaatcgaacgtgggaacaccactacccgtatccgatgggaaatgtagctcttgatgtttttggcgccaagatatcaatatatggccattatatatcccccatagaacaatcacatatactccctccgttttgaaatatttgacattgttgactttttaacacatatttgaccgttcgtcttattcaaaaacttttgtgaaatatgtaaaattatatgcctacataaaaatatatttagcaataaatcaaatgataggaaaagaattaataattacttaaattttttaataagacgaacgataaaacatgtgcttaaaaagtcaacggcgtcaaacatttcgaaacggagggagtataaggaaaaaaaatctaatacacttaattgtctctgtaggaactactagagggaattcagttctaataaatcgtcttggttccattataaggcattattatgcttcagtaataaatatccatataagtcgctgcctttctttcactacgctgacaaaaatgcaaatgtttttttgcttctggcaactgtgcttctgttccgcaactaaagctgtatcactatgtgctattttattctgttcttgtctgatgattctatttttatgggggaaatgagctggacatgcttgtttctatggtttacaactgttgtatgtctattttgtttatctctattagtatcaagagcaatttgccaatggtctatgttataatcatcatggtttatacattatttattattggattaaattgaatggtaatttactgaaagatatttccaacattataaaccccaagaagatcttccctggcgcgtgtggaagtttgatcagatattaagcattttagataaagaaattaaataatctggccctcttcaccaaccgaatgtatcagagattagcatttttggataaataataaggcggccgagaagagggtagatttttttcttcagttctttgcgctccaatccgaaccgcacgcctctcatctgacggtcgcagttgagtcggtaacaaattaacaaggtgataagcgatccagatttatgaagaaacacccattcttctcttcgaatttacacaaggaaacgaattcatcttaacgtacatttggattccgtttcgatttaacaagcaaagcaatcgtttcggaatagcagttgagatattagactcggattcgattcgattcaattcatgcaaataaatagataagcacagatcacctactgatcattggcaattaatccaggtctgagatcgatcgatcgatcagcttcttcaataacaatttcggggacggctaatgggcgatcgatcccctcgagaatttagactatttaccatcaaattcgcgtgcctcaatttttttaccacccaatccgtatgccctttataatatgtcattaggactgctaattagtttatttggtaccacttttatctatctttttatctatctttactgtaattttcttttcttaattttatttgtatatattttcaagatttgtggacatttttacccctgggcccacctgtcagatcaaagaaagatactctgggtctggatcgattcgctccctccaggcgtagcgccaccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatctatggcggcggcagaagagaagaagaagaagaagatgatcaaggtgatgagctccgacggggagaccttcgagatgacggaggcggcggcgagcatgtcgcggatactctcctccacatgatcgaggacggctgcgccgacggcggcgccggcatccctctccaagatcatcgagtactgcaccaagcacgccgccgtcgaaggccgcagcacggcggcggcggagctgaagaggttcgacgaggagttgatcgacgtggacacggacacgctgtaccacctgctgatggcggggaacttgatgggcgtggagggtgtcctggagctggccgtccagcgaacggcggagctgatcaggggcaagtcgccggaggagatcagggacaccttcaagatcgccaacgacttcacgccggaggaggaggagatcatcaaggagaacgcgtgggccttacagtaaatcataataatttgttaggcgtagtaataataattagtaataatagattttttttgtttatgcttttgcttaattattggtagtatcttttgtaattgaaatgttctcgagtcctaatcgatttgattagttacatttttgcaatattgttcaatttaacatgtgcatgttttggcgccaagatatctgagacatggccattattccccagagaacaatcataaacaatctaattcaccttaattaatcgtcttggttgcatatatatgatgcttcagtaatgcagggaacatatgtttcagtacactgcactcagcaggctggtgtagcaacatcaggagaaattttatggacatgatccttgatcagtatgtaaaagaaaaagggcataatcattcatgaaacaactctcagcgacatccctccggcgtcacacaacataaccattaaccaacgataatataatattaaggcagcattcacatggtcacagaacatagaccaaccctgcacagtacatgcaagaacctgcatttctcatactacagatacaacttcagtgtactcttacaagaatccatacatatgccacaggtcaagaaaccattaaatcacactagcaagtacggatatggcttgtgcaacgctggctaaaacttgatgagaacatcattggttgacatcataaatcaaactgggtaccacccacatgttgtctacttgaaagtctgggacgcggtctattctactaggaactggctgaccgagctcgaccgcagtccaaggttcaccagaatctccagatggtttcgcaacataaatccagttactctttccgccccatctttcagggctcgtgcaagagaatgtagggtccctcccatcaaggttgacaaagagagcctgattttccaacctttccatcttcacacactcaactgtttcagcagaaaactcaagacgaaagacttgaaaggtgcgaggcaattggtcgcggtctgttgacaaatcaaccatgagaagcatttcaccacaggccaccagccatggcccagaacgtgggcctgtaaccatttcttctcgtcgcagaaccgctacttcctgtatgctgagctcaggtgcaaattgcatggtgtgaagcctgccaagaacatccatcgcaaaaatctcacctttgaagagcacaatctgaagaatgtgctcaccgccataaccgtgctttgtccaagagtttgttccaacctgccaatagaatatggaagacctcgaacaaagtatcagatgtgagttgggtgaattaagtggagccgtaaggatgccgtagtagatatccctgtcgcccatgaagttgagtttgggagacttcagcttagtgctagtgtaagcatcaacaaagaggcagttcttctcatgataggagaagatgagatatccatatgagcagcccaaatagcgcatgcgatttggagcatctggcggagctgaacaacgaagggatatgtttctcttggatggatcatcaagctgccatttgcagtaagataaaagattgtccttcaaaaggacgcgaaggggacggatattaggtgtatttagtttgaggcagagaggtgggaagttgaaagtatatacggatggaaaggaagatagcgcagctcgccaagagtggcaggtggcactaaaagcaagcaagtcctggaatgagctaagcaaagcaatgatttggtgaaggaggctttccaggagacctggccaaacatggggttcacacaaggtagaagatgtaggcactgatgagtggcaggttttcttaaagggcctttctgcagcagcaacttccctgtcaaacaaagaaaaattcagagattactggagcagagaaaacattcgaagataaaattactacttcctactagtaaagattgagagatagagtggagtgatattgatccaactgtgttgtttcagtgaagcaatataaagcagtaacttcacctacagcttcttgagtcattacagtgacccttatgagttatgacacattgaggcaaataaaactgaccatttcattgaactgtaagtctgtaacgaactaacgattcccagaataagatgtgcatcaacgtcctagatgccaaccaaaacaatatacgccagaaccacctacagctttgatatcttgaacaataccacaattgtaataatctgtttatattgtgccaaacctatttttgtttttttcctcccttcccttcaaaataagacaaaatggtacttcgtattccaccctcccaaaattaatgaaaatgtttattttgacagtatgaatatgcggcaatacaccctatttatctggaaaaaagatagtgcatttgattaataatttattaatagatctggttggttcctttggcagccaacgcagcttcagccatcagtgattcagtgtcaaatgctaccatacaagaatgtcaggtaccataaacttcttggaactatatacctataatcaactagaaatctacaaaactaagcaaaattgaagcaagaacggaaaccaaattacctgtggccgagagcgctcagctccgttggcggcggcatctcctggcggctcccgtccatggccgctgctgctcctaccactcactaatccgtagcttcaccggatccgccggccggcgaggagaccgggcaaccggcggcggcgcgtccgagcctccgaggcgaggcgaagcgaagaagcggcggatatggatgcgtcggcgaggccatgatccatggcccatgggaggcccaaataatccgcaggcccgtagaacttcgcagtccggcccaaatattgagttgggcccataattttcggcccacatggagagaccaaactggcccacgttgaaggccataagacgagcaggagaaggggagagagagggcaaaccgacatcgccggagaggtcgccggcggcatcgtcgtcctccccgtcgccggagatcggacctcctccacaaggtctgcgctctctctaccctcccgccttctcgcgcctaaaccctgttcctcttttttttttcttgataaatttctcgatctcttgtgtcatccaaccctaaccaagaaacgggcgcgttcgctagggttggaatttccactggatttttgttgttagatgtgcttgctaacaaagtaacaaccctagattgatatggttgattaggtgggtttatcaatcgtgtcatgtaaatcaacgtgcctcttctacttttggggttgatttttttaatagaaaaatagtactctttggatgagcggtgttgatttttttaatagaaatttggaagccaagcatgagttgattgatgtacaaatggagagaggaatcagtacgcaaaaatacactcagatcatttttatgcgcgttatttgattacacagtactgaagtgctccatagaaaagctcaaaactgtactatgcaggaaaacatttcgattagagaaaaaaactagcccttttcctctatgatattgtatatttgtatctccctgaacataaaaatgcacctggttgaattgaaatcttctttcccattgtataatgacgatttaggctcagttcgtttgtgatggttctcaacctctccttctcgatttccgcgcgcacgtttttcaaactactattttgatgcgttttttgtaaaaagtttttatacgaaagttgtttaaaaaaatcatattgtttcatttttgaaaaaaaaattagctaatacttaattaatcacgcgctaatggatcgttccgtttttcgtgccagagccaaacgttcccaacctgctctttcgaacagagccttagatgtcttctgcatgtatttggtagctgaaattctagcaggcttccagattagtcagtttcatccttctaacttgtgatcaaattcgttatgtgttgcagggagttcggcaatctgccatcatgcaaagccccagcaagatctctgatgcctctggctcaatgccccctgccacgtctgtgcgcaaaggttccaagaagaactgcttcactccattgttcctctgttgggctccttcgtcgacattctcgcctttgctggcacctgccattcttggcgtgctgccttctcatcatacccatcaaaatctgcctttcgcaccttactcccaccactcctcgtccgacccaatgtccgcgtcaaatccccttgtatcccttctaccagcaatggtcctcacaagctactacgctcatgtcaggtcattgatctagccaaccgaaacaccccgctccgctgccagattcctcgagaaactctgcagaagatgctttttgcaggctcttctcatggtcaactcatatgctgccgcagtggttactgtctcgttgttgatgtgttcaccggtgctgaggtttcaccaccacgtcttccattcagcaaggaccatgaggagatctacttttgtggcactctgacggctcctatcacgtcacccaactcacatctccttatcagcaaccggtcatctctgttcgattggccggttggaagtgactcctggtctgagctcaagcttcctgttaatcgggtcgatcagattgtggaattcaatggtcagctcatcgccgtgattgaatacaagctgtacactttgcagttggcccccaagcttcgcctgaagaagatgaaaaccctgtggtgggatgacatgagtgaatgtccatatttgagaccatggctagtggtttgcgatggcatgcttctcattgttgaccactacataactttgtcatttggagcaccagtcaactacagaccgtaccgcctggacatgtcagccaagcctgcaaaatgggtggaggtaaagaagctggagaactgggcactctttatcgggggtgatgcgagaagcccgccgtttgctttcaagaacccggagcgctggggagggaggagcaactgcttgtactatgctcactactcccagccatggagccttcatgggttgggtgatgatgcagatgctgtgtgggatcctaccactgatgataaccttgtgttcaaaagaaactggtacagtcagctgcaggccttctgggtgtatccaagcatgttctattcagacggagacggccagtgattggcacacgcacgagtgctctgctcttattagcttcttctgaaattgcccccttgtgatgtagagcagagacttgtgcaacttggcctagaaatctaggagatcctcatggtggtctttatgtctagtttaacacttgcagtcgttttgtagttcagttattagctgcattaccatctgatagtagggtgtgactgcactggatgcaagtgtagttaactagttgttgcttttccactggtgatggtaggtaatgtttcgttctgtaagggtttggaacttttgttcttcttcacagcaatggtttggaacactaatgtaatgcttgtgcactttgtcttgtgatttggtgctgctccaaattttcttgcaggacaaatagattttcttgtactgggatattttctatgtacttctgaatcggaatcacattggtaactttgatctgtaattttggagtttcaggaagcagaaagaagcctagtgttccggtaatgggttgataaacatattggggcaattacaaatttaccacagttttaaattgttattgcaaaactacattcgaatagcattcttgcaaaatatcataaaaaccagagtcttaagttagattaagaaaaacaatggacaagtttgcaaatgccccaaacgtataagatttacataaacccctctcgatcagatcaaatccactccccgcaaaaaaaaaagaaagatcaaatccactcaactgcacgcgtgtgcatgtttcagaaacggattcatcgcaacagttcgcattgaaattagactcggattagatcggtttcatgcaattaattgatttctccgtgcaaaccggtcgctagctcgctggacagttgtcgtcatcaatggcggaagaagatatcaacaagatgatgagctccgacggggagatatcatcaatggcggagagggcggcgagcctgttgcggcaactgatcgaggacggctgcgccgccgccaaacccctcgctgagatggtcgagtactgcgccaagcacgccgccggcgaagctcaaggtaaggaagaggaagtattagacggcgagtccagcgacgaggaggagacggacatactcaggctggaggccagcttgatgggcgtggagaacatgctcagcgcacggcggagctcatcaaggactaggacaagccgccggagccgtcgccggagaacgtccccttccacggctttcacagtatacattcatttattgagcactgctacacagactaaattttcttattaacaatcatctcaaccatcttattatatagtatatatagtaaaagcagcaagctatattacacgagaatgcgccacatcatcacaaatataatagccatcagataaagggtttgggtaaactatagccattggatcaaacggatacatgtattaaaaaaaacataaatgggctaaacatatggaaatttccggaggtttctgttacctcctctagacacatgataaaaatgagtggggataaagagagaagaaagatgaggtttctagtgatttctcttattataaccatatagtacaacttggaaatcaatactttgtaaaataaaattaacttattatatcaaagccttcttcaaagcttacctaaactaatagaccatatagaaaagttcttaaacagattaaaagtcacgcaaagcgtgactacgaggctagtttaatttagcactgctacacagactaaattttcttactctctccatcccaaaataattttcttactccatcccaaaatgcttgacgccgttgatttttttaaacatgtttgaccgttcgtcttattaaaaaaatttaagtaattattaattattttcctatcatttgattcattattaaatatacttttatgtatatatatagttttacatatttcacaaaattttttgaacaagacgaatggtcaaatatgtttaaaaaagtcaacggtgtcaaacatttatggaaggagggagtattaacaatcatctcaaccatttaatttagttatatgaaagttataaaaaatcaacgtacactcatagcgtgacacgtcagttttagtaagaaaatgttaatacgtatagccttttccttgtttatttattattagttaaagacattattattcagagtaattagcaatagatttttttattccttgtaaaagattttgaatcctgattaatgatttatagtattttgcaacggatttgctaaatgtgtcgccagtttttttaggtttatcaggttttggaaaataatatcgctcagcagataaacgtgccttcctgaccagtataaaaaagaaggcaaattttcagggaacaatgctttcatgaggaatccatttatgccgagtcaataaaccgtagttaaatcacacaagcagtatggctaaaaacttgatgacaacaaaacgaagatgatagatagatcactggttgatgcaagccgacgcttcttcattcaggattccagggatgtactcacacatgacacattagtgttagtgttagtaagagtttactaataaaatttcagtgagttagtaaaccattactaaagcaaaagacatgattaaatgatcgtccgattttcggttctggaaactagtgttaacctatctatcatgcgccttcttgatcgctaagagaaggtaaagtaaattgcaatgccaaggcgttccgctaacgaagtcaatcatgaaacaactctcaacaacattcatagtacaatttagcctaaagatatatatatattgtgcaactcatgcgtcacataacattgtcagctatataatgtaagtctggaactgtcgaaacatgaattcggcaataataaaaggggtagtgcacgagacctaaaagtggatggatacggagacaaggatttagacaagttgaggccctctcaatgagaggtaataccctactcctgtttgggaatttgaatccgccgggtgtagtatagatctgacgatcatatgtgctcatgccccctagagggcctcctgcccaccttatataggatggagggcaggattataagatagaaaccttaaccaatacggtatcggtttactaaatctactttacaatcttatcaaaccaggactttagaccgttccgtaatatacaaggaaacgtaatacccaagtcatgatatgttacatatttcatagatatgagttatctcctataactagtcggataaccatgccgtgtgggtatggggtacccataatctccacagtagcccctaagaccttcgcagtcgaaaagataatcttctcacgaactagattattccaaagccgagtgcttcaatcatcttcgctatgatctcccgagtacttttaccgaatcagaagaccgtggagggctgaaaaacaaagtcaggtgcatcgactagatgcacctaataggtgtagccccgactatgtggttaattgaataaaccaagcatacagtcagggaataaataatccaaccaactgagtggtttttgatcattatagttaaccaagtgacttgatatcaatatatagcatatgcggtatgaatccccaaataacatgatccaagtgatataccgactgctttgtaaaaattgatgcgagcaatctaaagttgactacatcattgaaaattcacttagcaaaacagctataaaaaagcttgaatgcagtgaataaagaaatttccaaagtattgggcatacaccatgcgcacactgctttaacagatgtgcttaagtccttaaaagacacatggtttcaccacacctggaaatatacggcatatgtggtgtaacatccgagtaaataaactcataaggatttaccaaccgcctggaaaatgaccacaatatataatcagcctaagccataatattggtcaataaaaatgcacacttacgtggcaaaaagcaatgatattgtatccaatcaattgcttgataaacccaaatagcgccttgactatataaaaaagtcagcggggtagctataaaaaacttcactgttgggcaccttttaaaatgcattgtaccaactcctaaaaagttgagtaactatggtataaaaagattttaaggtattgggcacttgatcacgcgcactttggcctaagcaaaaagtgcctaagtccctaaaagaacgtgacaggtcacacctgaaaatatgggctgcagacatattaggcctaggccaaaaaatatgccttcgacatcctttaaaggatgacgcatgtaacatgctcccgagtaataaatctttcgggtgatatagaccaagtgtagctcatatgaatagcttatgatctgagtgattatcccttatgggatactcccaaatagatataataattgaatcccgactggcgtaagtattcggttgataacccttacggggaataataaatagtccagtctttgagcatagaaaatattggtggtagtgaagataatgataccaatcaaaagtgatgaagttgcacagccgtggaggcgaataaactagtcgatagcagtcaggtcagccagcaatgaatatgaaggcgcccagcgataaagttgcatagccatggcagcaaaataatcagtcggtgacagacgaggcagctggtgaagaagatgaagatgcccattagcggtgacataataagtcatccgtgaaggcgaggatatcggtcggtggtgacgaaagcaagccgagggtgaagatgtagacacgcatcaaaggcgatgacgaaatccaccaatcatgaagatgaagaaaatagtcggcgacgacaaacgcaaccgacagtaataatgattagcagcaacaaagatgatcgactatgatgacgaagttgcccatcaaacagcagtagaataggctatgttgaagaggcttgacaggatattgatgaagatgacgatgtcggtaatccagtcaatagcagtgtagcaaccaatgataatgactaagacgctcatcagcgtttgcatagtaggtcaaccgtgaaggcgaaataacaagccagcaatgacggaagcaaccggaggctaagacgtagtcatccattagcaacgacagagatgtcagggccgatgaagtagaggtgctggtgatgaagtcagtgacaataatccatcaaactgttaagaagatatcaaagctcaagtaattttcttgatgtgtgcataacgaagattgatgcaacaccccttgatttgtaaagatggtagtagaacttggagttgtagctgttgcagatgcttcacttgaagaaaagtaaatactgttatccaactcatcaaaactgagctgattggttgataactctaaactcccggacatgtagatagaatctcaaactttgatacttggaaaaatttggagcagattgtggcggcgtgaagaagccaaaattgccggtgtaataataagagttgctgaagtagaacgtctgctctgaagtgaagaccaaactgatgactcccgaagtagattccatagaactcgttggctgattgattgattgcttcatcttgacataaagcttgtcgaattttgagagtcttgtatttgtgtagcccccgactctttggttagttgagaaacaactgaacatagagtcgagaattgtagcttcttgtcgtcgagtagtcattgcttgagtgaagatacgcatagaagatgtccgagtaaaaatcttgaatattggaacaccacttgttatagtaaaataacacggcattatacttgttgacgcatgccgagatgttgaggctcttgtagacgtcgtggtcggcgaagtagcaaagcttgcgaagtaaaggcaatagagtttgccggtgccgaagataataaagatgaagttgctcgaagaagtagagtgatgatgaaaacaaagacgttctttaaccgcggcaaaataggccagccatgaaagtgaagacgccatgggcggcggcaaaggcaaactggtgatgacgatgacaccagtcaatgttgacgaagacatgtagctgtggaggcgaacaaaccagtcggcgtcagacaaggcagccagcaatgaagacgatgacgtccatcagtagtggtagcggtataaaccagccgtagaggcgaggacaccagtcaatcagtagacaagacgactggcggtgaagactataaggccaatcaatagtatcataatcatgcagccatggaagtgaagaaaccagtcggcagcagacgcagacaacttgtgttgaagataacgacgcctattagcggtggcggcgacgtggccagccgtgaagacgatagcaccagttggcgtcatacgaggtggtcggtcggtgaagatgtagatgtctaacgacggcggcataataggccagccgtgcaggcggagacaccagtcggcggcggacgaaggcaagccggcggtgaagtcgtagacgcccaacaatggcggcataataggctggccgtgcaggcggaagcaccagtcagcggtggcgaaggcaagccggcggtgaagtcatagacgcccaacaacagcggcataataggccagccgtgcaggcggtgacaccagtcggcggacgaaggcaagtcggcggtgaagtcgtagacacccaacaacagcggcataataggccagctgtgcaggcggagacaccagtcggcggcggacgaggcggccgctcggtgaagacgtagacgcccaacaacggcggcatagtaggccagccgtgcaggcggaagcaccagtcgacggtggcgaagacaagctaacggtgaagatgtagacgcccaacaacggtggcataataggccggccgtgcaggcggagacaccagtcggcggtggacgaggcaagccggtcggtgaagacgtaggcgcccaacaacggcttcataataggccagccgtgcaggcgaggacaccagtcagcggcgaatgaggcggtcgacggtgaaagcgaagatgcccaccaacggtggcataataggccagccgtgcagggggaaacaccggtcgacggcggcaaaggcaggccggcggtgaaagacgtagacacctaacaacagcggcataataggccagcggtgcaggcggaaacaccggtcggcggcggcaaaggcaggccggccgtgatgacgtagacgcccaacaacggcggcataataggccagccgtgcaggcgaggacaccagtcggcagcagacggaggcaggccggaggtgaagacgtagacgcccaacaacggcggcataataggctagctgtgcaggcgaggacaccagtcagcggcgaacgaggttgtcgacggtgaaagcgaagatgcccaccaacggcggcgtaataggccagccgtgcaggcggaaacaccggtcggcggcggcaaaggcaggccgacggtgaagacgtagacgcccaacaacggcggcataataggccagccgtgcaagcgaggacaccagtcagcggtagacgaggcggccggcggtgaagacgtaggcgcccaacaacggcttcataagccgtgcagacgaggacaccagtcagcggcgaacgaggcggtcgacggtgaaagcgaagatgcccaccaacggcggcataaaagaccagccgtgcaggcggaaacaccggtcggcggcggcaaaggcagtgtaacgtcccgccttcccccaggccgggcccgcttatatctgatagctttcataggtcatataacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactccgggtctacaccagccatgcgcaccatgcctgcgcaactgcgacacacgcgcccgtgaaaccgcgagagtcggctctgataccattttgtaacgtcccgccttcccccaggccgggcccgcttatatctgatagctttcataggtcatagactgccctcacagaccaacacatatcttttctgcacactttgtcctcactcatgtgcacccgggttcccggtcggtcacccatcccaaattgctccaggcccagcacgcttaaccctggagttctttggagattggcttccggaaaagaagttgcaactggagttctttggagattggcttccggaaaaaaagttgcaacttgttgatatgagtattctattaatcctattaagccctaggccgggatgttacaggcaggccggcggtgaaagcgaagatgcccaccaacggcagcataataggccagccgtgcaggcggaaacaccggtcggcggcggcaaaggcaggccggcggtgaagacgtagacgcccaacaacggcggcataataggccagcggtgcaggcggaaacaccggtcggcggtggcaaaggtaggccggcggtgaagacgtagacgcccaacaacggcggcataataggccagcggtgcaggcggaaacaccggtcggcggcggcaaaggcaggccggcggtgaaaacgtagacgcccaacaacggcggcataataggccagcggtgcaggcggaaacaccggtcggcggcggcaaaggcaggccggcggtgaagacgtagacgcccaacaacgacggcataataggcctgccgtgcaggcgaggacaccagtcggcggcagacggaggcaggccggcggtgaagacgtagacgcccaacaacggcgacataataggccaatcgtgtaagcgaggctgatttgcatgtagattcgtctctctgattttgttgacatgatgggcttggtgcagccaaccggccttagaggtgttgtgtgtggcatgagcgaacgctgcatcatcaacatcagtagtcgagccacgcactatgtcctggcgtacccctctcggcaacatggttacagtaggaagcattgcaccgacggccatacatgcaataaaaaatcatgagaagattaatatgcgttagtaattaatctaaatatataaattacaaggaggtcaggaaccgcagcactgccaaatcccatcactcgttaatgaacgattttttgatctcaattgccatcctgggcatgcgaccaaccatgcatcgctccagtatacatgcaaaataaacaaatataatttgattagccttaaaatattacatgcttaactgtgtaatacatatatcaagctagggtttgatattaagccgtgcatatcagttgatctgcatgtgaagcactcaattgctgttgatcccatggacatgaattgttcccgtgtcgtatgaaggttacgccggtacctatacagatcgtactgggcgacgagaagacacaccgggacttcgtcttgatctcagccggtgcgtgaaaacaagaaaaagaaaggtaataggagattagtctgcagttagagaacaatctaactagtgaaacgacaaagccaatgacattggagattgaatcgatgaaatcaccgagattgatcccttcggctggattgaatccgagatgaaaaagacatgcttgatgaatctggtgatgtcgcacattggttccatcacactcgtgacaggaaactcgatgctcccttacctgacgcgccaactgtcgaaacatgaattcggcaataataaaagggggtagcgcacgagacctaaaagtggatggatgcggagacaaggatttagacaggttcaggccctctcaatgagaggtaataccctactcctgtttggggatttgaatctgccgggtgtagtatagatctgacgatcatacgtgctcatgccccctagagggcctcctgcccaccttatataggatggagggcaggattacaagatagaaaccttaaccaatacggtatcggtttcctaaatctactttacaatcttatcgaaccaggactttaggccgttccgtaatatacaaggaaacgtaatacccaagtcatgatctattacatatttcatagatatatgagttatcccctataactagtcggataaacatgccgtgtgagtatggggtacccataatctacacaggaactttttgtgctggaagtctggaacttggtactgttgaggatttccactggtgatgctagataatgtttcattctgtaagggtttggaacttttgttcttcttcgcagcaatggtttggaacactaatgtaatgcttgtgcactttggcttgtgatttggtgctgctccaaattttcttgcagcacaaataattttggagatattttcttgtactacgatattttctatgtacttctgaatcggaatcacattggtaacttcgatctttaataattttggagtttcaggaagcagaaagaagcctagtgttccggtaatgggctgataaatatattggggcaattgcaaatttgccacaattttaaattgttattgcaaaactaccacattcgaatagcattcttgcaaaatatcataaaaaccagagttgtaagttagattaagaaaaacaatggacaagtttgcaaatgccccaaacgtataagatttacataaaccctgtttacacccaaatttggcacctagagattaaataggagaaattgccaaagtttggaagtctgccggtttcctccgagtagggccggtctgaccgccgtgcgttgggctgtcagactgccggtttcgggccggtcagaccggcggcatgtggccggtctgaccggcaggtccgagtccgactgtgtttcgtcgggtctcaaggtttccttgctcgggaaggcatgtttcgggtttcctttggtttctaccccgagttggacgtggaggagggcctgtagagggcaaaaccaacccctatataagggatatggccagttcaattataactaatcaatctacaatcaatcaatcgaatcgtttttcatattgcttttaattttctcttagtttgtccatctttgtcgatttgcaccgaaaattgtccaccgccgctgcgagagtgcgacacccctttgttggtttatcctgaaaaccttccgttttgcccacgagacgggtagttatctagaaatcggctccgctagccggtttagttatcaaaacccatcttggtctagcttttggctagatcgaggtggttggcaactccaaatcaccgcaaggcgtttaggtgctgcgatcgtgcttgtcgacttttcacaaaaagttgccaacacgaattttggcgactccgctggggaaatccgttcaacgccatctcaacttcgacatcgccatgacgaagcctccatcaaccaaggcggaggtggatccatccaatgtgctgccggtgatgatggagagtcttgatgaggaagcacgcatggccttcgatgaacacatgaagaagtatgccgacgagcttttaaagacatgctcaaagacccgtcatggcgtagtcttcaagccggatttggtgtcttcatctacttttgacaaggtaagtattgaggaattatcacaatctcttcaacaacaagttgctcatacaatagatgcatctatggttgctttcaataacaaattagaagcatcttttgaaaataattgtgaaaagtttatgagaaataaactcggccctctcgtggccgattttgtaatcaagataaagcctctaccagtgctagccaagctcctatagatcaaataaatagtaaaaccgatggagcgaagacacaacaaatcggcgagggctttccggcgcaaactgctgatcagaccgggccagataaagccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggcctgataatatagagcacttgattagtggaattattagggataaattcaggattgaagctaggaatcgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatctgttagaccatatgagaaaaagcctaatgttaattcaattgattactttgaggctagtgatagtgatgatgagggtgatcatgacatatatgttgctgagtggacatggactaacaaaaataagccttttgtttgctctaatttaatgccgactcctcgtaaagatcggcaaagtgagattaagtataggtttgatgtggccaaatgtgataagatttttgattatcttttgcaagaaaaacaaattagattacctaaaggccatattgtcagggttatggataccacatacccaatagtagttgactaaatctcggcaggacccaccacataccatgtcttatacggaaactgactttgagttggaggaagttctggataaggaaagacaactagagttctatatggaaacggcaaggactagtcggattgtatccatattggactccctagttctacttggacaaggggacacctatgggtataaatacaagaccccctaggaggagaggggacacgcaacaatagaaggaacaacagaagccaacatacgccaggacaagccgccggatattaacatcagagatatgcctaggaggaccctatctggtacctatggaggccggctgtagggatctagcgttatctctgatctcgccgggcacgagttcgaggaggaagactaccctgttgtcgactacgagttagcacttcagactgccaagtcgacaacagatagataggctaccacaaatattgtactggtgtgattatggtgaataagagcaacgatcggcttcggccaacaggatgtagggttattacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctagggagcgatttggtcattcaccaaaacggtcgcaatcacctccatatcatcattcacaagacatgtcatggggaccttatccaatgccgccaccgggttatccttatccttactacatgccatggggggcaacaccgccaatattcaaccatatgcctccaatgcaattcaactaagggtggggaggaccaaggaggccaattcatgagcgcttgtcttcaccaaataatagccggttttatggaaaaaatcgggttaatgaagaaaagagggaaggaaagcgtgttaaggtggaggcaaggacttcggaggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatctcaaaggtcatgttgatgggaagccagtctctaggatgctagtagatggaggtgtcgccgtgaacttaatgccgtattcattattcaagaagttggggcgtgaggataatgaattgaagaagaccaacatggttctcaatggttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatgggaatatccaatgcttatcggggagggatctttctagctatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgagatgccaggtcttagccgtgagtttgttgagcatcggcttccaatcaaaccaggttttaggccttataaacaaccacctcgtcgttttaatctttgctatatgatcgagtcaaagaggagattgatcggttgttgaaggcggggtttattaggccatgtcgttatgcggagtgggtttctagcatagtcctggtggagaagaaggggagtggtaagattagagtttgcatagattttagagatttaaataaagctactcccaaagatgtatatcctatgcctatagccgacatgatgatcaatgatgcctcgggtcataaggtgattagttttttggatggtaatgctggctacaatcaaatctttatggcggaagaagatatgtacaagacggcttttaggtgcccgggatttgttggtttgtttgagtgggttgtcatgacttttagattgaagaataccggtgcactatatcaaagggcaatgaatttgatctttcatgatttgctaggtattatcttagaaatctatattgatgatattgttgtcaaatcggatggtatgaagggacatatagccgatttgaggttagcttttgagaggatgcgccggtatggtttgaagatgaacccacttaaatgtgcttttggtgtgtcggcggggaggttcttgggattcatggtgcatgagagaggggttgagattgatcctaagaagatagaaaagattcgtgatttcaaagcgccgacatgcaagaaggaggtccaaaagttgctaggtaaggtgaattatttaagaagatttatttctaacttagcgggtaaaatcgatgcttttgttcctatactccgcttgaaaaaagaagccgattttacttggggggcaaaacaacaagaggcatttgaagggttgaagaagtatttatctactccacccgttgtgcgggcgcctaaagccggaaagcctttttggttgtatattgcttccgaggataaagtcattggtgctgttttgccgcaagaggaagatggcaaggagtatatcattacatatttcagctgccatcttttggatgccgaaacgaggtatgtctttatagagagactttgtctatacttatactatgcttgtaccaaattgaggcattacttgttatctagtacatgcatagttgcttgtcaagccgacattattaaacacatgttgcaatggccaattctaagtggaagaattggcaagtgggcatatgctttgattgagtatgatttggattatgaaccgttgaaatctatgagaggccaaattgtatgtgattttatagtagaccatcatgtagatattgcttatgaagaaggggtttgcttagttgaagttataccttagaagatttattttgatggttcttcatgcaaagaaggtcaaggtatagaagtagttttattttcacctaatggcatgtgttatgaggcatcggttcatttggagtattattgtacaaataatcaagccgaatataatgctttattattcggcttacaagtgatggagatgattggagctaagcacgtggaagcttttggtgattcggaattggtggtgcaacaagtcgccggaatctacaaatgtttggacggatcactaaataggtatcttgattcatgcttggacattattgctaatttcgataattctagagcaaatgatttggcacaacaagcatctggctataatgtgaagaagggattatttctgatactagaagagccggtgcttgatttttaaacctttgtgcaaaattggcaaaactggagaccaggggcggtctgaccggcgttgcacggccggtctgaccggtgagcaggggcggtttgatcggccacatgccaccagtctgaccagccaccccgggcggtctgatcggtcttgtatggctggtctgaccgattctggacagagcgatggggggcacgccgcaattgattcaaagaccgaattagctgtgaattcggacatttgtgcccagggaacagaagagtccagatcggctacgaccagatcggctgagtccaagtcagatagggttagccgatacagccgattccgacaatatgaatcggtttacattatcgagctgagttaatgtgcttcacatggattgccacacatggatagagttctaagaaggcaattgtatctattaattaggatattttatgtaatttccttagagataagtttgggcaaaagtctgctgcaaagacttatggtatcttagagtttgttagagataatagtcgtgtccgacaaaggacatattttgtagtctcgggtataaatagaccccgagtcccatgtaatcaattaacacacgttcaaatacaatcttggcgcatcgccacccttttactttcgttttgtttcgacgagttcttgctttcgggttgaactgcatcggtttcgatcttcaactagaggtatgacttgttatggtggcttgcgttctcgagattggtgcttccatcattatgatactctaatcctatctatgtaagttgttgagttatcatatatcttatataatctctgacaatatcgctatctaacctccaatcggctagtgtctatcgctggagagcagccgattaggttaagtatcgacgttggcttagattatataggatatctaccactttatgaagcttccaatagcttgattgcctaaaattgtctttcttttcatacttatggctgcatcagttgagtttgatctcataagtcgtgcttagaactataatctctagcctgcttcttggttgtcgattagagtagtatcggggtttcagccgatcttacctaatttagccttatatttcatgtgcttaattgatatgttaaatctgccctttatgttaagatcttattgcttttaggtgtgttaaactttacgtttgatatattttacttgctttaatatcttaaggtagagtagtatcggagtattagccgatacaagctagatctatttgatcagctatgctgtgaatgattatagtttccttgttaatatatatttcggtctaagtgatttatactgtctcggcatggcgaccgatctatcccaattacttgatttaagtatatatcgacatgaagattatttatcattgatatctacagccgattgaatagatttagtttctttattattgcctcgcacagccgatcgatgcaaagatgacatcggctcgagtacaaatgatacgtcatcggcggctggtcgatcggctatcatttatggactaactactatttctttgtctttatttcttgttgattgcaggatcaaatcaactggcatgctcatgaacctcaaaggcaagattttggacctgcactagagttaagcagatctcccaggcctcgtgtttttacatcaacactctcttggcacgcccggtgggacctgagttttcaacgacttcatcccgatggccgaaaaaccaccaccatcaccgggaacaggagtcaaacctcccgtaaataaaatgggggccaaaaatccatcagctgaagtggacccaaccaatattgttccaatcacattggataggctgacagctgagcaaagggatgaacttgaacagatgatgagcaacgtgaagaacaaattcatggattcttttcaggagacccgcagaggaaccatcgtacaaaagtacaagttgaaggtggtcgcagccgatgaggtcagcccaagttcatctcagggtgacaaaggtactgcaactggctcaggtaacaaaagtgatattcctcaagatggtacagttgaagaccttggtgcagatggcaaccaagagccactgcaattcaataattttcaagataggatcgactatgccgtgcaacatgccttgatcaatcagtctggagtattagttaataccttaaccaatatggtaaagactgttgtcgatggttcgatagccgaacatcaagcttcaggaccagtctatttaccaggaggtgtttttccaaattatagaccattggtcacagcaaatcagtcgaatgtctcccatgcattaccggctcagccgatggcttcagcttcaacttctgcacaagctacatcatcagtgtaacgccccgattttcgttcgggattaaaaatcattaaataatgcattttctagaaattaaataaaagttaaatcaacttaatcaagtgaattattgggagaattaaaattttcccttaaaaatcattggccgggaatattttgtaatatcctttgtgccctaaaatactctccggaattttccgtgaattttcggagctcaagaaataattttaataacacaaagatcattgtatcaattaaaataaaaagaaaacaattaaaatcctctttcctctctttgggcccctttcggcccaacccctcctttctctccctctcgggccggcctcctccctcggcccgctcggctctctctctccctcaagtctgttttgcctccccagccggcctctccctccctctctctccgacaggtgggacccgtggaccccacctgtcatcccca

SEQ ID NO: 21406 - DNA, 7568 bp, Oryza sativa
ccccgccacgagctccacgtcgacaccccgcttcccgccggttgccgccccaaatccacctcgctcgtgctctctcccaccctttcgaggctataaaaacgatccctgtgctctcctctcccatttccccaattttcccgggcccgtcgcgccttctcccgctctccccgcgtgaacccgagctccgccgctcgtcgccgtgcttccagccgcacgccaccgccgctccagtcgcccccgcgctgcgccgccaccatcattggcatcgccgtgccgtgccgcaccccggcccctactccttttcccctctccgcctccgaaacaccactgcaccgcgcgcccgagccccgccgcccgccagcgccctccagccggccgccaccgtcactcccgccgtcgctgctccgcgcaactgtcaccgacggcttcgttgcgtcgtcccgtaccccggcatcccctccgctcctccattccgccgtggaaccgtcactccaccacaccacccgaaccgccatcatagcagccgcctccggctgccactcgccgccgctccaaaccatttccggcctcacgtcctcctccagtggcatcgcagcgtcgataggaagcccggcgttcccctcatccgagctccccgtcgccgatgcccgttcccgccacgcgaggtcgcggccgccctcgtccgcttcctcccgggcgccgcttgtcgccggagcagcgacgccatcctccgcccgagctccgccggccgccttccgtcgccggcgcccctcggtgaggaccccctccatctcctctccctttcccctcttttcgtcgcctcccgcgcgtgctgtcgcgccggtggtcgtcgccggcgaccatcgggccgtgcgccgtcgctcccggccggccgatcggtcagccggctcccgctcgcccgtggccgcccgatcccccttcggggcgatctgggccgtccacgtggccctcccgtgccgcccgagtcggtgcctctgtggcgccacgtcggcgccacctccgctagccgtccgtcgtggccgccaggtgtctgccacgtggtgcgcccgcggaccagcgcgtgcgtggactcggtccacggtgtgcccgccacccgtgagtcaccgacaggtggggcccgcttgccggcgccacctctcccccgtcggatgacgtcataattgatttaaattgcgcaataaatcggtaataattctagaaatccattaaaatggctcaaaacttccaaaattcatatctaattcattcgaattccgaattgagccattcaacttgcaaaattcatctaaaattgagctctacatgtttgtttagtttttatgtactgtttccttggtttttattagagtttttcctcgttttgcgtgccagcgtgtagaatccgtcgtttcggaagtccgcggtcgcgaggaaaagagtttagaagatccaagtgaagaagcaaggcaagtcacacattccccttgagcatgttgatcctaatttataaatgttttaccgtttacaaataaatatgcatgttttgctaattacacggggtcagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagctgcgtgctcgagacgtctggccatgtttcatggtcgtaattatccaactaaaatacgactgaatggtgggctgtgggtgcatggttttgcgagtcgcacccatggcaattaaggaccggttcacgagaaaccctggaagacttacagtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacacggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgtcactttaattattcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagacgaagttggaagaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaatcagcaccaagacagatggttaaccccagattgttgaccagagaacaaccacaacatgctgggcaaaatgtcaatcggctgactcaggagcaagttgctgcaatgttcttgccaaatccgacaatagccgacccaacacagccgttgccgactcagcaagcacagccgaggtagcagacagttcatccgactcagcagcaaaacttacaacatgcgtcagcgagattgagaacacctgacaatcggccaatgcagcatactgtgaaccaagttattcctgaacacttggtccatcatgtacaggccgatcaatcagttgtgcctcagattatccctgaacatttggtacgtaatattcaaccgaacttctagaactatcaaggaagaaatttgaattatcaatatcagcctctgtcacctcatgtttagtatcagcaggcaggatcgcctcaacctcagtttgctcctcagttcaatcagtttgagctaatgcagcaacaaacacaaggagtacctcagcaaacatcatgggctgatatgattgccgatgtaatgagggagcaggttgggttcaaaccaaaagatactggaaatttgtatcggcatccttatcgaatatgcggcatattttttggaaattcggtaagtggtctcctagtagggaaggtccttatcgaatatgcggcattgttcgagggaacgcatattttttggagacacttcaaggggagccttttcagcgagcaatcaacgggaaatacttgaagaaatacttcccgagcgtttggcaagacgcttaggaggtgctatggccagtaattggattatcgccctaagaccaaaaacatgttctatgcttttggattcacgttgttcataaaaaaggtagggggggcatgtgtttacacccaaatttggcacctagagattaaatagaaaaaattgccaaaatttggaagtctgccggtttcctccgagtagggccagtctgaccgccgtgcgttgggcggtcagaccgccggtttagggctggtcagaccggcggcatgtggccggtctgaccggcaggtccgagtccgactgtgtttcgtcgggtctcgaggtttccttgctcgggaaggcatgtttcgggtttcatttgatttctaccccgagttggacgtggaggagggcctgtagagggcaagaccaacccctatataagggacatggccggttcaattgtaactaatcaatctacaatcaatcaatcgaatcgtttttcatattgcttttaattttctcttagtttatccatctttgtcaatttgcgctgtaaatcgtccgccgccgctgcgagagtgcgacacccctttataggtttgtcctgaaaaccttccgttttgcccacgagacgggtagttatctagaaatcggctccgctagccgatttagttatcaaaacccatcttggtctagcttttggctagatcgaggtggttggcgactccatatcaccgcaagtcgtttagttgctgcgatcgtgcttgtcgactttttacgaaaagttgccaacaaacccctctggatcagagcaaatccactcaactgcacgcgtgtgcatgtttcagaaacggattcatcgcaacagttggtttacgatttcgtaataagttgaaattagactcggattagatcggtttcatgcaattaattaatatatactaataaaatagatgatcgacaaagcatattactaattgatttctccgtgcaaaccggtcgctagctcgctggacagttgtcgtcatcaatggcggaagaagatatcaacaagatgatgagctccgacggggagatatcatcaatggcagagagggcggcgagtctgttgcgggaactgcggcaactgatcgaggacggctgcgccgccgccaaacccctcgccgagatggtcgagtactgcgccaagcacgccgccggcgacgaagctgaaggcaaggaagaggaggtattagatgatggcgagtccagcgacgatgaggaggagacggacatgctcaggctggaggccagctcgatggacgtggagaacatgctcagcgtggccgcgcagcgcacggcggagctcatcaaggacaaggacaagccgccggagccagagccgtcgccggagccatcgccggagaacgaccccttccacggctttcacagtttgcattcatttactgagcactgctacacggactaattttttttattactaaacttttactaataatcgtctcaaccatttgatttaggtatatgaaagttatgaaaaatcggcgtacactcatatagcgtgacacgtctaccctaaagttcaacaaatatctaccctatagttcaacaaaaacaaattctttcactcattcactcatcactcattctttcattcctcactcaacggtccagattacctcactctgatcaacgctccggattcaccccacctccctccccaccctgacagcccgacctggtgacctgcgccccctcccccaaccctaatccctcctcttcccctctcacgcgctgccgccgacgcccttcacctctctgccaacgccgcccgcgtctccgcgccgacgcagcccgcgcctccgcgcatcgcctttcgcctcgccatcaccgccgccgtcgattgcctccaccctctttgatgccctatccccgccacgcgcagctgcctcgccggggatgacctcgcgtcagtgacagtggtccagtgctcaatttgctgctcggtctgcgttgacactactgaggtctacggcgaggctactcccctcaggtcttatctcaatcccccgcctacggtggtgtatggttcgcatactttgtagtgtcctgttgaacttcgagtcatttttctcactaagaaaatggtaggtgataagatatcaggtacttcggttttattgtctctcaaacatcagtagttcggttgtgtgtttaaccaaatgaagcataatataatgtatattcttatgacaatgtattagatcgaacaatggtttttttaggagtattaatttggcactgttattagatccaacaatggtttttttaggagtattcaatttcaatgtaatctggttcttgatctacaaagggttcacgtgtactgtgttggcttggggtccagtctcctcctcctgcacgtgatgtgtgctgaacacggcggagaaataatggactgccaacatgatcggacaattcattgcttcctttagtttaacttgcagtgtgaatgattttcctattaagaacgcatgaagtcagaattaactgaaagaaagatattgcgtgtttaattaaactatccacagaatctgagtaattcagttcattttcttcacattcttttcaagaatagtctctgatatttcgtattagaattgcatgcatatatacaaccctgtctaattatatctgttcaaaataatttcagccagcttgacaagcaataatttctcaggaacctcaattggcaatatcaccacacttctaggaggaggagaggctgctccgcgggcttcgtagggatcccggcgagctcgcccccgtgactcctgcttcctctggtgtggctaaatcagttacggctcctctggggctttgcttgtgccttctgttctgattaggttaggacaaatttgtaacggctttgtggtctaacatttgctctgtgcggccgaattttttggtggccctataataattgagttcaactaatctaccctttagagcaactcaaatatcgatctgtcttttgttaatccaagcaacacatatgctgcaatggataagaacaaagaatatggtgctgttataatttacatgtttagaaaaaaaaactaatgcagtaaacacaattattcatggaaccaatgataatttacacttgctatggatataatgtcctgtatatttcagaatagagtaaagtgcacgagcggtccctaaacttgtgcgggtgtgtcacctaggtccctgaactctcagaatgcacttttgggccccttaacttatcttgggtgtcatataggtctaaatgggctccaactcactccgtgtgctaatgtggcatgccatggtagcgcctatgtgtcagtagaacccatatggcagcgatgcggtcacaagttccaccacggtgagtgcctttctgcgttcatatctccctgtactgatttgatcttgactagcataattatatgcctccctagaatttggcccagagaaccccaggtattcatttttttggcccacgaaaaaagcctagcccatcaaaacaaagaaaaccctaactcctctccagtctggctgtctcccccgtgcgctctctcccctcccactcgacggcgtcacggcgacggcgctcccatgacccggtgacctcgacgcgagccgtcaggctagccgccggcgtgactccggtgctcccgccgctcctccaggctggccagctcccgccaggccgccagccgcgcgcccatccgtggcggcagagccgcgccagcgcccgcgcggccgcgtcctctctccgtcccgccgcgtcgtccggccgtccaggggcgggcccaatgggtagtctaggtaggcccaggactaccctagaatttgacccagagaaccccaagtattcatttttttagcccacgaaaaaagcctggcccatcaaaaca

SEQ ID NO: 21407 - DNA, 2511 bp, Oryza sativa
  unsure (1)..(2511): unsure at all n locations
tccaggcggaggcccccgcggccggagcgggtcatggacaactggaagcgcttggtccgcgccgccctcaagcaccagcaccgcgccccctccgccaccgcttcttccgccgcgggatcggcctcgcctccgccgtgcccccctcgctcggcaagaccaccaacatcgagcacatcctgcaggctgccgacgacatcgaggatgacgaccccaacgtcgcccggatccgtaacttactttacccctcctcactcatccacctttgcttcctcttcctcttcctcttcccacccccctaatttcgggggtttagggtttccgctgctctactttttaccacttgttgttgttgatgatgatcatttcatctccttgcactccagtttgtgagcaagcctacaccatggcacagaatctcgatcccgacagcgatggccggggtgttcttcagttcaagacgggtttagcttctgtcatcaaggtatatatgcttcttcccacccgtgccactaactctctctgtcaatgccatttctgtctaacttgctcccatcgcattctacagcaaaagcttgctaagaaggatggcgcgcccatagaccgccagaatgacatccaagtcctctggaacttctatctacaatacaagagtcgccgtcgggttgatgatatgcagcgtgagcaggagaggctccgcgaatcgggaacttttagtacagagtatgccatctctccaatcgcaccacaactagttttgaccagttgatgcaccctttttttttgtttcctaacaactaacttctgcnatgcccgttgtttctgccanccatttcttaacaaccttgttcgatgaaatcgatgttgcatcattatattgctctcgtgtttacactctattgcagtattgtgctaaccatagaaagacaacttatgcacattctaataattctcatgactattttatttttaccagcatgggatctagggctgtcgagatgaaaaagatctatgctactttgagggctttgcttgatgttctggaaattctcattggacaatcaccatccgatagacttggtaggcaaattctagacgaggtaattgtgcagtcattacagaacccctactcctgttaaacccttttgttgctgctgctcgccaacacctctgaggatttttttttcatatactcactcaactagtgtttttccccctctcattttcgttttacagattaggagaataaaaagatctgatgcagccctgagaggtgaacttatgccatataatattgtaccccttgatgcaccatcatcagtggcaaatactattggttttttcccggaggtacatgttgcaatgcttgttgtccacacagcacagaccgttatcatcttgcattactttgccaaacagaaaaatatttatggtgttgtctattgtttcatgcaaatctattaggtcagggctgcaatagctgcaattcaaaactgtgaggacctgccacgatttccttctgatgcacttcaactacagctaagacacaaagatgtttttgaccttctgcaattcgtatttggcttccaggttaggaaaaatctcataccatatatttcatggcaacatttgctatgtaaccatccctttttggttacatacgtgcaattgctttttcttgttgcactgactcaatatgacaaatctaaaattagggatgtagttattgatgcattttacttatgcatgaaatttgaagtctaaattcattctacgcaaacagcaacaaaaacgagaaaattgtatgacaatgaaaaggagaaaaagacgcatgccactatttggacctacttgtaatttttccttatacattttcaaattaaaagtttaatatgcagggtgcaaagacatcctgtagactgcattgtcattttttggaagctgttatgttctttttggtgccaaaacaatagttaatttcaagggtgcacaaaaaaatctgtatgcttagcatacgggcaattcttctttagttgaccacattatgttggtttctatgagaataatttgaattgattatgcgttgagttgacatgtgacagttacaactgttactttttctgaaatcgtgcaataattttcctttaatctttgctggtgtgacatgttggagtatttagcaaattccatactaggaggcatcctctctgcagatccagtcataaatagaacctttggaaatcttgtactagcttagcagttaaaaattgattggcatgacctgtgtcctttccatgctgcatctgccagcaaatccttgttctgcagtatgcacatactacagaatatttattgttcactacgccttattctctgtaacgatcaacttcacttgattacatgctgctatagtgctatggcaatttttgattggtttcttaagccagtataccatctagcagcttatgtgaatcctgatcataatccgcttctacttttgaagattaaaatgtt

SEQ ID NO: 21408 - DNA, 8372 bp, Oryza sativa
  unsure (1)..(8372): unsure at all n locations
gcccaatcccggctcggcttgcttgatgtgacagagccggttagttcttcccctattctcatggagtatcatttggacttgtagtacaataagatctttcttcctactgacatgatacttcctctgctactaaatatatatagttctgcatgtaaaaaaagggagcacatgcaacaataatggtggttaccatttaatactgtctcagctttaaaaatgtcaccagccttttgcttgatcttcactttagctctactggtctaaataaatttcattggttgctgtttcccttcatagaatcaatgaaagttcaaacttgtttgtagaatagaaatataagtcagtatggctaatctattataattgcctcggtgcagcggccagatgttttatgaaagcaatgttcaaaccttaagtaatgaataaggtatagttactagtaattaacagtgcataggctgattactcttgttcctttcttttttggcctttaaattccatgtacttgcgatttttgtctataaattcttgtgatacatattattatacaatgaacattggcaatggccatggctcttgtagaaaattgatgagagggctgtgacagaagtatttttgaaagtgctggacaactacatgaaatggtgtaggtacttgggcaagcgtgttgcatggaccaggtaatttaacctctcatggttaattttctctgtgcctgttattatttcaatggatgctttctaattaatttccttttctattagccttgaagcagtcaacaagaacagaaaaatcatattggttgctctgtattttcttatttggggtgaagctgcaaatgtccgttttcttccagaatgcctatgctacattttccacaatgtgagttcctttctctcctactaatttctgccctttttcttttcatgtaattgcagatgatgacacgtagaaattatttcaacataggatccagtgttatatatatatggtctggtctgtttctgctgatgaccaaaattattaaatacagcaaacatttagatgactagttatctcagctttcgccttgtcaagttgctttttttagggttcaatcttatagtactgtgagaacacatgttggatgttgcacatttactttttctatgtcgcaaaatgataatgagcaatattgtttgtggagatcattattgactgtacttttctacttttctgttgagcgcttttccttcaggaaacttccatgtttcttgataatgggatattgcactactacattcagggaagcttgctttatgctaaaaaaggatagtcaaataagttttgtcgataattcctcatttaggcaaatattagatcatgaatttcttttaggttaaagtccatttgtaaccttaaactgtgctcaaagtccatttctcatcttgcataacaccctaaaccatattttatcgtggttctaattgatatgatagtggtttttcgctagcatgaacttcagttaagtattatgattttcgacctaattaagtaccatttgcatcaacaaaatatgcagctaggaaaaccacctccatttcaaacaaaaccactaaaaaatatgtcccaaggtgtttcttgtcccattaagagttgaaggtgaaaaatatccagttttctagtgaaggtgaaaaatggccattggccaaagtttaaaggctataaatggactttacccttagtttttattctttggatgaacaaaacaccatgtcctaaagtaaccaactgtatatttatgccaaacttgagcttgactgttgatattagacgattcagtatatctttgatgcttggacatgggtatctcgtcacagcattgcacatttacaaggattcagaagtcacaaacatggtgacatgggtatatattttaataacatgataaaattaattagagcagatcttgtttagaacgttagcacaattccaccgtgaaaccttaagcttgggcctttgctcttcaatcagcgtacttacatctagcttccatctcctaaggataagatgggtgcagtgcgaagcaactaagttacccagatcgagatcgaggatgacgggtacagagctgagattgataggaaatcatcaacaggcagaaaggaaggggccgggcactgcctgatcaagggcgaagaactcgttggtgggaacatgggagaggatggagagtggatgaaatgccgaatctgtgttctctcttgaatatcctggcacttgcgcagtatggcgctctctcagagatatatttgtgtgaacacggtgtccaacactgatacagcaatcggatggcattttggtgttacgtagcagtatatatacttattaggagagtagttcttttggttttagtggcaatttcctgttgtacaatacgctgagcttactgatgctgcttgcaaattgtcagatggcaaaggaacttgatgggattcttgattcatctgaagctgaacgtgcaaagagctgtactattactaatgattctgcttcgtatctggagaaaataattactccgatatatcaaactatggaagcggtacgttcagttattgaaggtctatctcaatttacttttgggtttagatgatgcttctgctaaatctaaatcagtaccaattaagttgaatcttctgaaatcttctcatgtcttattgtctacggccactactaggtggcatttcgttgtaactgcgcactcagtagttttgtccaattcatttgtaattggttgattattgtgaggcatgtgatgatttaatccttttttaaaggataaattgagctagttacattgcagcaaccgttttctgtatgtttgatatttttcttctgtattaaagttatatccattatataccttctacaggaggcacagaataataataatgggaaagctgcacattctgcatggcgaaattatgatgacttcaatgaatatttctggttttttccctttaaactgctgcttttatgctgtttcctattatatctcttgcttctctgtatttaatctcttgcatatatttaggtcacgctcctgctttaatcttggttggccacctgctgaaggttctaaatttttgcgcaagcctgctaagaggaaacgagtaagtagtcatccatagtattttagggctagcaatgtggctgtgtgagttgcaaacctatggaaaaatcagcctatgtgtgctttttgtatcatttgagattctcctttctatcagttagccaacagtactttcgcaccactgggattagtttccttagagatagattgtgtaacattattttttttccgtaatattagataatagatcagaatcctatgtattaatttggaaggttgtcggtttaattagtaagttagagatagggatgaaaacggatcggaaacggacggaaactagctttatcatattcgttttcatatttttttcggaattggaatcggaatcgaaaactcggatacggaaatgaaatcgaatattatcgaatacagatacggagcgaatatgagacggaacgaatacggtagcgaatatttaccggtatataaaaaacccctcaaattgagtttcttgatcaaggaagagatatcgcttattattttagttcaaaatctccaacatttatatcgtcaattttatagacggtcccacaaccatatgtgaaaattgattttcatggctgttcctctaagagatccatatgcaaatatgatttatcattttctattcccaagaccttttactagatgtataacttacttaccattgtataaattggagattttatttattttacttcacatcttcgaaacttgtaatgtttgtattatactttaaatgctttcaaatacaaatgttataagctacaaagtggtagatcccgttgagctcttcaactttgatatggaacacatctccatcagatgtcgttgaattgtagggcctgtttggcacagctccagctccagctccacccctcctgaagctggagctcagccaaacagtttcagctccaccaaaactgggagtggagttgggtggagctctctcacaaaatgtactagagttgtggagctgagnttaggcagntncacaactccactccagactcaactcctggagttatatttaggagttggagctgtaccaaacaggcccgtagatatgagattttgtaaaaattaatatggtatattataatgaatatttagacccataaatgacctcaaataataaaatagtcaataataaagttgtagatctcatcgagctctacaatgttgatataaagtttgtcttcatctgattccgtatgaaaaagttatgtatatatacgtgttttttatataatttgctcaatgtctgcggatatccgaaaaaaattccggatagtttccgactgttttccgattccgacggatagtacccttactgtattcgttttcgtttccgagaaaaaatatccgaattcgtttccgaatccgagaatttccggataattccgaccgaaactatccgaatccgaaaaatgactatctgaaccagtttcatccctagttagagatatgccattgttaggaaagtagagactgtcttaagggccaaggcatggtttctattcacataagttgtaccacaggtactgtagaacaggagtcgttgctacaaaatgggcacttacgtaccctactgcaatcatgtaatgaatatgtagagtgagaacaataagcctcagtattaaaaaggagttgtatgtatctattgactgaaaaggagagtattaaaagaatatgtattctgttaagtaaacatgcagtgttcaatcttcatcctaacctatccttatgcctattacttaaaagatgcacttggtgattgtgatggtaacatggtgtgctctacactcccactgtccactaacagtggatccaaagtgggttgtgcgcggtgtaaaagagggcaagatgtaggtagtgcaaggccgtagaggcataacagaggtcaaagcggagctcgttcagtcaccatagaagaacatatggtgtggcatgtgttgggatttgtgacaagggcttgctgtgctatggaagtaggatttttaacccatagcaaacttacgggcattaaacttagttatgtaaaatattgggtcttaccgatgactaaggctggggcaatgactagaaggaaatggacacatttattttactgaaaatttgtacatatcttgtttgcattatggttatttatgtgcacttaactttgcttttaattttatatttacagactggaaagacaaactttgttgagcatcgcacttttctgcacttgtaccgtagttttcatcgcctttggatttttctaatattaatgttccaggtcagtggtttgatatcgtacttgtacacatgtatagcttaaatccaagtatcatttctgaatacagtttatgatgctaaaagtgctcttttctgatgcagtgcctaactattatagcttttcatcatgggaagatagacattggtaccattaaaatattagttagtgctggaccagcatttttcatactgaacttcattgagtgtacgctctctatttctttgttcatggtttcacttttgctagttacaatttttggcggatatactttgtttcatcacgaagcttttcatgcatctcattttttgccactgggttcatctgacatgtagccttaacagtcaaaatgttaaaccaagatgaatgtacagcttagtgacataaagagaatcccttttctaattgttatgtggactagaatcaaaggatacttcctaagctgactttggtggttttgttcttctctaggctgcttggatgtgctgctcatgtttggagcatataagacagctagaggttttgccctatcaagattagtcatccggttcatttggttgactgcagtctcaacatttgtaacctatctttatttgtgagtattcagtattttgttcatgtttttttaatgtacagcaagtcacctcacttgaatgctgaatgtcaaacaggaaagtcttggatgagaaaaatgcaagaagctctgattcaatttatttccggatttacgttcttgttcttggtggttatgctgctgttcggcttgtgtttgcattgatggccaagataccagcgtgtcacaggctctccaatttttctgatgggtcacagtttttccaattctttaagtggatataccaagtatgcacattgtcatcctgcgcagtagtttgcaacatatctacattgtgaaatcgtgtacttatattgtttctcctgtttgcatttaggagcgatattatattggacgaggactttatgagagtataggcgaatataccaggttcttttcttttactctagatgattcttggaaatgtacaaggcattcttagtttttctggtgatctctccagattaggaaaaaaaattctaatacccagtcgttatgtggaaatcgcaaaaaagaaaaagcttgaatattttttctgatttgttaaccatatacatgattcgttaccaacctgttagtttgaataattcaccagcggttctcttatagctatttttttggtcatggtatgctatttacttgtgacattctgatgcagatacgttgtgttttggttggttatactggcatgcaaatttacttttgcatattttctccaggtggttataactgtgtatttcagaattttaatgtttattatttttttgtgttatcaaaatttactcttgtttattgtgttatctcatttctgcagattcgacctctagtcgatcctacgaatgtgattgtgacactccgtaatctgcattattcctggcatgatcttgtatcaagtggttagtacattttgcacatatcactaaaagcattgcccattttctgctacagctttactaagaagaaaactattttcttcttttttcctctaagtacgagataagcaaattccttcctgacagtgtttcattttagggaataaaaatgctttgaccatcctgagtctatgggcaccagtattagctgcaagtttcttgtgttgacatgtaattttctatgaaataatgagatgaactttgaaaatgatacatggttcatttcatttctatgttagatatacctgatggacattcacatttggtacactcttttatctgctctcgttggtggtgttatgggtgctagagatcgccttggagaggtacattttgttctgatgttctagaactatcccgaagtacttaataactgtatgctcactctttgtagtttgcaaactgtaatcatcgttacatttgctaatttaacgcagatccgttcaatagaaatgcttcataaacgttttgagagctttcctgaagcttttgcaaaaaccctttccccactgaggtactcgctcccactaatccacaattgctattctgtctgctcatgataggagctgattaatagatcttatagtttcttttagatctgtcgttcggttaatttgattttgatcttccgatccttggtttttattctgtttttgtgtaacactgcaggatatctaacggaccagttgctcaggtaaataaacttacattttgcttctaatactaacttcaatagattggttctgacatgcaattatttaaacttcaccaaacatgtcattctaatttagtttgttccgtgacttctgtctggagctactaggtttattcttaacttgttaagcaccagatttgttgtattcttacattattctcgccgctacctctctaaacttatgatagcctgaacatattagtatgacctccgttttctatccacttcaaagatctggcttttttttgagtgagtacatttggacacacaccgcaatcacactatcacacacgcacacacctgcgcgcttcaaatattatgggaggcaccgaatggcccctagagtgtgcatccactgaatttgcatgcatgtacactcctaaaattggtggacaacctccaaatctaggatttgaaccgtagagggttggatgcacaattgcgccacttagccatctgaccacaatctagctccccaaaatcaggctagctgatatactagtcttgtttttgacgttctatcaagtgtaatatctgtatgtaccattgctttggttgtctcaacattagggtccagaaattactaagatgcatgcctcgatattctccccgttttggaatgatattattaagaccttacgtgaagaggactatatcagcaacaggtacatgtaatcacagcc

SEQ ID NO: 21409 - DNA, 2341 bp, Oryza sativa
atttcagtgcagagagaattcttcactctttagttgatggtgaagggcagcgttggtatgctttcctactgaaagatgaaatatctgatactgacaccaatattgtgttgtatttcccccaagttttctttacttaatgccaatgcatactattgatacatgtacagggttgaaaggctttttcgggatctgaatgaaagtatagcacaaggttcacttttagtgaccataaatctcaagaagctgcaattagtccagtcgaggcttactggtttgacaggacttctggtaaagactattgcactttattttggagtaaaatgcaaatagagagatatcgtgccttggttcttgtttaattatttcctattttttctgtttggtaaatttaccatgaagaaatcttatgtggtaaattgaatatcttttagatacgcgatgaaactgctgatcgtgcagctggtgttacaaaagctctccgtgagctttatgaggttgttacccatgagtttctggcaccgaacctgaggtatgtggtgagaactcgctgtttaatttgcaaaagacatagctccgttttattttcttctgaaaatatgctctttcttgttacagggaacaattcgatacatggcaactactgttaagagctagaaatgaggggcgtctgttctctaggattttctggccaaaggatctggaaatggtacttctcttatgcaaataactgaaatttgcttggcctttctatatccttggttgagtgactatgtttgcctgcagaaagaacaagttaagcggttacacctacttttgactgttaaagactctgctgccaacattcccaaaaatttggaagctcagagaaggttgcaattttttacgaactctctattcatggatatgccggcagcaaagcctgtctcggagatgatacccttcaggtactgtaaatatgtatggacttcattctatttcaaaaataggaacctattgacacctaattatcttgtgcaacagtgtgtttaccccatactacagtgagacagtgctttatagcatgtctgagctatgtgttgagaacgaagatggcatttctatacttttctatcttcaaaaaatctatcctggtattgttatgattccgctgctttattacaatatcttattgtctctgaaggttctttacttttggacatactttgctccttctttacatatttatatttagtgctcacctatataaataagtggatagcgctgggacttgttaatactataattgcttatagattatggttagtagttatccgttgattgtaacgggttaaagaatcattattgcaataaataaatgaaaataaaataaaaccttgaatccctttagaaccataacagaccacagctaatgtcttcacataacaattttcaactccaaacaacatataataattagcattttcaaaatcaatatttatctaaagatgcttgttttcattataatgtggtgagttgttatgggtttgtggcatggcgttttatttggtttgcagatgagtggaacaacttcttagaacgaatcggtcggggagaatcatccgaagatgatttcaaggaaagtccaagtgacatgttagaactgcggttttgggtatcatatcgtggacaaactttggcaaggacaggtcagtttgttgtttcatttcttttgtctgcaatataaatgataaagttgcaatggagttcatatccaaccaatatagtatgtttaatgctacacctgtatatcaactttattctcatatcaaatttcatgtcttgtcctaccatttgattgctatattccttcatattttgctgaaacagtgcgtggcatgatgtactaccgaagggccttgatgttgcagagttacctggagaagagatatcttgggggtgcgtatttggtattctgttggtactagattaattcaatacgtttctcggctatcttcatcattttgattgttctaccaggcattgaagatggatattctgcagctgaatatattgacactcaaggttatgaggtgtctccagatgcacgggcccaagcagatcttaaatttacttatgttgtttcttgccaaatatatggacagcagaagcaaaggaaagcaccagaggctgcagatattgcgctcttaatgcaaaggtagcttggtaaatttgtgtggtgtgtatggtgtgctaggtgttcttggttccgtgttcattatgcgaagttccctgattagtgtcttatcttaattgttgctgttacatgctgtaaactgtaccattgaataaatgctgatttttg

SEQ ID NO: 21410 - DNA, 1407 bp, Oryza sativa
ggttcttttggagagattaaagtcagggggaaagactaagggatagttggggagtcagagggtaggtggagccgtggaggtaagggtgggtgaaaattaaatgaagggtggttggaatcccttatatttgtggacaaacttgaacccccaaatcccttatattttgtggatggagggagtagacaatagtttattggattgaactgtcaactatttagcgttattacttgttggccttactggctgtcaaaagaattagtgagtgataggtaatcaagtgctcacaggttcctgatgtcctgtagtcctctttccttgtttgcaatcccagaaactactgtgattctcaactatttgacattgtttcctctagatcaaattttcttaggtttataaagtatttgcaacaatgtcttctcaattttcatatgtcgagtaagaggattagaaggaaacatgatcttggtcaccatttcatagtctcttgctactgcattatgtgttcttgctaccaaaaaccagctccaatgctgtctgcattcagcacttaactcttctagtatcttcaaatgttattgctcgacattgctgtgtatcaatcttgtcttctgcatatattgctatatagctatttctcctctgcccttttccaagccttgctaagtacttcatcccaaaataacttcatttttagcctccaccgtttgtcccaaaataagttcacttttactctctaacctacccactatcagcaaatcgatgagttttattccttcaataccccttgcctacccacccactaatactacttttctgctaatgaggggcacttttgtagttttttttctcttaccttgtttttcacacctagagccaaagatgaagttatttttgggacagagggagtagacataaataaaaaacttatgcacaatctgtagaaaagtagtgttaggtaatttttaattgtatcctctaataaattaacagtttatgaaaatataactcatgtattccgttggtgttaatcatggtagtctggttactaattcatgttactgtgctgagagatatcctatatgattttgaatgaaatatacttttgaataaggtcttgagattagaccgttcaactatatgacatgcttcttattttattctgttccctgttgtggtgcactttaattatccataatccgaactctagaaggaattttcttgtcaatctatgatgtattttactggtgtattttgcatcagttatgttttacttaaccatactgttgcacctgtaggaaatatactccattaaactgcctggtaatcccaagctcggcgagggaaaacctgaaaatcagaaccatgctattatattcactcgaggagatgcaatacagacaattgacc

SEQ ID NO: 21411 - DNA, 4710 bp, Oryza sativa
tagccttgtccactccccttttccttaatgaaattaggtcgaccaaatcttttggccgacccggcaaaaaaacagtagcattatcctttttgttgatatattcctcatgaaatgtcgagcttgtctagattcttatgtgtaattctatgagatagattctaaaaatatgctcatgtagtacgctgcttgccatttggattattcacaattcatgctgttattaaccatgattctgacggtgataggtcctcttcatgcttggtaaattggtgtaaacaactaaacatgaagatgagttcttgtttttttctttgtgatggaagtattaacaaaatcactggagaaaggtatccattgtgtacaaaccaggggccacggggaatttacactcaatacctcattgagtgaggtagaggacatctttaggtgctaacatgtgacatgcagattagattcaaaagagatgtgaggatcattgacccaggctcatatggagaaataacatggggtcatattctgacccatctaccttatcttgtccattggtccatgcaatacattagtttatacttgctctacgtagatgaaatatacttggcactcccctctttttcgaaaaggtgtctgtgcaccagaaaccatcttggatccttggctgataaaatttctcctgtaggataactacttagaggaagcaatgaaaatgaggaatttacttgaagagtttcgtggtaagcatggaatccgccctccaacaattcttggtgttagggaacatgtgttcacgggaaggtatccttactatgactactctcagttattcactagcttttggttttgcttttatttttgtattaacctattatattttattcctgctgcagtgtttcttcgcttgcatcatttatgtctaaccaggaaacaagttttgttactttggggcaacgtgttcttgcttacctcaagtgagtcaaatttagctagttgcagggaataatatctcattcttaccacattctcttttttcccccgcaacaaacctgtgacaatggttttaaccaaggaacttaattgtgttttattgttcttattacagggttcgaatgcattatggacatcctgatgtttttgatcgcatatttcatataaccagaggtggcataagcaaagcatccggggtgattaatataagtgaagatatatatgctggttggtattttgtatgctccggttaagaagttacctgaatgtggttattgctgcattgttcattgaaaacatctcatggcctcatgactgtctaggctgcttgtttaacttggaaaaggaatctcccatggtctccgtgaaaataaaaaccataactgaaaaaaaaaaactattgggttccttgatggatctatttttgttgcccccctctcgtaggttaagtctacattcacgagacaacccatcaatcctgcaaaaagttgaggtgccattattttgataagactgttctgataaaccatgcctgttgttctttcacagtatataaaccatatatggcttattgagaactaaacattagttacgtcacttgtgcatgcttagtagtgtatctctttcaaacttgacttgtatgtgttatctaatctgcaggattcaattcgactctgcgccagggaaatatcacacaccatgaatatatccaggttatctgtttaatttttttgcactgcaaatgtgtataacatgaataatgtgcactcattatgatttgtgtatgagattggtcctgaggattttaaatatgcatggttttggaatatggcatgtgcacttgcatttttttttgttagcatgtctggtacagagaattaagcggcttggacgcgtattacacatacatcaatatggtcttcccttttcttgggcatgcaaattagcaaatgcacttgaacagatgaactaaactttcttacacttttgatttatttttttttggaagtgcaggttaacacatttgcttaatgggtgcatatgtcatcttgtgtacacttgcattttaaaatcagtatatctttgttatcatttcccaaaataataatctaacaatctatttcacttcttttaaggttgggaaaggacgagatgttggtttgaaccaaatagcacttttcgaagggaaagtagccggtggtaacggtgaacaagttttaagcagagatgtgtaccgtctggggcagctgtttgacttctttaggatgcttactttctttttcaccacagttggttattatgtctgcacaatggtaacccctcgccccaatcgcacatgattacgcttgaagcaacttacatggtctatgtgatgaaccagctcggcttgaacacttgagtacatgtgtgcactgcatccagacaattatttgattgatataattgctgttagatgggatgagagcgacaaattgcagttagctaatcatatatcatggtttggtttaattgcattgcactatcctaaactatcacctgtttgcttgagatcaaacacagggatcaagatacgagaactaggtctaaatcatataccatgaatgggtttacaccaagttaggccctttccagggatgggccgggaatttatttcaaatttctggccaactaaattcctggaccatccagggaggagccaggatttggtagtttggcctttgccaaacaaggtcttaaggtttgaggatgcaacatctagttgaaggcttaatacacctgtttgctgcttctcttttttaatcaatgggggtggagctttctactcttccaaactctcatcgagtgatacgcctcatattttagtataaaccctcatcatattttagtataaaccctcatcatgcatacgcctgttaaatcataatagcagtatatgttaggggcataactttatatttagcaattagcaaaagatagtttcactaacttgatggaatatagtgctatgtgaatatgataaattctgatcgaaaatactagttctcatccgaggacctgtgtgtatgatttcttgattgttgctggataaatagcttctataactgcaagattttcaatctgtcacctgatacctaatgtctcaatgtccttataagcattgttttgaggaatggaatattgcatgtccattagttatattgttgcctagaggattttggacacgtttacatcatagacatttttgtagttttgtcagcaattcttttattttgtttactatcaccagttatttactataactatattatttatgtgtgcatgcagatgaccgttctaactgtgtatatctttttgtatggaagggtttatctggtaagtatttaaattataatgtgttatgcttctgaatgcaagtaaattttgctgaatgttgcttgtgttgtatattatatatttcttttaccattcttactagctattgcaaatttgtaaattcaggcactctctgggctcgactatgaaatatctcgtcaatttaggtttctgggaaacactgcactcgacgctgctttgaacgctcaatttttggtccagattggtatttttactgcagtaccgatgataatgggtttcattttggaactggggctactgaaggtgggctttgtttccttttagagaacgatacatgcttttcacagggttgctgtaaatcatgttaggattcttttttgagatgataatcatgttacaatttcaattgttttgcaggctattttcagttttattacaatgcaactgcagttctgctcagtgtttttcacattctctcttggaactagacacattattttgggagaacaatacttcatggtggtgcaaaggtataatttgtttgctagtgtacgtatattatattaccttttagattttttctgacgcatggccctttatgcagtatcatgctactggtagaggttttgttgttcgtcacataaaatttgccgaaaattatcggctctattctcgaagccactttgtgaaagcgtaagtttctacttccaagttttcaagtgaatacttaaaagaaattcaacttatatgagtagttgtcatttatagatatcttcgcctgatgaaatggagcatgcatttcattttgttcatattggtcttttagtatgttgtattacagtgacccatgcctacctatgttatcagacatgagctattttgtgagagtgattgaatgaaatgtttccttatgcatcttacaatatgaatcaaaatctggctctatcccatgtgtcgatattggtggagggaagtgctagatacctttactttagaaggctcacaagccctcttgcaaacacgcatttctgttttcttttgtctggatactgtagggatctgactcaacgaatgaaatctgcaattttaattatggtgtgcctgattggtttcttgactacttgatgattaatctgatatatattaatatttgcaggcttgaagttgctctcctcctcattatctacattgcatatggttatacaaggggcggttcatcttcctttattctattaactatcagtagttggttcctcgtcgtgtcctggctcttcgcaccatacattttcaacccttctggtttcgagtggcaaaagtatgttcagaatattcctatcttttagttaatttctctttagttgcctaacattcagg

SEQ ID NO: 21412 - DNA, 6640 bp, Oryza sativa
  unsure (1)..(6640): unsure at all n locations
attgcatgcatacaggcccacatccagacattaagaggacgtatcctagagactatcctaagcctcagatttcttattttccaatatggcattgtttataagctcaaaattgcttcacacaatacatctcttgcggtaagtcagggatctccccattgttttgcactgcaaatttttaattgctatgttagcaaaccatttcgtcacatcaaaacctttgttaaaaattcagttaagcacgtgtctgcctgattctttttccatcttgcattcttccattcatgtcgaatgcagtattaaatgctgtagctcttctttcctggcctaaaaaacattcatgtgttttcgttaatgtgaaacacttggtactgtgaggcctcatgttagctgaaaaagaattttttgttagttttggcatttgtctggagcacctgatttaaaattcctatgtgaacaatagtgttataaaccacaaaagactgcatggtatggattcctatagcttctacaatctagcaaatctatccttctgatcttctattatatctaatgcattttttggataggtttatggcttctcatggattgtacttctcgttttggtgctcctatttaaggtttgttacgttgaagtcttaatatctctacctgttctgtgattttaatttatatgggcaacatcatctaagctaatcttttgctgtatcgtgctgcagctttttactgcaactccgaagaagtcaaccgccttgccaacttttgttcggtttctacagggcctccttgcgattggaatgattgcaggaattgctctacttattgcattgacaaagtttacaattgctgatctatttgcaagtgcgcttgcttttgtagcaactggatggtgtgttctatgtgtaagtacagcattcctcttgtttctttcctcaaatgttgcagggttaatgctgtttgtagcacagattttagttgcatcactggtagttagtttgattagttcttacagatgcggtcctggcttatgcaaacttctctacttgaatttggttgccacattttctatgctttgttgtttggattttacccacatgccttctaacctgttgcatatcatggcagctggctgtcacatggaagcgcctcgtgaaattcgttgggctctgggactcagtccgtgagattgctcggatgtatgatgccggaatgggtgctctcatctttgtgcccattgtgttcttttcatggttccccttcgtatccaccttccagtcacgtttcctgtttaatcaagctttcagccgtggtctggagatctccctcatcttggcaggaaacaaggcaaatcaggaggcatgaaaagcctaaccacctaaccgcctggatatttttgttgtatattcttggaattgattagtggtacttgatttgaacaacacctttgtacataactgcctgccattttaggagcaaattatgtatccaaactaacagtgccatgccagtttagatgtgagtattcatctcttgtttgtagccgtaacgacctgtaatttgaacattccggtaatttggatgcgacaattcagatagcctgattgctgtatttgagcaaacaagtgtcccgaatctttggtgctgagacgcatataacgccgtatcagtttacctagtagaaacgcagttgtgttacagtcgtttcactgcatttacttgcatatgccacctggagtcccggagtcgtccagaactccagatcgttcacagggaagttgtattaagttcatagtggctgctactattacatgtctctgaagaacctgggtcatcgctacatgaaatgtgtcgcttgtgctgtcgttattgttctgctgatccttccgttcttctgtatagatctactgctctaggatgggcaagcaagagtgaactcgccatgattgcattgcaacatcctagcggaaaagaaaggcttttcaagaactccacaccgttgcaacattgacaaagaaagggctcttggaggatctatcaggtactatttatttatgtggaggagatggctatggtccttgtcatttcttccttctctacatcacctagctaggtcattttctaaataagctcccgattcactggcacttctggattcgtaagccacagcgcccacagttgtgttgagtataccttacgttatggaccatcaggcaggcatcagcactatccacagggatgtgttactatctaaaagcttagtgccccttacggatccattctctctgccacttcatatttaccatttatttcctacttgttgattgttacacgtgctagttttaccactaggatctttggggtactagtttaggcctcctttggaatggaatggatgagattttgttttttttcgtaggaactaactaataaaatttctattcctttgtaactgcgttctaaagaagtccttaaataacgtagtctgctttgaaatccatatagaaaactacctcagatgcagcctacatatgtgcaaatggcatggcccatctgttttgcttattgtccccttgccagatgaatcctggtcatgccactagattagctgtctggctggacgggtaatgtatgccatgtgccgaactgccgacaatgatgatgattgtgggccattagtgtcactatcacctctcttgtagttaaccacctagctatgcaatattgcaatggcataaacacctgcatgctagtaatagcccaataacggtttcctagaatccagacacaacttatgtttgtcctgcagtgaagttcgactctgttctgcattcatccctttcctgtaaccattcagagaaaatcctgcttaataatctttatggagaaatgcagtgcttctacccccattctagaactacatcaatatcctactggtgatctagcctgccaggtgcagttcgtatccgcctatccggggatctgaaaattatcatgaacctactggtgattgctatgctatcaggagatgccagagcactagcttttttctagttgcatttcgacaattcttagtagttacaggaacaatgttggctacatgtttattggtttgcacccaatttatcttagcatgcatgcaggaaggagctccgtatgctcccaacaagccattgaaccgaaccactgtttgacagaaacagcctaaacggaagctgatgagcaccgttgatgtgcctgcctgtcacacttcatataagccatgagcaccatcatattgtcctactcatcattgcatcactcgggtaaactctgtaaattccctctctgataatgaaatccctctttaacttttacagattgtgaatctctgcaagcaacacttgccgataagcaacaagaaatcaacagcagtagcacagctaggtgtgattaaaaaccatgacagtgtgcttgaatatattttagctctttcctcttgtctccatgtatgcagccatctctgtctgtttggtaaaaactcaactgaattgtaacaccttttgtttatgagcttacaagaaaagttttgccctgcatgagagtcctaagaatttactctcttaccacgtgaaggattaaaataccttttgatcaagatgatgcactggatgatgatctttgatcattatctgttacaatttacctgatccattttaccgcgtgctgaactaaaacaccttttcctttctccctcaagctttaggtgattatggttgttgttttactgctactgaaatggatggtaaaaagaaaatgtatgatgtaacttctatacttttgcaagggcaggaaatgtaatcatacctatgtgtacgtttctacttctctagaagaaatatgaccttattattgtgaagaaatgagaatatgaagggtttatctgcaccaaataacagataacacttgtgcttaatgatttgtgtacttctaaaggaattttacggagcaactgactctgatcatgttttttccaagactaatcatgtgtacgaaactacagggaacaaccaagtttcaacaaattaacatgcacaatgattcaagaaagggtacttcttcaaccttggtacttatgaattatgatgtactactaggcttacaattatagaactgtgttatagatgataacttgtactttcatctatcattggatcaataaagcagagcactttcagaaatgtatcatttctcccttgccttcattgatgatgcaacgaggttgagagtgaggcagagcaagcatcggttggaccacaggattattcttgcggaaggtaggtacgtggttgttccattctaggtccatggtttacctactaatatcttgtcatcccttgtgggacaaggcttttttgctttgtgattatactgccactttgttatcctcttgagcactcctgcgcattacaattaattgcatgacaaataggagctatagctagctacattaaagtcaaactttatgatgtcttaatagtttgtggattaatccatttttcaggtaaccggtgaagatgtcgccattgagaggttagtttcatggaaaggctgtgccttgccttgccttccttgttagattttgcttatgtatcattccaagcgagcagttgcagattgtgaaaatgacaaaatagaaactacttcatgtagctggggaattttaacggatgtgtatatatatatatatatatatatatatatatatatctaggtcaaatgatatgttcttgacttgttaatcatatcgtgtgcttatggacagtattcagcacaaccaaactataatatgcacgttttcttgcatgctaatccgacaagaagaagaaaaaaagtttctttggacagtaatattctcctcggtggtttaatgcaggagtggaataagaggccactgttgcaaacttactcagtagactgaatacttacgactaagattatattggactattggtggacggtggcactcaggtaacgggagctcaatgattcaaaaccgactctacactaatttctttcaggtatgtagagccaaagaaaagttgtttacttattccattaaactaataattatgttcttgtcagtttgtgtgaaacaaaaagtttcagaatctgcagtgacaaatgcaacccataccatttggaaacttttgagaacaccgagcaagtcatatatacttaatttgatagacagctaatgatggttgttcaaagcgtatcctgtatggttgattagcctatgtcacaatgcactatttcctaacaaatagcaactcgaagtctcccttcttcaacatttcaaaagcagcacaatttcaggaaattttctaaaagttttaaattattcacactttatgcataagaaagtctaggtttgacacattggtagtcaatatgtgaagttgaccatgctctgcagccatcgcatgcatattttatattcctttttcatcggttaggtaaatctgtgtatgtcaccatactgtggactgggttgcgtagatcgcatgccaacgattgagaggattattttcaggtggtagaagctacctctgtaacttaatttactttttcgatctgtacacgttaattatatttacctgatgcatacagtttaggatatcttaataaaagttttacgtacagcaatgatcgatgcataacatctgcattcgatttctaaccatgttgctattgaatgctccgcttgttagaccagttcgtgcagaaaatactgctactgtactaccaagacatgtgcctttctgatcgatccctgtacattaatttgttctctcttgcacatcaattctgttgcacagcaaactgtactagtccctacatgaaagtcactgtagaatgctttctgaagccgccaaacctgagctatatattaatgcctttataaacgtgtgcaaaggaagagagagaaagagaagagtaggttcttcctgttcaacaattatccataggctgtctatgctttgccccaacatggacatgacaaaacctgcatgatcagaaagcgatatatacgaaaatttccgggtacaccagatataactaaatgtataaaaacaataaaacgtatatatagcccatttaattaaggcaatagaattataaatggtggccgtatgtttcaattaatttgtaacaacgtgcaaaatttacattgtatgcataaaaaataatttcaccgagcaaattagttgtttgattactagctgcgtcaggaggtggaaaataatgagctcgatcaaaaccttccaactcaacaactctgtcaaattcagatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21413 - DNA, 711 bp, Oryza sativa
gttgaagtcgggaggaaattccatgggacggacaagaagcaaaaggcagatgcatcaacgtgatgtgtttttggaatggcttagacctatacaaggaggaatcactgaatctgtaccactagattagtattagtttggcttggccaagaaacggagcagctgaaatctgaacacctcttttgatgttgctacaaatttattatattagtatcaattactatcagattgaattctgtttgtgtcgtggctggttctagattcgagtggctaaactgtacccatgttcttcagcatttctttaatctacggtattgagaaattcatatcttcctcatcataggatgattgattacctaaggagctcccgcgtccctctgaactcttggcatgtcaagagacaatggaattgatggcatcacgcatggcattaatcaaagaaaatatcatgagtgaatacacagtactatgacgacgataaggttggggggggggaaatgtttttagagaaaaaaaaactccataacaaagatgttggaaggaagaaaaaaaaatgttgggaggaagaaaagaaaaggtctcagcctatatatatatatatatatatatatatatatatatatatatatatatatatatatatatatatatatatatatatatatatagagagagagagagagagagagagagagagagagagagagagagaca

SEQ ID NO: 21414 - DNA, 637 bp, Oryza sativa
accccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttagcaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaacatgaaagcgcatagtgcacatgggaaaagaaaacccagctttcagtagtacagaaggggcacacgtgtttcctcacaatgttgcaggcagtcactgatgatgaataacgtgtttacattcggtgcacatacaaggtaagacctgtaagtagcagaaccctat

SEQ ID NO: 21415 - DNA, 754 bp, Oryza sativa
  unsure (1)..(754): unsure at all n locations
agcataaagcgctaacattgataaaacaaatcaaacttttttttttttggagaaatagttggctcaatggtgatagatagaaacaaacacatgagctcattcagtgttgtgagtaatgttacactatgtgactttttccaatagagtttgtcagatgaaacagaggaacaagtgcaacataggagtagattataaagaaagtaaataatgaagacatacgttgcccttgtcaaagtctcctnnnnnnnnnnnnnnnnnnnnnnnnnnnnnnnnnnnnnnnnaccccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttacaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaa

SEQ ID NO: 21416 - DNA, 755 bp, Oryza sativa
ctttgattgatcatgaggtgggctggggctgagatgggccttaatttgcagtggatcagataggcacacggaccagaataatccaaatcggaggactcgtttctgaaagcattatccctcccacacaaggaggaaatatatatatacatccccgcaaaaaaaaaagaaatatatatatatatatatatatatatatatatatatatatatatatatatatatatatatacagaaagagaaaaaaaaaacttttatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccgatgaagaagatcttcggcgccaagaagaaccaggagcccccgcccagcatccaggatgccaccgatcgggtttctttctgtctttcttgtttcgattccatcttcaattctattctattcaattcatccaccaagcaatcgaatgaatcgaatcaaacaaacccgcagatcagcaagaggggcgactccgtggacgacaagatcaagaagctggacgctgagctcgcccgctacaaggaccagatcaagaagaccaggccaggccccgcccaggaggccatcaaggcacgcgccatgagggtcctcaagcagcgcagaatgta

SEQ ID NO: 21417 - DNA, 3518 bp, Oryza sativa
  unsure (1)..(3518): unsure at all n locations
aaagacgtgtaattattaatacgatgatagatgttcacattcatgtgggttgatgtgaacaaaacaatctcaactattcaaatgaatgaaaaatatcagaaaacaaagaaaatataactgttcaaatggaaacatatgcagtatcggtcggaaaataattagtaattctcgtaaaatacgaacggcctctatgtatggacaaatggagaaggacatgtactaggtatttagaattttgggtgatggtgattctgccccaccaaggttataatggaatgaaattattccagtcaaaaaaaagaaataaagtaatttaccgtattataaaaacaacaatttttgtgaaaatatggtaaaccaaacaaacagtcggtggggcagaaaaatcatttgnngttctatttgctttcttttttttttactattttcacctggttttggtgataaccattgtcagatggttcaattggaaaaaaaaaaggtactcctaaatgaaatcataacggtacgtagccggttggtccggaattaccaacaccaatttcaccattaataaaagccatgtcttattgttattattgctttagtcccgtgtcaaggtttataagtcatagtaaataaaaaaatcccagccgaatatattcaaattaacaacgtggagaggatgcttaatggaaaatagataaaataaaataattagtaataacggtaggagtactaatctatgtactttgtggctttcctaggtagtccggtgtcgtcttaggacaaatctatgtgtgacctacattttatggcctttcacagtggaccacgcggggcgagttgcttcatgcctccaccccacttgcgtgatgccctggaagagggagggtgtgggccctattacctttgcataggctctcgtccctcaggtaagacgcgagttccttgcctcgaaaaaactagaaaagcagcatagcatccaaagcatcgatcctggaaagctcaccccacccccgccatgcctggtccctcacgtacaacacgcagtcgcttgttgtcgagggacaccgcatcaagcacatccgcttaccaatgccaccgaatctgcaaaggaagggaagaggagatcgggaatggagccgccagacccgaccgatggagaagccctccttgacctctttttttctctctttactggcctcgccaacaaaccgtgtgaaaggagaaagaagactgcatgtgtcatgaggtggtgtggctctaacatagtgagccgaagccacttctacgccgttaagccgtcacatgtatgtatgtatgtattgttacgtgccatacgcagatcatgttgtgttgtatgtattattgttgctgcttctaccatactatcccttccatctcaatatgtagcaatctagcatgggattagatctatttctcattctagattgatacatattggaacggatggagtactacctaggaggaaggaaaaacaacaaagcttctgttggaagactgtagtacgaacaaacatgcacgcgtcgcgtcgcaggatgttactagttagctacagcagcaattactatcttacattttcggatttttcctttaatatagaatttggatccaaaatctcaagatactactggtctctctctctatatatatatccatatacacgctcaagacagtagacaaaatccatagcatctagtacgtgccaaccatgaatcaatcagtaagtacatgacatcaacattactctatcatgcaagtcagctatagctagctcgagaacacagagagaaagatactgtatcgtatcnatcatcataagaagttttgattttggtcaaacttaaactactttaaatttaactaagtttatgtataaatatagtaatatttataataccaaattaattttattaaatcaacaatcgaacatattttcataataaatttgtgttgagttgaaaatattattattatgttctataaatttaatcaaatttgaagtagtctgattttaccaaagtcaaaacatcttacaaactgaaacggaaggagtagtagttattattattattattattattattattattattattattattattattataaggtaatagtagtggtttagttgtttgcggaagcataagatacacgtgatgtggacacgtgattttcgaagagattatttcttttggagtaatcaatggccaatatccacatgtttaagataaagatatgttcgccatcaatatgctgctgctgcctcctatactcctccatctaaccttcaatggatgtgacacggccgttgcaccatctcaaaatataacaaaatttaactttcgatgtggatattaaagagttaaatataacaaaattttactttcgacgcggatataaaagaggggatcatatattttatgcacaaaaacctcccgtacacacttcatacacactaactagcaaatatcacgaaaaattctataaaaaaggcatttactactaatagtattacacatatatgcaaagtctcatattcaaattcattatattttagccgtaacaaaaaaagtgaaaaatctaacagttttacaggtaaaaatctgtcaggattttgtcttttttattacggctaaaatataatgaatttaaagataagatttcacatgtaagtgtaatactattggaagtatgtgtccaattttttgtagaattttctgtgacaattgctagttggtgtacatgggaggctagtatacataggatatgtttttttaaaaaaaaacaatgtgagtaggatatgtttccataaagagagggttaaataaaattatcttctcaggatggattatatatagacctaaatagttagggtttaaataataccaaaagtactataggtagtttagggttaaatgtcacttcatacaaatattaagttgttatattttgaacaaaattaaaaatgcagaagttgtattttgggatcgaggaaataccatattatatcacctaccactaataaagtagaggttatataccatgaagataagtgtataacgccaacttaagagcgtttgaaagagaggaaatgagaaaatcgataagatacactaaacaaggtgataaattagcgtgttaaatattaattattttgaaattgaaaatagattaatatgattttttaaaataacttttctatagatttttaaagagtattttcaaatttatattaatatcactattaggcaggacacgggaggtgatgacaaccgtctcgcgtgaacgggagaggttacgcctcctgcattgcactttgctctcccaattccttattcaattccctccgccctaaaataaatttatctttaccttattttatttatttaataagttcacttttaatcatcactacatcaaaatgtgtgtaaaggtaaggaataattgtcttagagcaagttttatagtagatgtgactaccacctctaatcttaaccatgtcatctact

SEQ ID NO: 21418 - DNA, 15960 bp, Oryza sativa
ttgccaatactaggacagtgagtgagtcatttgcatctgcataccctaccttacctgctcctactactgctcgcctcgcttacttactaccctcctgctcctaacaacaacaacaacaactacaacaacaacaaggaagctctatcgggaaagaaataggaggaagaaggattaatgatcgaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaaattttcagcctctactcttattactcatgttattattatcatctcctgtataaatgtaatcattggatggcctgttctcgatctgattcaattagctagttgtacagtttaaaggcgtgtgctcagaatcatccatgaaatggatcaacgcgatcagtattcggtggtgtaagtgtaaaaatatatgcatgtatgtatgtatgtatgtatgtatgtatgtatgtatgtatgtatgtatgtatgtatgtatgacaggcaaacaaattaacacaggcgttgcaacaacatttagttataataatggataaccacatcaagcataaagtcgttgaagcgtagaatcagagagtccatcaggacagggaaattgcaaggcgccagtgccatcaactttacgttgacactgcaagtgctaatgcgtagtacgtctctcatcactgctcatgatccatccatccatccaaccactccatctgcgtgtgtgtatatgtgtactactctactttatacgctacctgtttgtactcccagctgaactgaagttttataccattctgttttcccaactgaagcttcaagctgaggttttgtacatatgcaatgcaccacaggctttacctagaggatgaagctgacaagcacaacaagtaactaatctcttgacagataccatactatcagatagattcctgttaccactcatagattgattgatcgaattttcgcacggggccttgtctggtcaggaacgtttaccggccatcatcttaagatgataagagcaagcgaaatgctagtcagcctcactcacacctttgcctgccttttggttccctgccctttcatctgaaacgtcacggatgaaagctgaattatttaatggagagcgtttatgcaacatctctttcttgccttcttttttcctccatttctttatacccttcgctttctgatattcaatacatttgaccgtatatacgggcatcacgacagccgcagatatttcacttaaaaagaccttcacaagtgtaaaatggagtatacattacttaaacattagctgcaaacagcacatgcactagctttccatcttgtacctagttgatcaagctgaaaaaaatattgggcttgcttttgtactccgtagctattacacgcagtggattatttttagcagcaacatagacagtattatagcaaaaaagaaatccaagttccaactcctacacagatggaatccatctcttaggtctccataattacctaccatttcacaagcaaaaacactattctagattgtaagccaggcaaattaaggtactccatccaggtgattctgatttctgaaagactaacatcttaaacatccatgaatgcttaagactgactgtaatagtgcattatgatatcagatatctacttctgaaactactacaccataaagttcttcgacatcttatctttacaccaagacatcttgttggagaagccaacaatgcagtactaaacagttactaatgcatgctcgccttgctcggttaccagtaagaaaaaaaatgctcaatcccacaagatgactatcaatggttgggttttaatcagggattgataccacaagaagaaccatgctgcagtagcatagctaaaccacaacagaaaccagggagtaaaaagcagacgagtaataagggttttgcaaaacgcaaatggcaacagcatagattatgtatggataacgctttcactcatgataccaatcagagaaaaacacccagaattcatgtttcatttttacccaatatttgcaatacagaatccctaaactcaaggatctgtagcttcctcacctagcctggtgcgatgccattagaattgtagaaatatgtcttaggtctcatcaaaattccaggttattaaatcatcacagcaaagcaaaatcgtatatcagttctttcctcatcacaaatcttccagggctactgagcaacttttgtgttgcccctttgcctcgccaggcgaacacatgcttcaaatctcttgactgcctcagcacacttgagtgggtcctgtgcattgctcacgtaacactggcggcagtttgacctctcctcagtgcatggcgtggggttttggtacggcagcttgaactccttgtcacgcaggtcttttgatttcttgatgagttcatcacgcatcccagcatgctgcttatccagcttctcctgaaccttttcgctctcttccagaacggcacggatggcttccagctctgaaaaagcaggtgggggtggtggaggagcaggggttacggggagatacatgggaggctgcagtggccagccaggaggagccttgggttcagaagctgggagttcccttgagttgtcctggggctcttgttgatgttgtttgacagtcttcttaggcttgggtttcctggttttctttttgatcttctcgtcatcacgagcaagctggtcgattagcttggtgctaatctggatggtgtagtcacccataacagaaagttacaaacagacgctgcaatagaagtaaccaaaaggaaaccaggttgaggcatcagcatgaagtttacttaagtagtaacacaatgcagcaagcacatacacaggaggtattgaaatgcagtcgtaaaaagcgcatgttcatcatatatgttagcataatacaatgaagcacattgtgctggttgtatgtgaaggaagatgagaaacatttatacagcttggttgatactgacagagagtatggagcatagaagaagaagctgtaaactaggcatgactgtgtgccaagttaaatcagagcaaacagtgtagtggcatttatcttgattttttttattttaaaaggaggagtcatcccctaattcaagatcatctatctttgtttcttcggctgccagatctgcctagacaattggctattaggaggattctttgcataaaaagtgcatgtgcaggaaggtgggcgagagatcaattaccggattcgcggcaacaccgcgattccgatggcaaatcctaacgtcctaaaaagtaggtaattgaagggatagttggcgaggggatcgagcggatgcttacctgagcggtcgaggtcgatggggcgacgcaggagaaagaggaacggcgccagaggaggagagcgagcgcgagctgcggcggcggcggcgacgacggcgatggcccgtcgccctagttcgtcgcggttggggttggggagacgaacagcttttcctcttcctctgccctgtctctgtgtcgggctttctacttactattattgggcttttttcttctttgggccattgcgtctctctctctctctctctctctctctctctctctctctctctctctctatatatatatatatatatatatatatatatagactgagaccttttcttttcttcctcccaacatttttttttcttccttccaacatctttgttatggagtttttttttctctaaaaacatttccccccccccaaccttatcgtcgtcatagtactgtgtattcactcatgatattttctttgattaatgccatgcgtgatgccatcaattccattgtctcttgacatgccaagagttcagagggacgcgggagctccttaggtaatcaatcatcctatgatgaggaagatatgaatttctcaataccgtagattaaagaaatgctgaagaacatgggtacagtttagccactcgaatctagaaccagccacgacacaaacagaattcaatctgatagtaattgatactaatataataaatttgtagcaacatcaaaagaggtgttcagatttcagctgctccgtttcttggccaagccaaactaatactaatctagtggtacagattcagtgattcctccttgtataggtctaagccattccaaaaacacatcacgttgatgcatctgccttttgcttcttgtccgtcccatggaatttcctcccggcttcaaccgcctccctgtcaatcagtttaagtaatcaacttcacttgtcgcatggaataacaaacacatacacacatgagttccaaaccaatcataacgacaccctatatatgtctatgttaattgctaaacaacggaggaattcattgcttttctttgctcacagaggaaggctttactacctgaacgcgctcacaagctcgccgttctctggctcaagctgcaccccctcatagaaggcattcgcggcttcttcgaacctctgttggtatcaccggaacaacttcagcaacaaatatataggtaggtaatcacaactgcctatcagttcccaaacttatcactgaaatcaacagacctgcagcaggcgcagtgccgcgccttccctgtagcaagctttcgcccagtctggcctcagcgctcgacatgctcttgcatcctccagagcacgttcagcttgccctgcccgtagccagcaaaggcttctgtttgaatgcaacgtggcgtcgtttggatttaactcaatagcctgaaatgtagttccattccattctactctttgaatttgagttcatatgataaacttatgcgccttttctaaaaatacacgctgtcttgcggtttggttcttacctgtgtgtaggcatctactgctactaggtagtctttatttctgaaggcatcatcacctctcgattttgcctccaatgatctctcttttgcctcagatgacacctgtacagtgtcaggaaagcaccatttgcagcaatagttagatcttgagtcttacagttattaaatagttggagccttgaagatgaataaaactataaagtaaattgcaatgcacctcaacaagttgtggtacttgtaatctgtctgctttctgagttgtagcttcctttacctgtgcctgcaaaatttattcaaccattgggatcgacaaagaacttgcaactagtaatagatcatgagaagattgaagttgcaccttttcctcgactgatttagtgtattctataattccatcaatactccaactcgaaacacctggaattggtgatgtcaaaggtaaaagaagttccacaacttcacggttattcctcaaagcagcaacctgtattggctttagtccatcctgtagaagaatataatagttattcaaccattagcattacttagctctactgctacaccaaaatcaacagtcatgtccttcagtgaaattatgcagcccagtgctgtttgctcaataataatgcaagaaaggacagatgatggaattgcaaaagcagttgccaatccagctaaacaatacactacagggttacaatagttattcactgcataatgaaacggtggaaattttcagagtaacacatgctgaccaagaaagggatattcattatcatacatggtgtggaacaaacagcaaacgcttgacaccctcttacgaatcattttgaccaatcaatgcacatgaacctggctattgacatttaaatatttaatgatacactggaattctgattaatgtacaacttacatcatcacatgcattggggtcacttccagctttaagtaaacaatttattatttccatgtttccaccatctgcagcaatatgtaatggggttgctccaccagctctgatattcggatgtgcacctgcctgtgtagcagattatatgatcggttttttatacgaatcatagatgtaaggggtgtagaagcaacagagcatcaaacaaaaccaagaacagaaacagcatatgacaaaagtaagaacagacactttgatcctcttatcaaaatcttttgatataggtagcacacatataagaacgtgacatactatgatttgccatgcagcaatctaatcaataacacgaaaaatgagcttgtctgaacccccattgcacaagccagattactaaacaaggaaatatagcatacagaaaccatatgaccaatgaatggcatcgaagtggataatatcctaaagtaaaagcaacagattttggtattttactcttgaaattagatttgtgtacctgaattagaatatccaagcatgggagggaacccgctgcaacagcagacaacaaaggcgtaataccatcatcgttttcagtatttggctgccaagcaataactagcttcagtaaaaaagttaaggaaaggccacatgaacggctgattgaaaggtggttgagtgctaaacaaagagaagcctgtccaattcaaagaaacataatagatacagatgctattagaaccaaaagatagcatcttcttaacaatagcaagcttgagaacccttggtggttactgttaaagtgtcagttgctactagtatttgacaatattaaaaggcgacatattaaaatttcagcataatgaagatttctgaacagaatgactagaagctcaggttcgttaaatcagtgagatatgaagtgagataggagatagtggatttattgaggagcaaccttagcatcgtgttgaagcaaaagtttgactgcctcttgctgtccatgaccagcagcccatatgaggggtgtgccggcatcgctttctgattcaacatcaacccccttggagagaaatagtttcataaggtccaggttccctgcagatgcaaacaaaaaaaaaaggagagtggtgttggacgcatttatagaggcgttggcacaatcaaaatgggagaaaaaagaaaagagtatagaccatcaatccatggaaagaatgaagtgaaatggcaaatagatgatgaattttacctatgccggcagcatggtgcaatggcgtggctccgagggaagaagcaacggaaggatctgctccatggtgaagcagataggttacagtttggagatgggcttggcgcgtagcatggatgagtggagtttcacctggtggagtggatgtaaactgatggatgagagattgtgaagaaatcagatgagagtaagagatagtgatagttagtagtaccatcgtcgtccttggggtcgacggggagggcgaggtcggagatgaggaagtgacagacgtgggtgcggccctcgcgggcggcgaagtgcagggcggtgcgcttgttggcgtccttgacggcagcagcgacggcggcgacgcccttgccctcctcgtcgagcgccgcagcgagctctgcaatggcgcatgaggagaggagatgagaagaaacgcaaggaaagcaaaggagagagagaggaaggcatgggggcacctactcttgagggagtcgagatcaccggcacgagccgcttcgaggaaagcttgcaccttgctccgagctgcagccaatgaattcgaagcgacctcagacctcagacctcagtactagtactaggtcaacagttgagttggaagatggtactgtacctgagagggcggcggtggcgtcggccatggatgatggaagggagctacccgacccgagcaggggggaattgaagccggaagggtgttccagaagcttctggagacgagacgggaggtggaggtggcggcgtcgagtctcgagtaggaggaggaggaggaagcctcccgtcccgtcgcctagactctcctcttagggcttgggcccatataaacacggcccatatcttcggctttctttttcttccttctctttctcatcaaatcatatcaggcggctgctgttttgtaagtttgttttctttcatatttttttcctgttataagatctctactggagtaccaaatatcagcatgtcacatacaagatacagtagcacatcttaacagacataccaaacgaatcatatactgtatatcatacgagatacagtagcgggatcttaacagaaattccaagcaaatcatatatcatatgacatatatacagtaacagaagtctgaaacgaatcatggccctaagctggatgaaatatcggcatatgtcatacaagatactagtaacaaaggcaaccaaccagttgactcgtcttcataaaattaattaaccaagtactagtactcttggcattttaagttaaaaatctcgacatcaaagaccaaggtgttgccctggatgatgcattcatggctatagatagatagatacataggtgcacatgttttcctctcttttttctacaaaaatttggcctcctcaagaacaaacgagcccagccccgcacgtatatgtgttgttccatcacatcactgctactgttatctcttctctcctactgtacaacctaaaactacaagcaaagcaatggagagctcctggcagcaccatcttttaacttaaataaaaacacctcatcaactaactcgtcgaacttgcaagaaacccaagtccaggaagcctcagcccaccaaatctgcccgtgcttgtgtttgttcctgtgcttgtgttccttcctgtgcttgctccagttgaggatgaggctccatttgaagattcaggagatccttccctcatagacgacgttctggtcacaacactccgctgctgctgcaaacgccctaatccttccctactagatgatgctttgctcacaaaaccccactgttcctcctgcaaaagtccagcaatagctcgtttcaatcatggaaagcgcaagaggaaactgaaattgcatgcaacaaagtgcaacatcaaactgaaaccacacctgtggcacctctgccctaggtgatggttcagctgcaggtgcggttgtcggcagagctggaagagcagtagattgaggcaacgaagaaacctgcaaccagaaacacatgaacccaagtcaacaaactggggcatgttccgaccatgacaaagctgggaaaagtgcaagcctttaccctcctaacaactcgctctgaagatccaatagctggaggaacggatgctgctgggacctgaaaataaaaacatctcttcagaataagcatataggaaaagaatatgcttatagttgaggtgcaactggttttgttaaataaagcatagaagaagcatggcattaaggaatcactagaccattcaaacttgcctggcgaatagtggctttctgggtgaactcaaccaagtcagatattccattagccgtatgatcctaaaaggattttaagaagatagcattaggagcatgtcgatgagtttgttggtaatatgtagtggtaacatgagcttctacttttcctaaaaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaactacaaggttaactgattgtaaatcctcttggaaagcactcagatccccatggatgactgtgacctacaagtcagtcatgaaatgccattaggtcgccgaaaatgcatcaaaaactataaaagtaaacacaaaaaataaaaggaaaaacagttccaacctcatcccttgtcccttcaataatttcttgtgtttcatctaaactgatatccacacgatcaatccttccagcgagatgtttccttgcagactgaatagtgaaaatcaaaggccagtaagatgttttggttggaacaatgaaaacatggaatcacaagtaacacatttgagttcagcgttgctgaaagaagttaaaaacttacagtgacatcatctgaaaccttgtccaattggctgccaactacattgcaagcatcagataagccacgcttcgtgacaaacatcaaatcagaaagtttccagccctgcaaatctatgtaactttagaaactagctagaacagtgaaacaagaaatggcaagcagataggattgtaataatatgcacttgcgtccatgatctagaatgacggacagaacaataaacatcaagatagcaactagaataatcaaagattatgtcctcctcattctgtacttccattgaggtgaaagaatcaaacattaccttccacttaatgtaggcgtagccaacagccccagcaacaaccaccgctgttatagtaaatgtaccaggtcctacagaagaaggatttacatgaatgtcgttcaaggacatttgagaaagaatgtgtgtaacctagaggggcaaacatatgtaattgtgtatgtttaaaggcaaaagagcatgatgaaagtttattagcaattataaaaactatcacgtgtccaagaacctttataatgcagcgaataatataatgataatcagtagtgcatagccaagaccatgacaaataataataaggaaagaaaaagaaaagaacatgtgaactgaatcgcaaaatggtatactctgtatatgaacagacaacgcaattgtagctctgtcgaacatgtagatataaaaacaacagaccaagtctgaaaaaaaaatcgaaaggtaatagaaatatctaacactctaaaatcgcattaattcttagcaagagatgtcgacatcggggcatacacaaagtctagtgtcatgtgaaatttatgtttgtatgatctgtgacccatgcataagtctgtaactaaaacatagtaactagtcagcaggaacttacctgatctagcagcattggtgacaactgtaacaggccttgatcctagagattgtatctcctgtctgagatggttgacctgagataatagctgagcggtgtgtgtatcggtgttagacgatgtatctttcccttcgtttccatgcttcttgacaaactaggggggaaaggaatcatgtgacggtgagttataagatatataatcaatatagcagtagtattctgggttgatagttagggcatggaggggcaataatacaataccttggcagcaccagaaagtacctccccggcactagggagtttggcatcaccacctacaagaactgatccaagaattcctgcaggcaagcaaacaacataaacattggtaccgagtaaaactagtatagttatttagtgaaggcgtaattatacttaagataaaaagaaaggcaggatcagcctatgtactggggaagccactaagttgggggggatttgacagtggtgtttcatgtagcagtgggatacccaggtaataagttcccctctggtttgaagcgaaagcttagttgaactaaacaaaccccggccccggccctaaaaggctagatcaatctatgtattggaatctggtaaagcaaaatactccgtacaagatgagcaaataagttgggatttggtagtggtattccctagaagtgggagggattggtttggtaatctatctatgactgcgccatggttgcaagtggcatctactcctatctatctatcaatctccaagtcgaaagtcaaccggctgggctgggcgacgagaagctagctagggctgcgggtggacctcaggagggagcagacggcggaaagtgactcaccggagccgacgaggatggcgacgttgccaagcaccatggcggcgcgcgaggagaagcccctcctgcctgtagctctgcttcaatctaacggcggcggcggcggcggggacgagggcggcgaccggcgagagggaggacagattaaacctctcgatcgatcgatcgactactttttttttttccctagactagtagaataaagaaagaggaaaattactcctacttgtttgctagagagagaatagaatactgtaattattaacggggcagggaggccaaggggagatctcaatctgagacggtcacctgttgaagttagacagtatattacccgttttcttttttcccacgctcccctctaatcctattttttttacgacactgccactacgtttttttaatccgtcccatttcctttttatcacaaaattgcataaactgcctcaactttaatcatccttgttttgatattctacctcgaaacctatttatattgcaaaaaccaacactgtcgctttgaaaattgctcattcccaagctagatcgtgctcatctagtgtgattgcgtgataagtccaactcaaacttgttcttagccaaagattagtgctacttccatctcatctcgtgacaaacaagtctctcacccaacctagagtcgaggaatagcccaagaataaactcaagtcggactcagctcgtagccacactagaagagcctgacttacatgatatatatggtcagcaacgaatacgcatcacaagaaaaaaagggtcgaatcaactactcccgtgtgtgagggagaaatgtaggggaatatagtataaggccctgtgtacttcaagggggtgaaaatttttagcgtgtcacatcagatatatggatacacatttgaactattaaacgtagtctaataacaaaataaattacatattccgcatgtaaactacgagacaaatttattaagcctaattaatccatcattagcaaatgtttactgtagcaccatatttgtcaaatcatggcccaattaggctttaaagattcatctcgcattttacacgcaatctgtgtaattaattttttttgtctatatttaatactccatacatatgtctaaacatttgatgtgatatggtgaaaagtttttcgtgggaactaaacatggcctaagtttgtatatgcaatgtactataagaacattgtttgagcccgtaattttagaagtatagagcaaataatccacgtcaataatacgttgaataagcagaaaagatcacgtgtgttattttcatagttgatagtttttttttactatccttttattcatgtccaagcacctttggttactcactctagactgttctattattccgcgtgagacagggattagaagggattgagtaggattaattccgcaccttaatcccgatgggattaaccaaagaaggccttaggataagtttagaggcattttggtaatttgataagggcaaataataatactcccttcattcgaaaggaaaacaaatatagtactagagtaccatgaatctgaatactatattaggttttttttttaaatggagtagtacattggattattgtaaagcatattgtaggtcaaactacaaagtcctcggaataataatatggcattggcaataccagatcaaagctcaatttgatgatagattgtcttcattagatcagtaccttaaacctgaataatactacagcttcttggaggagaaggaccttgtcatcttcttcttcctccttccagaagaggatattagtatacgcttgtcctctcatagcacatgaaccaaacaacccattcttttgtgtccggttacaaatatattatttcatcctttaagaaataaatgtgaacatgtgaactgctatatgtcgttgggctactcaataaaaaggtgattgatacatcatacaagagggggaatctaacgtgataatagtcccataacattgctacacttttgttgtcttttgcatacccacacacaaatagaaaccttcaagttacacaggtcatcatactgttatatgaactttcagaaaattaaaactgcaatccaactctgcagccatcattcagtcaaaaattattccagcctatcatcaaagcataagcaaaacctagtatcgagccattattgtacaaaaccaagtgtcatcggttcagtatagagggctagaggcggacatggagccaattctaaaccatgttcttaggatcaaaaccaagtgtcatcagttcagtatagaggcggacatggagccaattctaaaccctgttcttaggatcccgcggtggatgagttcccagcatcatttttcttcatgtcttcaaacttatcaatggcgacctgcagctcatctgtgcctcccaccgctctcatggtgtagtaatacacgccgaggacgaaagcagacagtcctccagccaccacaaagttcttggtcttgggtgccaggctgccgaatcccgccatctttagtttgcaccggttgttgcagaaactgaagaagagaatgttacagaaacaggaagaagtggtgccacactgatgccagttgacctttagccaaggcacagagctatatgggatatatgaatttaaactgaagatagatatggtttgctgatgtagcctcaagactaagaccctgtttagatgcgactaaaacttttaagtccctatcacatcggatgtttggacactaattataaatattaaacgtagactattaataaaacccatccataatcttggactaattcacgagacgaatctattgagcctaattaatccataattagcctatgtgatgctacagtaaacattctctaattatgaattaattaggcttaaaaaatttgtctcgcaaattagcatttatttatgtaattagttttgtaagtagtctatatttaatactttaaattagtgtctaaatacagagactaaagttaagtccctggatccaaacaccacctaaactagtgtttgtctttaaatcacagtataactaaaagtgggaatttgtaatacaagttccgattatactagaaaacactcgagctagtcagtgctagaatatcaatcctggacagaacccatctgctacaagtgcagctggcaatggcaagttcgagagcataacattagcttacttagcagtggggaggggattgaaccataccagaacatagcctagattgatttggacatggaaaaggaaaagacttacctcacagcagtaaattttgagagattaataattttagaccaaagaaagattagagatttaaactaggtttgatggttggagtttggctagactagtaatttcgggtgtttactgtttagggagagtatttgatctccctaaaataaaaaataagctatcatattcagagtgaagggccttagtattagagcgtagaaactcatcatcacctgtttcagctactgatgatgttagtacactaaaatcataaatatctcagagctccttttatactggatttatagtggtacccaaaaaccaaaggcagtaattgtgtagaaagcaaagattttcatattatcggcacagacaggtctctgtattgtttttttttgaacagattcagagttggtttgtaaaaagactccctcgctctaatatactcctaggcagagtagaaattgactaggaaaggat

SEQ ID NO: 21419 - DNA, 628 bp, Oryza sativa
gtcttccaggatgaggaggtcggtttcctgttcctcccactcccagtgggccaatgggccttctgggtgggaaactgcaagccggcccgatgagatgaacttcaccgcaggagcgcgccaaggccaaggagaagggggtgttgccgtagccgtggtggtcatggtcgtcgtcgtccatcttttttccagtggcggcggaatggccgcagcagtcgcagcctcctcaacagctcttcatcctcggcggcggataaccgaccggcttcctgcaaaagatagcaggcttcatcaataaataaagagaagaagtgatcgttaatacgactcatcaacgcatgcaacgacctcaagtactttgttgacccttgtctcaaatctcaccgactttgccaactatactacttcagatcaggtttgttcatactccatccatatgcatcccatcccgacaggcagaggggcggacaaacataacaaacttaatttgtgacgagtttgttgaacattaattttctcctctcgtttgaatattagtaatggagagcagtaataatcacacaatatatagttcattgacaaatagaacaaaaagtaacactttatataggaatatatcacaagaaaagaa

SEQ ID NO: 21420 - DNA, 2756 bp, Oryza sativa
catctccaatgatgatcttctccaaatgctcagtgtttatggtgatgtaaaggaggtagctatactgccataattgagtaattgactacaaaactgaaatccacacactatggtaatcatttgttgtttatagatttccagctctcctataagctgcaccaagaagtttgtagagttctatgatgttagagcagcagaagaagcactacatgaccttaataagggtggaatttcaggcccaaagttcaaggttgaacttaaccaacatggagaggcaggatcttggtaatttgcttggctgaatttttttctacccgtttttggtattatcttttcatactcgtgctagctatcaatgccttccttcatactataggtttagtatgttagttacctttgggagatgggataatatcataataaaatatgttcactgttttcttaggtaaaattatgcaaatactcctagatgcaaggaatgtatctcaagttctcattcacggtttttctcatagctttgcagccactaacacacctattggtcgttctttcattttgtggaacagccatatatcaactctatgtcaatcacttgaaccttttaaattttcattaaggacaaaccaactgggcgtgtaacttttttttaagcgttatttgattagtgtggtgaagattttatttatgtacttaacagcttgaggcagcaacattctagagaatggaagcaagacagtttgcctcaccaacctaaaaactcttcacctgggaccattggtacaatatattacttggatatattttggaaattgttgatcattacttattttgccctttttcatgccaaaacaggaaagttgggcaccaaatgtcaggacaacagcactgttcataatttattttctccagttaaccaacaattggagagcccaacccagtgcatctctacgactggtcctcaaattttatcttcacctatcagaattaaatctacacttcagcacaataatcaagcctctgttggcgatcttagtggacctcttggtcaaggaaactttggacgtggaatacaaaccctccacccacgctcattgccagagcatcacaaccgcatttgtaataactctaagtccatgacagtaagtggtaggaatgctagctctagacaagacggagtggatcacaatatccaaaaagtgggccctgctggtttttgcggtcattcttttgatcaaaataatgaaggtaacagttctcagcttcaactgctcattgttggctttactaacctatgtttttattatcataacaacataatggtgaacctttttggaaatattggatgatgtagttgatgaattgaccagcttaatgattttttttgttagaatttcatcagcacagaaattgttttttgcagcatttggctttactgaaattggaagttgcccccttcatggatatcactacacctggaaccacacaaatgtttttccacaaagtccctcagctccaatactgtggtcgaacttgcagcacccaatgcacgtgcatagttatcctggtgtgccgcctcacatgctgaacacaggttcttatcccatggaccagcatcacttgggttcagctcctgacaatggaggcagttttggaaatgtgcactcttttcatccaggatctctcggaagcataggtttgcatggtagccctcagatatatccatcagaattatctgcctttgcatccagcagaggaaattttagggttttcttgttctccccagttggcgggggatttcaatcccttcagcaaatgtgcaatgcaatcaatggtcggaatcctatgatccatgtttccacttcatacgatgctactaatgatcggatgaggagtcgcagacatgatggaaatcctgcacagtctgaaaacaaacggcaatttgagcttgacattgatcgcatagcaaagggtgaagattcacgcaccaccctgatgatcaagaacataccaaacaagtaggttctgcacatcttgccaccggttgccagctgtcttgcacattactcaggtatcttttttttcttctgttgactcaagtcatacttgatgtgatccacaggtacaactgtaagctgcttttggctgtcattgatgagaaccaccgtggaacctacgatttcatctatctcccaattgattttaaggtctactttttttttcttagtgtaaaagattgcaactgtgagtacaatttcaggactgacttttgcaatgttcacttttctcagaacaaatgtaatgtggggtatgcttttatcaatatgactgatccgcagcacataatcccattctataaggtatacatatcatgcatgcattactagttaagcttctccgtttttaatgtaccttccaagatctaagcatagcatatgatataacagtatttttattattgtgttgcattcttttttgtgggaggaagattttttaaaaagtatttctgccctgtagagtactgccagttttcccctggcattttctaattgaaagtatgcataggattaattggacttgacatttgctgcagacatttaatggcaagaaatgggagaaattcaatagtgaaaaggtggcgtcgctcgcatacgcccggattcaaggaaggagtgctttgattgctcattttcaaaattctagcctgatgaatgaagacaaatggtgtcgacctatgcttttccacaaagatggtccaa

SEQ ID NO: 21421 - DNA, 584 bp, Oryza sativa
  unsure (1)..(584): unsure at all n locations
agggccggggccggggtttgtttagttcaactaagctttcgcttcaaaccagaggggaacttattacctgggtatcccactgctacatgaaacaccgacccccccttttggggttttcccaaaaaaaaatccccccccaacttagtggcttccccagtacataggctgatcctgcctttctttttatcgtaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctccccnnccccaaaagaaaaggggnggggtttaaaattntggggtatatattgggccccctcacatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacag

SEQ ID NO: 21422 - DNA, 1730 bp, Oryza sativa
  unsure (1)..(1730): unsure at all n locations
tgtatcattttattagttcagattatttactgccagggatttcctgtttagactagatactgcactggtgggctaaaagtgatcaagtatccaattttggtaggtaaagatatccctgaaacagttcagcagggaatgagtaggaactttacttgtgggagaatgcttacggaattttgtcccaagacagtttggtaggaactagttggacagttaatttagcacagttcgatattaaatgatcaatttatcatatgatacatgtattgaaggttgtaatatggtgataggttaaatagttcttcaggaactgactgtgatcattaatggcagggagcaagtcagtttttgcttctccacttgaaaagatccaacccaatggagcaaatcatgcaggagatccggaaactccaggaggtcaagccttcaagggcctggacatccttagcctcagcaatttgatgcggcaagaaaatgcttcaggttcaccgtcactttcttggggtgagatcctcccaaacccaatatcgaggcttggcttgtctacaagagaacaagcttttgttgaaccaactactgctgatcaacatgtgcctggttatgggaagggcttttcatccactccctctctgaagtattcagtggcaaatgtgagttccctttgccttctttttttcccctacaagccatgttgatagtagaattttatcatcttagttgcactacaaccaaaagtactgtttttgaaagaaaccacaatattgttcattgaagattaatcttttctaagagttcatgatgttctgcagcgagagaaatagtaagtggtgtttttttttttttggggtttccccaaaaattttgccttaaancttggggngacancatacctccatctacgacagtgatgaacctctagagtccatggaagcgatagaagctcaaactattggagatctccttcctgatgatgatgatgatttaatatcaggtattgccgatggatttgaatttactggcatgtcgaccaaccaggatgatgccgatgaagatatattctgcactggaggaggaatggaacttgaaaacaatgattccgtaaaaggtgacaaagttcaggatggatccttcaagagccaaatttcttcaggacactccatcaataaacaaccttcccgaactcttgtagtcagaaatattactgctaacatcgaggattctgatctgacggttctgtttcaggtattgaaccttttccttatttcatttcaaattttggttttagtttagtaaacaatatccttttgaacctatatacacacatatatatctttcagcaatacggggacattcgcatgctttatacctccttcaagcaccatgggtttgtaactgtttcttattatgacataagagcagcccaaaatgcaatgagagcgctgcatagcaagcttctggggctgatgaaacttgatgtgcaattttcttttcctaaggtatgcataataatatcagtagttttgaattaggcatgctacctaatctatatatcttccttatcatgccatttgttacttgggcaatgttgttctgtttcatttttcattctaacttgctacaaaatcatgctattacttttactggtgccccttgtttatttattggtttttgttccttttagcatgcaataatcatttatattctatgttttgaaaattaaatgctgttgt

SEQ ID NO: 21423 - DNA, 731 bp, Oryza sativa
agtttgagctactccatacaccactagaagatcccagattttcttgttgcaaacattttgcaactgcagtctgatgtggaagtcacccattgactcccttcaaatagagaacttatcctcatttactcccaccaggatacctccagatctaccacaaggtggaagccaagtccacttcatatttctcttaccactcaagctctgtaacatactagcagtaaagttctgctttatggtttctaaaatacctacaaaatctaattttaaatctttaacaaggtcttgaagatgacctattttttctggatttcccatccctctaatattccaaaagaggcccttcattaatctttagttttcttttttcttttcctgacaactttgggggttaccttgaaaatctcaaggttcccctttctctgtttcatttttctagctgaagattgaatctgtttaagcacatgctcaatttctttaaaatcctcatcattagtttcagaatccaaatcatcagaaaaaacatttaaatcaggatttgaattctcaaaggaatcaagacaatgttgaccttcagaatttgttccctctttcagaaagaggataattctggccatctctaagtctctaataaaattaatattagaaggctatatcatcaacagcacaaccccagattgaccccctaaaacactagcaatatcaattaaagagacatttgattcatgtatgaa

SEQ ID NO: 21424 - DNA, 19564 bp, Oryza sativa
aatctcaaggttcccctttctctgtttcatttttctagctgaagattgaatctgtttaagcacatgctcaatttctttaaaatcctcatcattagtttcagaatccaaatcatcagaaaaaacatttaaatcaggatttgaattctcaaaggaatcaagacaatgttgaccttcagaatttgttccctctttcagaaagaggttaattctggccatctctaagtctctaatcagattaatattagaggctatatcatcaacagcacaacccagattgacccctaaaacactagcaatatcaattaaagagacatttgattcatgtatgaaggagggaatttttattgatgaaagcattttgtgcttctttcctttccattgccatctcttgggacctcttatcttccttgtctttcagtctcttgcttctcctcatctcttcatcttgacttccaagagcttcttcagttagattaatccccaacctcttagcaaaacttcccttagactcctgagaatccatgtaatcttcactgtcccccggatctactttgtccttgtcttcttgattcaaacccatatcaaaactgactctattctccttatcccctggaacatctgtctaagagctttctaattcttcagccaacttttgattcatcggttgctgcagagtatcaacctgctcctgtgacatttcctttttcccaacctctttccttccttcacagcactgagtcagaatacagtctcctttctgcagttgcattgccaactccatgtctctcaagatctgtgcacatttgatcttatgttctcccagcatcaattctggcaccaggacttgcttctgacaaacttcaatagcccgttacccgtcttactgacatggtgatcttctgtcatgggatccaccaccacaacttgcttaccctctctctgactgctaccctccagagtattttcttgtatctcaattttctcaaaagtgtcatctagctgatcactaaaccaccccagttccaccacctcctctagactgaaatgagcttggaacaaaagtcccttgggagaagttaacactagtttcaaaggcagaacacccagctccatcattccaacttttgccctgatcacattgctagctctgaaagtagccatatcaacctccaagacaggccctagatttgacccaatttcatacaaagcttggtaacccttcatttcctcaggaattccagtgattttgacccagacaatatgcaacttcccaactgcttcagatttctgggtccattctttcacattaacttgcacatcagtgcccttgacattgaaataatcaaagtttgcaagctcatcaaactttatcttgttacgaaatctcatctgaaagcttccattaggcattgctttagctttccaaacccaattccacttaaattgttgcgtgaaaccttgctcaagttgagcttctgtcaattctccaccaaagacagtagagatcatagccagaggattattatgctccttaggtgggtcaggcttagtgttttgaattaagatgcaacctaaacctggagcaccataccctactagctttgccataggcctcggctgcttgtcatagatgcaatcctctgtcctatgtgtgggtttggcacaatttatacagaagacaacattgctacaatccctagccatgtggccaaaacctttgcatctgtggcagaaaattctctgtgggttagtttgcataccagtgcgagaattgggtggtggagttggttgctgggttgcagtctgaggagtcactgcagatgtcgcaatcttctcttcagtttgattcttctccttctgaactggacgatattgctgcagcttcccccctttgttcatctggcccctcatctctccacctccagccttggtggattgctcactcccagcttgcgaggagcccccctggtgcgccactgcgggagggcgaccttcctcaccacggctggacgccgacgccaccctccgcctggatgcccttgattcgccattcgcccacgaaccacccttgcaaatcgacgcttatcgccttggattgtgcctctccaccgagattcaccacctccgatccccaatcgaggccactcctccgcctccacacccttgcaacttgtggattccttccgccgccactcacctctcaaccctaaatttctcgggctctctccccacagatgatggagatggggaaccaactgttggaggtgagtggatttggggggatccattactgtcaaaacggggcatcacgtgtttctaaatatggggttctatttttattatatggtaaaatttctttattgtgaaacattcaaagaacgtgtatcttctcgtagacacggtaaaaatatggtaattagctgttggactcccgagatattattttattattttcggtggaaccaaagagaccacgaacttagtgtcgaggatgtgtgagacacataccccgggcagcaaagctgctccatggtggccttctcatttgtctctatgcgcacacgacagaagaataccgagagggcggatgccggcgacggaggaacatggtttattaccggttgaccactaaattttgacctccattgttatcacggttttctataaatttcgatcggttttcgataaattttgaccaaatctattatttaacctttgaaattctaatcgaaacttaattccgagccgtgtcgaaacgtcgaaatttcatagaattcgaccggttttcgtcggaattgtgaacctgcggaggaaagcgcggcgaaaaattaagtattttttaaataggttaggttagattagattggtaaggataaagataaagataaagataaagagaaaagaaagggacacagcacagggccggaatgcggtttatgggcttacatggtgggccgggcagcccaacccattccgccccacctgcactgaactgaccggatcgagttgttcatccgcaccgcaccgcaccgaagcttctccctccctcccggcctcccttgccgccgccgccgccgccgccccgcgcccatcgcccgacgccgacgctcctccggccagatccaaccccctagctacggcgctccctttctgtccgtttgatgggcggcggcagaggcatgtagctagctagggtttcaacaatgaagtccatccaagactatcttgctcgctccaactccaagtccaaggtccctcctcctctccgcccctacacattctgaattctcgcgcctccctgtattcattctagttcgatacagctagtagaaaattcatcagctttgctcaattgctcaataagattataagaaaatttatgtttctccttccttttagactaggcgtaatatacatatatgatcagtcccttaactcttgaaaccgggtaaaaacatgtacctccaacctgtttaacaggggttttacccaaactggagatgggacctgcttgatcatcgtttgtcgtgtgggcccaccatttatcctcaatgacaagtggacctcacctcctatgctgctcaaaaccatgtcaaacggggacaagatttatcctgttttgagagtgtgagctatgagttgtatctagtttttcaattaagggatgactagaaaaaatgcccgtgcgttgcaacgggaaaagactattttaatcttattattattatatgttttaagtcaggtgaaattcactgtagaaattcgcttgaatatatgtattttacaaaaatcatgagctgtagttaggagtccaaccgtgtaagttagcatgcgatttttttaaaaaaaaggatttcttatacgactccttctgtatttccaaaagcgaacgaacttaaaaacctattcaaatacgaatatgtatttccaaaagcaaacgaacttaaaaaccgactcatacacggatgacgtaccaaagtaccgcaaaaacatcttgaatttttataatagtagagatagagatgagaaattagcccaagtgaaaaagaaaatccagggagaattatcatctttctactgccatttgtttctcactacccctgttgcctgttctactttgcagaattcagagttggttatgaaagatgacatccctctgggtcttggagctgccaaaaactcaactgctgctcctgattccagtcatgctgttgaagaagaatatgttagtaagagaaagctgacatcgagtgtgtggaaagaattcaagaggaagaaaatcgacagcaagtggaaagccgagtgcctatggtgccataagaggctcggaggggacactaagaatggcaccaaacatttgcacgatcatctcagcaaatgtcctcgtcgcaggagtaataaagtcagcaagccaactccctccaaatgtacaaaggatattgatcaggaacccactgttgcttctttagaaagctccacctttagccaggatgttgccaggatggagcttgcgagaatgattatcttgcatgaatatcctttgtctattatggagcattacggtttccaaaggtttgttagggctcttcaaccattgttccagctggttcccaacagtagtcttaagaaggatgttatcagcatttatgagacggagagggtcagaaccagggaaattttgtgggaggctaaaggtcggattgcaataacagcagatatatggacatcagatgatcaaaatagaggttatgtggctgtcagagctcattttatcgaccaatcctggacattccagtgccgtctactgaggtgtgttcctttttcattatttttcgagcgcatagatgtgtgtatgtatattttcaaatatagttgcagttttctcggtccaaagttctattcagactattttaatgtaaaaacttattgtgctttgattgccacatgcagctttatacatgtgccatggccgcatacagctcaagcaatttctgaaactctgtcttcttgtttgaacgaatggaatcttggaaggagggtatcaatggtgatggctgatgattgttctacagatgatacggttacggggctcttaaagcaaaggctggataccgaacaacttttgttaggtgggtctttgctgaacatgagatgctgcgcctatgtgctaagtagaattgccaatagttgcctgggtgtgatgggaggtgctgttgataggatccgcgccagtgttgatttctggacagcaacaactgaaagagatgtagtgtttgctgatgttgctcgtggtttgaatgttaatctcgacaagaagttgactcttgattgtaataatagatggtactctaccttatccatgttaaatgttgccataagctacaagcaagtctttgatcacttaaggcaaatagaggaacagtatatttgtgctcctgatgatgatgactggaaattagcaaaagaggtctgcagtaagttgaaactgttttctgacattgcagaactaatttcagaggctaagtatgttactgctaatatgtacttccccaagatttgtggaattcggatggccatgaggagatggcctgggtgtgaggatgaactgataggaaggatgagaaatgaaatagccgaattgtttgagaaatattgcgttgaagttcatgatctcatggctgtggcaactgtcctagaccccagatataagcttgagctactgcagttttatttcccctcaatttttggtgatgaggcatacaatgagataaatagagtccggcagctctgttatgatttgatcaaacagtatcagggtccccaatcaaaagtcggtgcaatgcagccttgtgggggggaggaagagggtccagatcagttatctagcttcgatctatatatcgctttcaagttctccagtgcagatgtcaagtcagaactagacaaatacttggacgagcctgttatccctagagcagtagactttgacataatagattggtggaagattatggggaagaggtttccaactctgcagatgttagcaagagacattttagcggttcctgtctcaagggtagtttctgaatcggcgtttagcattgctggaagggttttgagtccacagcgtagcaagcttttacctgatacactggaggccttgatgtgctcacaagattggcttcatgcagaaaacagaggtgtttgccttgtgttattgtcattgtctagtaatgttgatttcatccagtgaaaggggtgagaatgctgattgcctggttgtctggaacatgcaggtgcaggatcgtcagggctcttgagctgcctcacttgcctggaagatgctgatgtaactacaaaggtacgtgtggtgaaattcgcctctatagagtcttgtcgaacacaagagatatgagttgtgttaatgagtgttatatattgtttgggaattttgccgtatgcaggagtgaagtttggacgcctgttgattgtttgctacaaatatatgctgaagttgatctcgcacattcaccagctgaattaaagcgctgagatctgggttagctttttttttggtttatctcaagagtattgtgggtaaggaaggtggtgtgtatgttggaactgtgaggagtctactaaaatgaagaaagcattcagttgatcattcttttcaggaaagattagttgcaaaattctgtgcgtaagcttgctgttgtaactgatgggcgttattgtgttgatggatgggagattaggggtagttggatgtgctgtttaatttaggtgctggtattaattaagtaggcagtatgtggttagaactctgcagttaagatgaggtagtatcctgactgttggtaactccactagaaatgagagtggattggaggggttaaattaattttgttttgtgtggattggtttgaggaaggattggaagctctggtggtgtgtatagttagttagcgtcagagtttggtaagcaccgtacaagcagtttggaggagaattggagaaagaagaataacatagagcgaagagaatatgtgtgtgtgtgtttggctttgcctgcagtgggagggtgcgtgcgtgaaacggtgacccagacacacaagcaaacacttgttacttgaggccggttaaattacttgaccagcagtttgctggctaatacatagtactagtagtagtatattggtggtgtatgcagatgcagtttttttttttttgggtgagatgagagctatgcagaggcagtaggcgtgcgtaattcatcttgctcctaattcccttccaaatgcaattgcgcttgatgcatgcatgctggcgattccttgcacatatctgcatgcacgtagacgcacgcttaggcttgttagtttttaggttgcttgtgaaataaacatggaataatcttgtgcataaaatgcaggcatgcacgctagctatatcttagctgcagctgaagaagaaatgagctatagtagaataagcttaagatttacctttttctttcaggcaggcaggcaggcagggcggctgggtttgttgcttgcttgcactgttggaagatccatcatcgatctttgttaatttgttggtaaggctagccaatatatatggatgaatcgtccccatacatttatcatcgatgagcgcggggcgggaaactaacaaattaacgatcgactctgtgtctgtgatcttatagggtagggtaggcgagaggaggcggatagatagctagagtatatgaataatatgaggacgacgatgcggcggccggagatggtgttcttcgacgtggagacgacggcggcgtcggcggatgaggggcagcgtagtgtgctggagttcggggccatcgtggtgtgcccccggaggctggtggaggtggacagctaccacacggtgatccggccgggcgacatgtcggcggtgtccaagaggttcgccgctatggtggatgtggacgtggcgtcggcgccgagcttcgatcaggtggcggagcgcatcttcggcgtgctggacgggcgggtgtgggcggggcacaacatccagcgcttcgactgccaccgcatccgcgaggcgttcgcggccatcgggcgggcagcgccggagcccgtggccatcgtcgactccctcaacgtgctggcccacgactttgggcgccgcgccggcgacctcaagatggccaccctcgcctcctacttcggcatcggcaagcagagccacaggagccttgacgacgcccgcatgaacctggaggtgctcaagcgctgcgccaccctcctgctgctcgagtccacccttcccccgggcatgctgcactcctccgccgccggatccatcaccaggaagaggagcaaccaccaagaggagccatcgtcgtcgtctcttgtcaatgtgacgcctagtaaaaggaagcagcggcagggcagcggcggcaaaatcaggcccaaggcagcaaccaccacgcccaagccatgcttccacatgatcctcaggcactccaggaccatcctcagatagccctttgctttgctgctaactcactcactctttcattgctccatccattggggtttagttcattcttcttcgtcaattgtattctatatatgtctgtaattctctactgtatatacacttcctccctccctctgtacaagtcttgtcttgtctaattgtaaacaatacatccattaacttcaagttgcaaacattctttctgaagcctcctggctgagctgatttggccttccttttgtctccccagtcacaaattcagtagggcttagccagcctcaacaataccagttacatcaacacacggtgccaatcgtcaggcacaacaacacacactaaatcttaaatttggcctacacctaaggcaaccatatatatgcatgccaacaccaacatgactctgcctgatcacacaacactcagtatgcatgccaattgaattggatgaaatgaaccaacaaactcttgccctttttacaacttattcatctcgttgcacatatagctcagcaacagtacaacatttcagtaagctagatggattcacaggtgaccttccctttttacaacaccagtacacaggctcatatcattcacaaacacacaattgatggaactgggcacgagcagactaatgaggatttttcacattaattgatcgattgattgcatcttacatgccagtacactacagtatttacagactgaccgacacatatttacagactgaccgacaccatggacctggatgttactaccttttgtacacacacaagatgatatagctacagacgggagacttcatttatgtacatccgaaagctctctgcgattgtgcagtttcaaaagccacaatcagaagggcaatgccaactcaactcgacaaaaagaagcccaaaataaactaatttatgccctcctcagcacacggaaaatttacaagttttggtggcaggatagcgttagggtcaatgagaatgctcaggcaaaggtgactgcacagtggggctccttgttcccacaagcaaaaccttcaattctaacttttgggctgcttgccccgcaagatggagaacctacttcagctcttccagcagactttttgccgaaagaactccctaaaggagaaaaggaaggtatgtttttaccaaactgtggatcatggacaatggggttgttagcgcgcacaggaggtgagccacagaaaaagcccacctgggtgctcgaatcagtatcaacatcagggtcattctgaaacaaaacgagacaattggagaattataaattcagaatatgtatggaggcagcatagatagctagcgtaaattgacagtttacagacagccgcaagaagctacaggtaaagcaccttactgaggatgaggtcgaggacatcagaagcagagtcagctctgtacaccggtaatgtcctgcaaataattaaaaagcgcgcacaggtcagcaataaccctaagtcattatgtgaaacgtatattttgtcgtcacatgtgaaccgtgtgatgcccattgctgaatttgtcgctacatgctcgctgtcgttactagagcctaggcactattgtgcgcatatagtagaataatatttcgcatgaaagaatcttttgacaattattgaattgaattaaaattatgggcagtgttgtggtatggttattggtaccatatgtgcataaattttggtgagcctcagctcctttgttggaaggaatgcattgcatccaagtgtacagcctggagtagatatgtgctaaattaaattgcagctaaaaaaaggagacccatgctcaatatggtttgattagggtttgggggtggacctgttgatggagtcggataggaaaggagggcggggtgacgggcggcgaggcatgggacagatgagctcggtgggttgggaatccatctgccaaaatcttgaccttcggtcgggcatggggtctactagtctccctcctccattgctgaacttggtcgagtagtgttccatgcctctcgctctcttgagtgtagtgtgtagcagagacctgaaacaagagaagaggaaggcgcatgatgatttcacaactcaatctttgattcactacccgataatataaactaatactagtgggcggtagtaaacagcatcgaaattattgtagtggagtagtataaagaaattggaaatcgcatgtataagggcgttgggttattaggtaaaaaaaatactgaaataataataaaaaaataaacaaaggaggatagcggcggatctcatcagagcggacctgaagccccaatttttttttgggaagaaactagtgtcgttagtggtagaacataagagtggagaaggttattagggcaaaataagttgcagatctggaagagaagatagggttaggggggcgcaaaagagaggagatgtagggacggggtggggcggggtggggtgagtgctcaccggtgggcgaggatgcggaggcacaaggacggcgacggcgagcggaggatggacggagatagatcggcgaaggaagtttcaggcgagggggatggacggggtagctagggcctaggggatggatggtcttggcgcgggcatacctgctgctggctgctgcttcttcgtcttcctcttcctcttccaccgccgccggcacaccaccactgcgaccgcgatgcggatgcgaaccggaaacaaaaacaaaaaaatagaaaataatttctccgtcgctgtttgtttgttgggttgggacttgggaggagaggagagacccccgccccggcatttattaggggtgggccccctgtctgtatgacgcgtgggaccatgccccacacgtcagaccccccatcccatctcatctcatcccccacaagccaagcagcctccgttcggagtccgtgtaagacaccgtctctcatctccacttcagtccggttctgtcttgccccaaatccaaccatctctctctctcagcttttgcacaaacaaacgtgcttaaccaccacacgattcatcctccttacgttacgctcattttattagatcagatcggagaaagtttatcaaatacttttacaacagttctgctaagattaaaaaaaaggcaccatttacaccatcgttttatcattccttatatccgttgtgatcgaattctatattggttgcctctaaaatatcaacggtaaagattaccacttctatcatttaattctaatctaattgttggtctctagaagagatacatcaatcaaaaccatgtttgttatcctatctcattatcgggctcaagagatatatcatgctactattagtctctgtacaaaagagtatatcaataagagtgacactaattaatgtcctcgaggtatataagatgcgtcatagtcactccttgaagagagacgtctaacgtgagcaacacctctgactaaggagataggatgtgtttccatcagccttataaaaattgatgatagaaacaaggatacattgaaatgagacgacgatgaaagtagacgtccgtctctaaggctagggtttcataaacaaagcctaacccaaatacatttcagatattcacatcttataaccataagttttatcaaatttactctacacccctacgtgttattggaatatttgtattgattttttatatctattgtcttgctgcagccttaccttctctatataattgaattgaagttttttaaaaaaaatggaacataggatgggaatattatagaagataaaataccacaagcacaacatgtttgatttggcatgacaacaatggcatgtcgttttgttccaaactatattattttcttcctaagacgcaagcgcttttgtcttgatgtcaatagtaccctccgtatcggtaccgttacgaatatatccaacatggatactgtcatcaatcccatttcattagtctaaaacgtgaaaaaaaagcatgtgattcaagtaagatgtctttctaaaagcaacttagcttgtgtaaaatcggggcatgctagatatactataaaaggatagttttgggataatacgcaaacgtattgttataaagagaccaatagaggtaagtgaaatggtatccaaagagtcagtgtgcatggacgaggcgttattagaggcatggatctaatatcgtgaattacgactgtttggagtgattccgccgccacattgtccctcccccttttcatctccgcgcgttcttgctagagataaggatgaagggagcctgtccctcctttggttgtatataaatacaccccctcccccccaagcataaggaactcatgactcgactgtctggagcgactccgccgccacctcgtcccctccctttcatctccacgcgttctcactggagataaggatgaagggagcctatccctcgtttggttgtatataaatacaccctctcccccccccgagcataaggaactcatgactcgattgtctagagcgactccgccgccacctcatcccctcccctcctttcatctccatgcgttctcgctggagataaggatgaatggagcatgcctctcatttggttgtatatgaatacatcctctcccccagcagaagaactcacgactcgtctggagtgactccgccgctacctcatcggcccctcccctattttcatctcctcgcgtcctcattggagacaaggagggatgaagatgtcccccatctggttgcatataaatgcatccgccctacccaaacagaaggaactcacaactcgactgttaggagtgactccgccgccacctcgtcccctcccctccatgtcatctccgtgcgttatcgccggagataaggaggaagagaacaagttcctcgttcgtcttcggtaggttttcaataaatcttgtacgaggttagatcgattagatgttgatgggactttggcttctctaaagtcttttgctttttatccctttggtggtgggtattccattcgtaaggctatatatggaaaatttgggaagacttctctattaggtcgtcgataattatatttgcggtgttgacttaggaccttggtttccgatttattcgataacatcgggtcaatgttgtatgggaagaataaaaatgttgacgggtgtttgttcatatgttttttgctgtgttgagattggttagctaccatgacagtggctgtatgcatgtttatcttgtgtcgttcaaagatgtagagcctcttatgctatattttgattgtttctatattttaaaagcaaagtttataaccatgggccagaaaaaggaaaactatatattggtttatatggtccggtttagcttttgttaaaagaagactttagaaaacgtgagggtgagggatattctttttaggtgtaaagggcggtttaatctattattataaaaaaatgtgaggagttgatggatggatgtttgtttgcggaagttgtgacagagaggagagagagagagggggggtggagtagtgttgtgacggtgggtcacgccgctgaagggggaaagacgtgggtggtggggtgtggacaactggcaaatggagagactagagaggaaggtggggggcatattggtcatttcaacctgccgcgcgttttccttccttcctttcttgcttgtttgatttccccttccttcccaatttccatcggcgggcgcgggagcgggcgggtgcgggggcgcgcgcgcttctcccagttcccatccaaaaaaagaagggatccttttcatttcattttggtagcgtggcgtggcgtgtggggtccggttggcagtgagtgcggggcgggggacgcgttcacaccaagccacggcagctgacgcgtggggtccatcatcgtctccctccggcgatccacagatagatagagacgcctgggctggggctggggggctacaaatagcaaggacgagtgaagaggaggagaccaccccactccgctgtcgggttgggttttgagatcgaaaatttttgagatttcaaaacctcctccattccctcccttcctcgcccccaaaaaccctagccgccgccgccgccatgcctgatctcccctgcgacggcgatggcgtctgcatggtctgccgcgtcgcctcccctcccgaggtcgatctcctccgttgctccacctgcgccaccccgtggcactccccctgcctctccaagccccccgcccttgccgacgccgcccaatggagttgccccgactgctccggggactccaccgacgccccgcccccggccccggcaccgctcgcccctgggagtgccggccaactcgtcgccgccatccgcgccatcgagtgcgacgccaccctctccgaccaggaaaaggcacgccgccgccaggagcttctcggcggcgccgcgcccgccggtgccgacgccgatgatgacgagggggacgacgtcctcgaggtcatcggcaagaacttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacattagagttgtatcatccctgattatccgtcaatcttattttgagttgacgctgccatttattcttttctgttggttcaatttgcatttcctgttatcgtttaaggtttctaactagttgaaatgaccatgtaccatttctacatgatattgtttgcttttgctactcatttcttatatttcttatttacgctaccatttgaattccaataacggaacaagtcttctaaaaaggcacccacataacctgcttaggtgctaggcttacatcctcccaccagaccactcttaactgattatcatgaaccagatcatcgatgttacgcacctcgtagagtgatgcttacatttctttatttctattaattgagactgcaatgcttgttacaattcaagtttaacttgttgaacacatcgattgcatgccctttctagatgataattgtttgctttggtaatgccaactggtatgtcactcctaattttcaccacatgcacacatttactatgcctagatatgtttgttttagctcataccaaatccaccgtacaattctgataatgcaaacagtattctaaaaaggcaatccacgtaacctgcctaggctctaggattaggcttacaccgtcctgccttgccagcctagctcattacatcacccaagcggctgcctaatcagtcactagacatttgtatgtggtacagctagcttctattgccatcacatgcttgttcttctggattgatgcaataccttgcattgttaaaagtgctgtcttgttcttttggggtattggtttaaccttccagtttctgcacataattcttattttgatccatgcattgtaggtaggtaaaagttcttgctattctgtcaattcattggacccttttttttttgggtagcgtttctaaccatcagattctacttttgtcttgggcagacaccatgtggccataacttttgcttgaagtgcttccagaaatggatccacagcggaaaaaggacatgtggtaaatgccgggcacaaataccagcaaaaatggcagagcagccaagaatcaactcagcattagtttctgttatccgtatggctaaggtttcaaagaatgccaactcagctgtctctgcagctgcgtatcattacatacgaaatgatgatagacctgacaaggcttttacaactgaaagggctaagagggctggaaaagctaatgcttcaagtggccagatctttgttactatcccacccgaccattttggccccattcttgcagagaatgaccccaagagaagcattggtgttctagttggggatacatgggaagacagacttgagtgcaggcaatggggtgcccattttcctcacgtggctggtattgctggccaatccacacatggtgctcagtcggtagccctctcgggtgggtatgtcgatgatgaggaccatggggaatggtttctatatactggaaggttagcaaacttgaccatttgccatcattcagtttttctcagtgatctctgatatgagcaattgctaatacactctataatataatttatacttgtacagtggtggaagagatctaagtgggaacaagcgtacaaacaaggagcagtcctcagaccagaaatttgagaagctgaatgctgctcttcgtattagttgcctcaagggttaccctgtcagggttgtgcggtatgttctttctgccatgattacacttagcagtttaatcttaaggagataatgttatgcctgagtaaattgtcatacctttgtaatctgtgcctttccattattattataattggtaaaatcttgctgtagaaagataattctgatctgccgctgttatagttatgtagatatttgttggctcttgaaacagataatttttgtaggactactactgtcgctctatggagtactactgtttagtgtatatatttgttctcttttgtttgtctgtctgttattgatgatccaaatatatatccttttcactattcaaatgatttatagtttgtcatgcccccctaactcattacattcccttaaaaaaaggtcccacaaagagaagcgttcttcatatgctcctgaagctggtgtgaggtatgatggagtttacaggattgaaaaatgttggaggaagattagtgttcaggtaacgccattctcttgtacacagctttgtgaatgttgctttgtagttttgtgctctgcagttcatcagttgataattctttttattggaaacataatggatattttgctgtcttgtctcttagggtaaattcaaggtttgcaggtatctctttgtacgttgtgacaatgaaccagctccttggactaggttcgttgaaatgcttacttttgacttgagacatgcatattgttcattattcatttgagcaacacattttgttcatactgacattatgttatttggttttaagtgatatttatggtgaccgtccgaggccactccccaaagttgatgagctgaaaggtgcaacagacatatcagagaggaaaggaactccttcatgggactttgatgtatgtgcctgtttctatgtgatgcaatatcatcatataatgctttattttggctccatgtcaccatactatgctaccgctaacctctgatttctattggttcataacaggagaaagaaggctggaagtgggtgaagcctccaccaatcagcagaaagcctaacctatcaggggatcctgcaactgacaaggaaatccggagggttgcaaggcgtgcccagatgtctgtgactgaaaggctgctgaaaggttctttctgttgcatgcttgttatttagatatgtactattacaacttgtgttcgtagcttcgaagcactaaattgctcactctatattggtttatgtttcctgcagagtttggatgttccatttgcaagcaagtgatgaaggaaccactcactactccatgtgctcataacttctgcaagttgtgtttggttgggacatatggtagtcaatcgtctatgagggagagaagccggggtgggcggactctaagggcacagaagattgtgaagaagtgcccttcatgtccaactgatatttgtgacttcctagagaatccacaggtacaacaagtttatgtttgttgaagcatgctattacatgtaattttcttgctcatgcttggctttgtttgcttctttcagatcaatcgagagatgatggatttgattgagtccttgcaaagaaaggctgttgaagaaggagataccaagacaagctcagatgttagcaatggtgctgagtcatctggagatgatggaaacaacgaagctttagagaagggagaggatgatagcagcttgaaggatgatggcagcttgaaggatgatggcaaagtggtcaaggctgtggttgtaatcaaggaagaggacctgcagcctaagaagagcaaaggagaagatgagaaagaacaaggtgacaagaagatggacagtgctgatgtggtggacattgcagttgaaaagaaacagcgacgaagcgggcttctgagaaggctgagaagaagcaggcaaggaagcgcaagggggatgctgttgccacaaatgatggtaaaaggatgaaaacaggtggtgatgctatggagacagcagcggaagaggatgctcccctgagcggcggaactcctgtgaagcgcaacagcaggaagagtagtgaggttgatgccaaaggcggtggcggtagtcctgttgtgagcagccctcgcagggtgacgaggagcaatgccaaggctagcggtgaagctgatggtagccctgcgacaaggaccaggagggctacccgcgctgaagcctgaatgaagatggatgaatggctggttggctggctgtagaggggaagaagacggagactggagccattttggggtcgtattcgtatattctatctatttagtaatttaggccgtttgccttgtgctgttgctctagctcttttgatccacaaggggtgaactggaactgccgcggtgtgcttttgggatggcttgggttgggttgttagttgaaggaatatatacttatatacagtggttgctttacctttacctgtatggatgtatgatggatgttcctcatacaactttccaattccaattactggcatggtttgccttggattctcatgctactccttttcctagcactatcattgtttgccttgtttcttgctgcaatgtcttgtaaaccatctcatctaatctgctgcttagagctcctatatgttagctcttaaatttgccacataagattaagggatgggatgaggtgaatgagagaagttaggagagaatgagcattg

SEQ ID NO: 21425 - DNA, 664 bp, Oryza sativa
ggccccggcaccgctcgcccgtgggagtgccgagccaacttgtcgccgccatccgcgccatagagtgcgacgccaccctctccgaccaggaaaaggcacgccgccgccaggagcttctcggcggcgccgcgcccgccggtgccgacgccgatgatgacgagggggacgacgtcctcgaggtcattttccgcccgggggggggcccccaaaaaaggaaactttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacatagagttgtatcatccctgaaaaaatttttaaaaatttcccccccccgggtttccaaaatctatatttttgaggttgacgctgccatttattcttttctgttggttcaatttgcatttcctgttatcgtttaaggtttctaactagttgaaatgaccatgtaccatttctacatgatattgtttgcttttgctactcatttcttatatttcttatttacgctaccatttgaattccaataacggaacaagtcttct

SEQ ID NO: 21426 - DNA, 990 bp, Oryza sativa
aattttcatcttaatttcaaaagcaaaggttaagtagttatgatttcattcagatgaagcaacacagacccgtcgatcaccacgaatgcgtcataaaagggggggattaatgaaatggaacccaccatatatatatatatatatatatatatatatatatatatatatatatatatatatataaaggacaaaaatatatggatgatgaatactatgttttgcactggtatgaaaatgtccatgcattattgattgaggtactgcttttgaatggcagcagcatatccaggtcactccatcgattgtatttggtcatctcctcctcctggaccagcttcaacttaacttgatagctcaatccatatgttccagacatacttgtggcttttggtttcgtatccgaccttgatcggcttctttttctttttcaacgcacaaaagtaaagaaaagaaaaaaaaatttgtttgatctgtatatcctgttgcgctgcaattttggtccggccatagaaagaaaaggctgaaagcgagacatgaaacacaagcacttactagagccacaagcttgagattggttgtaatagttccctctatctaatccgtccaagcatcaaaaagggaggagctcctgctgctgcagctagctagatagcaccatcgaacagtctgtgctcctctctattactagcaactaattagcacacgcaattactacgcaattagcagtagtgctctcttcaaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacag

SEQ ID NO: 21427 - DNA, 8169 bp, Oryza sativa
ttttatatgaaaattgttctaaaatatcagattaatccatttttaagtttataataattaaaacttaattaatcacacgttattatcctctcattttacgtgaaacacttaatctttaatctttaggagattcaaacaccaccaaattcatcggttatttcctcatcagctgcaagcctgcaatgtagtacttaggtagcatcagctagttctttctacctagtgcagtgcccagtataaggccaaaaccagaggatgtacaaagagcaactgaggggtaaagttttacgtgtcacatcaggaattatataggatgtcgcatggggtgtttggacactaataaaaaaactaattacagaatccatcaataaaccacgagacgaattattaagcttatttaatccatcattagcaaatgtttactatagcaccacattgtcaaatcatagagcaattagtcgcaatctgtgcaattagctattttttaacatatatttaatacttcatgtttgtgttcaaacgtttgatgtgataggatgaattttagggtgagatgtaaacagggccttagtaaatactccctccgtcccaaaaaaaaaaaaggcaaaccctgagtttccgtgtccaactttgactgtccgtcttatatgatttttttttataatttgtattttcattgttgttagatgataaaacatgattaatattttatgcgtgacttgtctttttaatttttttcataattttttcaaataagacggacggtcaaactttgagcacggaaaccagggtttgttttttttaggacagagagagtatgcagcaacaaaaggtattgggaaaggagtaactttagtctgcgtatgcacgaaaagacagacatttgatctttcatgaaccacaacattatttcctgaccctcgacaggtaagaacgttttattccagccgaacaatagaggattcttctcaacttagaaatcttggcctcaactcagcatgatctctgactgcgcggagaacatgcgataagttcacagcttactatgaaaccaaaaacagcaaagtctccgggggaagaagattagccctctggcacctattagaccactggaagctccccacactcactgatgaccaccttcttcttcgggcggtcccctctgtcagtctcctgcgattcgatcatcttaacgatgtccatgccttcaataacctgcccaaacacgacgtgcctcccatccaaccaaggtgtctgcattcgcaggtagcagtcagcgcaatgtaattttgagtgagtttcgacactagtacacagtgaacatatcagtacagtgttaccttgacagtgcagatgaagaactggctgccattggtgtttggcccagcattggccatgctgaccactccaggtccagtatgaaccactacaaacattacaagacatataatcagcacaaccacaagataagaagcagaaagaacgatcagattaggtcatttgtcagacgtacatttgaagttctcgtctttgaaggtccggccatatatgcttttccctccagtaccctgaaatattcattttttgaaacctactttatccacatgcagaagttgaaagctgaatgatttgatgtaggctaggtcaaaaattcataattcatgaaaccaggcagctgcatgatttaatttaggccatcaatttaaagaaaaaggatttggtgctaatctccttgtaatctagccatgaagtcaataatcactgcatacacattatgctgatcacaaactaccaattcatactcataatgtacatgatgcaaagcagtataatgatctaaaacaccatagggcaagcactgaagtgcataacacaaagttgtataatgatccaaaacacatatataggtcagctttctatccaaaacagcataaagcgctaacattgataaaacaaatcaaacttttttttttttggagaaatagttggctcaatggtgatagatagaaacaaacacatgagctcattcagtgttgtgagtaatgttacactatgtgactttttccaatagagtttgtcagatgaaacagaggaacaagtgcaacataggagtagattataaagaaagtaaataatgaagacatacgttgcccttgtcaaagtctcctccctgaatcatgaagtccttaatgacacggtggaaactggaccccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttagcaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaacatgaaagcgcatagtgcacatgggaaaggaaaacccagctttcagtagtacagaagggcacacgtgtttcctcacaatgttgcaggcagtcactgatgatgaataacgtgtttacattcggtgcacatacaaggtaagacctgtaagtagcagaaccctatggtcgaggcaactaaaattattaatcagagcaggtgaatacataataaagcattggtgatgataagcctgaaactgcaattttggtagcataaatttcacctggtgatttaaaaatctgataacaaaatttgacatacaaaggcattactagtattagttttaatttaatggtgttggaaggtcgaggtcatctgtgctaacccaatatctcttcctccaaagaggcaacaaacaggggccggtattgcggaggctgattgcataataatagtccagtaaggtggagtagtaaatttgactgatatactactagacaggattacaagaatggatgcggtgcggcaatagaaagatatatgtagggcagataaaagaagaagatccggggacacagtaccttggggtcagcggtggcggaggagacgaagcgcgcgcggctgtgagcagcggaaagcgcaggagtgaaacctccaaagacggccgatgaggggaggcgtgcggtgccggtgccggtgcggatggagaggagcggcgagggggttttggaggcgaggagggcccgctccgccgccggccgcgcgatggcctgcagtgcaaacacaagagaagaaagagcgacgataataagattgagagctcggtggggaagaagaggagagcagaggccatggatgagtgagcttacgagtgtggcgaaggaggttgcgaccgccattgttgatgttgaggaggagaccctttctctctctctcgctcaggtggattgggattggataggtagatagggcattgcactgggatgaatggatggcatttttgcatatgtgtgcacaggaaatacaataatcacacacaccttcttcattgggggaagtactatattttatttttgggaccaaaagcatctgttaaatcaactctatttgtcccaatccaactatttaaaatttatttatttacagtgtctctttctataatatatcggtaagttatcaattattatacaatataccatcggactatactattttcaaaaatacctaaaatacaccatataaggttaatatttgatttatcctaccataagtttcagaagaaaaaaaatgctagtttatgcactagttttaagattttacatttttatatttttttaaaaaaaattatttatccattatatactgcaagaattttttttttgctgtttttaatgtaacttttttcgagaacatacctcatttctaatgtaaattatcttttgcgtaagtaatttctctctcataaaaaactcaaaaatattttttttaaaaaagtgaaaacttgaaatttatatataaactttcatgttgggtaagtaagctacataaacaattcatatttttaaacccttagatgaataaattaattgttaaccttatatgtattttgagtattttttaaaactaggacctgagtaaatatttttcttgagttttaggttataagacttcacattcatatatgtctagatctattaacacatatataaatatggacaatgctaaaaaataagaataggaggtggtattattttttttttggtagagaggggagggggccgcataggaggcaggaggtagtaaaatgggctgatgggcatagtattcacgggggcccatgtaatagatgggatgggcttgaacacacatgtaatgtaacaatagcctcggtcgaggtgaggtggaagaagcaaagcaatctccgtgagcggtgatggcgcagcagtggcgatctctcctcttcctcctcctcctcctcctcgtgcccttcgccgccgccgccgggcaggatgcgccgttcgtggtagcacagaagaaggttgcgctgtcccgcccgggtccaggcgtggagcgcctcgccgtcaccctcaacctctacaaccagggttccgcgtcagtcccctccccatctcatctccctcttcccccagatttagatccacatctctctctccctctcttcactttgttaacctattattgctctatccgcctttccttattgattaattcgcataggtcaaaaacaacgggaattcctactgttagctagacttgatagatagccgcgagcccatgtttccctttctctgtgtaataatgtcaagctgactcacttgttgataacacaaattatcacgctactattgtgcatatatactactcctacatgacatgacatgattgatagtcacatacacacacatcaatcgctaatccatttctccatctatctaaccacactgctattttagggaaggggaaccggaatcctcattatgggggtgtttacatccagggttgtaaagttttggcgtttccgggtattatatagggtgtcgcattgggtgttcggcactaataaaaaaactaattacagtaaaccgcgagacgaatttattaagcctaattaatccatcattaccatatgtttactgtagcaccacattgtcaaatcttagagcaattaggcttaaaagatttcgtctcgcaaagtagtcgcaatctgtgcaattggttatttttttagcctatatttaatacttcatacaggtgttcaaacgttcgatgtgatagggtgtaaaattttagggtgggatctaaacaggccctatattcttcactgccagtgccatcaaccattcatcttctattcttctatcatgttgtttactactctctctctctctctctctcatttttacaggaccgcctatgatgttagcttgaacgacgactcttggccacaggaggcttttcaacttatctctggaaccacatcaaagattgtggaaaaacttgatccgttagtaacaacacttactagttacttatgctttctcacaccaatatttgccctttgacaatcctttttacctcttgtgctttcagtggtgctactgcttcccacaacttcatcttggagaccaaagtgcagggcaagtttcagggctctcctgccattatcacataccgtgttcccacaaaggccgcacttcaggtacatcaaaattttcatacttacacttcaggtactcatgcaatttgatgcttgtcatatgctttgtttcacaagttaaacttgaattttcgtttcgtgatgctttgtttcacatgccatcacaatcgagtgagtatacctttagtattgagcaccggatgagccttttctaaggactgcagtgtgatcgatctcattattccatggatcatagtgaaaggggctaactttgctcagcttaaatagctcattacgaccctagtacttggtgttctaattatcattttcaccatactattcctgcactattctcttcttgagtttaaactgccaattatttttctcaaggaggcttactcaacgcccatgtttccacttgatattcttgctgagagacctccccaacagaagtttgaattggttagttatctcataccatttgctttcattaagagtaaaacctttcctgattcttatgtctcaacgccttacttttttggtgctggtactcaacttatggatatgcaacttttgcacttgacctttccaggctaaggtactgccattgccctctgttttatgtaaacttatgtgttttatctaagtaggaaataggcgataagaaaagaaaaccatatggctagacattgtgatctaatgtgttaacaaacgtcatctgcagagacttgtggggaaatatgggtcgctggtctccgttgtttcctttgtcggtgtgtttatctacctggttgcaagcccgtcaaaatccactgctgcaaaaggaagcaagaagaggcgctaaatctgttttgttgccttttttttgttgtatttggttttacaagaatgtactctctcaggttttataaggttctcctatgtactctaagggattaactagactaaggcatcatctgtcattttggccttctgtagttgagcatctcgggtgaggcctgagctgactgacttaaaatcagaggtgtagatttgatacatcttaaatcattttagtacattcaaccttttgtgcctggttctcatttcatctcccgtcatgggtcaagggtaagagtgttgtctattgtgattcggatagggcttgaacctagcttcaagcgatgttctcggggagattttgtttgattgctactgtaagcggtaagataatagtgtatgatatggtaagcttagccgtttcttttttttccctgaggagcaggtgaattgtacaaggagcagatgatggattgagaggcgaattcacagggtaatatgtttccctgtctcctgaattgctagttcagatcctattctacgatgtactgcggaaagggaccacatgatgcatgttattgaaaattgacactggtgcatcttgtgttctgcatatctgagccttgatggaaagaaattataattctttgagttagaactaaactgaggtatgaatggctttttttttttggtttttcacggtggggcagcgctcaggtgtgtgttggggggaggagcaaggggatgtaaggaggactctgtttttacaaccgtagagataagtactggtaagtatgaatcaatcatcgtcctatttgtgtgctaaagcttggaaagacaagatgatgcagatgcagtacaaaccgcttactactccaaataacatgatgctggggcaggagccttgtggaagttggcccacccaattaactgcacagaattctagcctatctgcccactatcagtcacataggagtaaatataagcagcagctaggggggctaaagaaggaagaaaagcagatagagacctgaatcctcaactcaactgcaaacaactctttcttacacatagcacatactaggcacataggagttactagagatactactaggagtagtagcaatagagcatcaacataggaggcagcataccaatggagagcttgtgtgggcagcttgagcatgaacatgagcagcagctgcaccaatcctcctcatcttcacttctcccctactgtttcctttctgctccagagcctcttcttgtcccaggcttccctgccggctgcagcaaccttgaagagaagccagcagcagccatggcggcttatgagtatgagagcagcagctgcagctccttgaccccacctcaatgccaatggtgtactcaccaatagtgctgcagccacaggagtgccctctttcctttgtctttgacaatgccgctgccgctgccggcgacaacaaatgggtgcctggcattcaaggaagttgcccttgttcattggg

SEQ ID NO: 21428 - DNA, 1159 bp, Oryza sativa
tgtccatgaagcttgcctcccttagccctttgatgtatgagtttggaccgggcattgatatgcacccagatgttcttcgacaggtaaagtaaaatagggaacaatgacagcatcaatccaaacgcaagcaagcatctctgaagaatctgtgattcagttttcttctgccatgcatgcgatcatatctctgactctcttagtacttagtataccttctttgtttgattaagcttgcaaagatgccacatgagatggtgcagtgcatgggccaaatggggagtacaggcatttcactccaaggactaggaggaggacccacaggctttgctcaggtcaagatgataaccatagtctctctgaatctgaactcaatctgcatgactgcatcagatgtgatgtcgcttctcctgtgttgaacacaaattattccaccaagcactcatcaagagtagtaggagtagcagataaggaaggcaatgtgacactgatcatgcatgcgctgtctgtgcttcacctttgcattgcaggatggcagcagccacattaacatggtggtgatgcaagttggagagcaaggccagcagcagggctctcttcaccaggtcgagatgagcagccactgcttctttcattagtagtagaacccatgcatattctggtaattgagatacaagcatgattgattagcaagaagcaaagcttatgttctttgcaaatggtgactgatgatgtgttaactgttgcatttaccagactaatgcagctatctagtaacatttgtacaaactaggaatggccacgaagcagcatcacatagaggaggagatgccgaatcaacaagtgaagtgaagtgagcaagctgaagaagaagagtggggcaagccgacagagttgaacctcctgaagatctcgcaaggatcctttggttgctggctcagctgtaccatctcctcctgggctccaaaatccacactatcgatatctctgccttcaccgtcaccaagactgcatgcagacagtaccaagacgaggacatgtactgttgctcctcctgcgtttcgcttcattcattcatctgctgctgtgctgttcctccccctcttctgtgtgttgcatctgtagatactctactcccttttcatgtgtttaatactccaga

SEQ ID NO: 21429 - DNA, 671 bp, Oryza sativa
tgggtttgaaaagctaaagcaatgcggaatggaagctttcagatgagatttcgtaacaagataaagtttgatgagcttgcaaactttgattatttcaatgtcaagggcactgatgtgcaagttaatgtgaaagaatggacccagaaatctgaagcagttgggaagttgcatattgtctgggtcaaaaaaaaaaaaatttttcccccaaacccttgggggggaatttcttgaggaaatgaagggttaccaagctttgtatgaaattgggtcaaatttagggcctgtcttggaggttgatatggctactttcagagctagcaatgtgatcagggcaaaagttggaatgatggagctgggtgttctgcctttgaaactagtgttaacttctcccaagggacttttgttccaagctcatttcagtctaaagaaggtgggggggttgggggaagagaaaaaaaaactctttgggggggggtggttatagttgatcagctagatgacacttttgagaaaattgagatacaagaaaatactctggagggtagcagtcagagagagggtaagcaagttgtggtggtggatcccatgacagaagatcaccatgtcagtaagacgggtaacgggctattgaagtttgtcagaagcaagtcctggtgccagaattgatgctg

SEQ ID NO: 21430 - DNA, 282 bp, Oryza sativa
atgaagacatacgttgcccttgtcaaagtctcctccctgaatcattttgtccttaatgacacggtggaaactggaccccttgtaaccaaaccctttttctcctgaaaaggaaaagggcaatggtatgtgtatcatgcaccaaaatctgggtaatcccttgctaaagtaaagtttttaaggtgaaaaatttggggaaaaacccccccaacaagagaagaaaagcaagaagccctttgtaccagtgcaaagagcacggaaggttctctgcggtctggggaacat

SEQ ID NO: 21431 - DNA, 1326 bp, Oryza sativa
gtaagtcaacacatgcaaaacacagaactggtgaaggaccaatagcaaagtaccaaagagatggattcagaaaaaaataacaattcatgagcatctagactgttttctgccacaacacgcatacaaatttaggttgaaaagaaaatcctccagatcaccatcagaaactggaaattattttcaattagacggcagtaagcagctatggcaacccctgactacactatggacagaaatgtggggagaaaaaacaagttgactgcataacttcaaggcaaacatttatgtggtgccagtataatctaagaaaactgaaaaataagatccataccccccataagttcatcctcgtcaatgtcatcagggacattgtagcttcttccgagagtttcctgtatttcattgctcacatccataagatccatcatctcgtcttgcaagctctgcagataagaaaagcatgggtctagattcagatgcaattggaaacagaagaaaacagggaacaacgaaaatccattgcaagccagaaaatcttgaaaacatgacgaatatgttacacaaaaagatgctgcgtacatctatatcttcaagcttgacagttttcatcattcctttcagctctttattggctgccttcattgcagtcatctgcccaaatgaaaacacttgtatcataagtttgggaatcaggatgtaaaacatcatggaaataaaacttcttgagtatactatagctatataccgtttgctgagcatctttaagtccctctgatgcaaaagcaacttgggcaagggtatatgtttggttgtacagcatgtcacgctgcccttcgtacctgtcaggaaagcatatataagacagtatacagatgagcacagtaccgtaatagagtaagtaattcgaaggagaagcaaaagagctcaacaagatatacagagtgaatggtaaatgatgattgggttccttaactaagtaataaaatagaagtctctttttttcttataacataactgctacccttaggaaaatctttcaaaatatatatgaagaaccacatcggtacttaaccaaaaaaagaagatgaagtacacttagaaaggaaaagactctgtgcttatgaaaggacacaaacaatttacagagtcaaaattatgcctctttttatctcaaatgacttgtaagcgatgaattgtaaaattggcgtaaccgggacttggtacaagatgcaacggtttataatgtcatcaatggcgagttctttaatttttcattcatgtgttgttgttgtccacaaggaagaaggcagtgcaacaatttgatag

SEQ ID NO: 21432 - DNA, 1102 bp, Oryza sativa
gccgcgtatttggccacctttccggccagagccaactcggcctgctgtttgttgccccagatgaggacaacatggagacgatcgtcgcgcaagatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaagtggtgtacatggacttcatttcctcacccttgaagaaataggaggtgcggcccgttagcaacgcagcgtaatctataaatagggatcatatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtaaagtttttcgaacgggaagtctaacctacatctaactaggaaagtgctttgtatttgaggatgtgc

SEQ ID NO: 21433 - DNA, 6415 bp, Oryza sativa
  unsure (1)..(6415): unsure at all n locations
gactggcctacggagtggaccggctgggctgtaagcttgggctggccagcctgcatgcttggtttgggaccggccggactgcatcccttggttggctaggctggttggcccgttgcatacgttgcctggcattgttcttgcattttttttgaacttcctgattttgcttgaatatgttgatgcacttattaccggcttaccgccaaaaacttgttgacacaccaaaactcgtggatacattaaggttagtgccaaaataaatacagcatttatcaatacctcatttattcataagtatttaaggagtacaaaatatcacttttagcattttacggccgtcaacaatgctccatgtggaactaatctcaccaaaccacaccatgggttacatcactagcaagtagcaactactgggctagaatattacattcaaagtatttgtagttgtgtggggatccttatgtctttctcgagcaattactttgtttctttggccttctccatttttttaatgtgtatgtaactacaatagtctccttaatacacaaaacagagcatgatcgggagaaaaatattggaaagccaactgcaaaaaatcagtgttcttggtgacaacaatacaatcagcgattatccggcatttgatgcagattacaaagtttgtaagtgttgcatatgatattcactaaacatgtttgttagtatgtcccccacatttgtctcacaatgttgctggtcctaaacaattgctgacttctttttcagtgtgggccaaccatggcgatgcaataagcactcagtactctggaactcctgccttgaagggagactttgtgcggtaatttgtgttttcaagtttttgtgaattctcttatttagccccttttcctttgcacaatttggacctactaatttcagaaaaagaagtaatgatttgattgcaaccataagcacgtttaagctgagttgctaatgtttccttatgaagcaaaggttttgtaacttgtaagatcctttaacacctagcctgctaaacattttctctagtttcatgttgtgaatctcctcaatagttaaacctttataatggcaacttttaaactgatttatttcttgctcgctgtgaaaagttatcttctcgtcaccatcagaaaaattacttgttggattatgtttagttgcttacttcccagtatcaggactgagctgacacctaagatgttgacacagttctaatgcatgagagtgcagtattataattaaattactgacaaactacatgatcacataaggtgcaaaataatactatcgttctgccaatggcattgccacatgttttcactttttcctctattaatccgctgtctatgatctatttcttcttttggttgttggatctttagaaacaaataatgattaattagttatttgttgttcttaacctaactatatcttatttatttattaggtacggaaagcgaactacacagggaattttaaatgatctgtggaatgcaatggctagatattacctgaacaactttgcagatggtactaaacaggtatgttgcttacttggtctcaccattgatgggctggagtgagttggattttgctattttaggtttgctattttatccaagacatcatggacgagtgaagaaaagatcccttacgttggtaatgatggatcaaggcatagtgataactcattatttgtttattgtcttgtataggatgccatggatcttcttcaaggacatcacatatcctcagttagtcgggatatgccaactccaaccaaaggacttatagagaatcacgcggttggttattttctttctattacttgagatttttttttacagatgaataatccttaagttgcataccgtgaattgcatttattgttcttactcttggttctgaattctcatgcttaaaaggattgcaatttacaatgaatttctatgcataattttgatgtttccatctacttactaggataagttgacagcggtgatgctatgatccataccaaggttttgaataccagtctttctggaaaaccactatatccattttttttaattcacaaaccatttaccagccgtaaccgaccatgaaccagtttttgatggaaaattttgtattaaaacttatggcatggataatgcgtgcttttttttaatgacttagtatttatcacacttaatgctgcaaaaaatatacagctcataatgttctgaccggaaataccagtaactggtttggagctcctggccggtaaccagcagtgtaattacctgcgaagatttccacccctgatgtattccctcaatttagttctttcgtgttgatagagttacatgggcatttgaatgtcgttatgcatatcttagtggagatatttgttgaatagtcccacattggttgtggaaggacctaagatataagtgggggagcccctcacctcaatggctagcttttggggtgggaaaggccctttacggtcttacaattggtatcagagcctggctaggttaacatctctggcccgatggacacagtatgtgaaggtttgatggaccgtgggtgcctgcggggcccgtatacctaatggaccgtgggcctgttctgtggggtctatacacggtgaaaggctgagggacttaagatataagtgggggagcccctcacctcaatggctagcttttggggtgggaaaggccctttacgatcctacaatatttttccatatttaaattaggatattttagtggagaacttacttgagttttcatttgcagtccttccgccttgcttttgctctgcttttggctgccgtgatattcttgataatgtcactgagaagaggtactatttcatcctaccgaaatggcaatgatttaagttaatttatgcagattagaggcactcaactgttgtaaacttgacgagttgtttgcagccaacatattactatgtggaaacaaatacataaccaagtcactaggccaaattcactccaacaagtttaatttgatccttcttcatgctttgtcatactaacttgattcatttccttgcagcacgtaatgatgttttccatttggtgctgtcactactatggtctggtttttgctttggcatcacgcgttatgtcaaagctaacggacggaagttcacgaaccgtcctcgctttcacctatcgcgccattgatgcgaacaaaagggattatatacacactcatggtcgactcacctttctgggcatgcatgtgtgctctcagttttgtatcaagtttaactttccctctttgtaagattttgcacatgttctgaccatcacggctttatattttcttgttgaatgggaacatcaggaattgattnngtctaatggcattattcattcaattatttaattatataaacagtttgcacaaaatgttgcaaagatgtatatgatgatcaaaattgcaatggcttagggtttcatatattttgggcatcacggcttctattcaatccacacgtagaaacaagactgcagtttctagcattgtgtatgttaagggtatatatgagatagtttgtatgaaaagtattaaagtaactttctatcactagtgtatataattgatatgccatttaggattaaactccaggaaaagttaaattcccaatttctcctccctgtatattgatattgtaccggagcaagagcaagggagtaaaatcctaaaaatcctagctagccgccgccggctcaacgtctagcaaccctcagttcagatccagctccaattgtccaccatggctcgttgtcacccacgtccgtccgctgctgcttgccatcccccactgcatgaaatttagtgtatgacgcaagacacaaaaggctcaaaagctaagttactttgaaataaaagataatcataagtttgttcatatccattccttggccataaggcatctcaatttatagtacattcagtatctacccttggttccacacgagagctagcttaaaagcagaggaaaacagagaagcgacaaaatgaaatgtaaacagtggttcctgacaacgagcaagctcccagatgcaaaactaatatgcctcgtctattaccagtcgtccgatcttcataatccgctcctgaattgtttccttatcctcttctcttcaattggcttaagcatcctcagagattcataaattcagaacatattcagtccatttctcatctccagattccgacattaccttcccctcgagacaatccttgtcctcaaggattgaaaggtagaaacatacttcggatcacagtggtatcttcccagggtggttcagccggtgataaatttaccaaagattcaaccattgagtcacagcttctccccttctagcaccatcctcctttgcaatacaacaactggttcagttttgatccagccgtctggtctaacagatagcagattggccattggaactgcatgagctcccaagtgtttttcagttggctgacatgaaaaataggatgtatattggagccctttgaagttggagtctctaagcagcctgtccaatcttcctagtaattgtgaaagggccataaaattttaatctcagcttaagagagcccctgataccaaatgatgtacgcctgtagggctgcaattttaggtaggcaaaatttggtataaaacatttaaaaaaattgcaattagctatgggacatcacaaagacatcaatttgccaaggacactctaaaagtgtggtaattttctgtagtatagtggacgcattaaaatatagtatccaccaatttgatgagagagaaaccatataaaatgacaaatttccctttatcttctcccttctctcggtcttcttctgactctcactcgcagtgagctccaccggcttgcccatggtagatagttgctcagcatggtcatgcaacatgtcgaggccaccgctaccggacgccgaacaccataggcgaccgcggaggcggcgcagctgccggagccacttgcactcgcaccaccgtggtggccgtgccccggccagacgaccacgtgagggatgccagtgccgtcgtgttctccatcaggtaccgcctcgccctcaagcaccgcctcccaccgcagttgacgatgcgacgggtttcctccactggattagggaacacaccttggacaatgctgatggctggctcaccgaggctgctgacttcggccgcgtgttcgtcaccggtgactcggacggcagcaccatagcgcaccacctcaccatgcacgccggcttggcgatgcccaatctcactggcgcctgtggcatgatgtgcaaccgcgccatcgactgcaccgagcggttgttcacaatggacaagccaatggagctcactgcgagtgagcgtcggaagaagactatgagaagggagaagaagataagggccaaactgccattttatgtatttatctctcatcaggtgggtggatattatatattacaccaaatttgctccaagacactcaaatgcgtaattagctgtgggacaccacaaagaaattttcttgaggacactctaaaaatatcgtaatttgatgcaagacactagactcattaaaatatattaaacccacccaattgaatgggtgtacctatataatgctttgaatagggtcatctcgatagttgtatgatatgtggtatattaccactcagccaacgccgaccataaataccaatgttggggctcttggaaggtcatatttctcatataggactcaaagacattgattcactctttctgtctaacaatttgtttcatggaggtgacctgtattgaatctcgaaaaaaattttggaaatacactctttttttaataatttgtgtttatatatctacattggagagtttagcagaaatatatctaatccgcggttcggaaacacgggaccgcaaagcaagtgcggcgtggacatgcaggaacggcggctgcttcggtgccgcgcagcggaaacgcggaataggcccgatcctgcagagcaaaagagcgggaccgtatcgttcccgcggccctatcctgtggcaacgtggcggagagtgggaccgatttgctcccacggaaccgtggtgcgctaccgacgcggttctgcatcccggatatgcggcaccgatctggtcccgtcgtgaggcaccgctccctttcccgcataaccatcatgcgggaccgtgaatcaatctctacgcaattggccggcaggtcgtcggtcccgcggcatagtagtgcgggaacgcaccagcacgagcggcattgcgttctggattagaggtcacaaccgtaaaaaaaagcaacttactttgttgatgtgattaggcttttttttttactcttctg

SEQ ID NO: 21434 - DNA, 625 bp, Oryza sativa
ctgtgaatagcataaccaaggaacacacaatcaacagtattcggtccaagtttacgctttttggctataggtacatttaccttggccaaacagtcccaggttcgtaggtatgagagatttaatttcttcatttcccattcctcgaatggtgttacttccttatgcttcattggaattttattcaggacatgacaaagcagtcaaaactgcctcaccccaccattccttggaaagtcctgtagtgtctaacatggcattcaccagcttagttagagtatgattctttctttcagctaccccatttgattggggtgaatagggaggcgtcctctcatgaataattccaaactcttcacaaaaggatgtaaactcattggaaaaatactcgccactcctatcagaactcaaccgtttgattttcctttcaacttggttttctacctcagctttataggtcttaaagtaatgcaatgcttcatcctttgttttcaatagatacacataacaaaatctagtgcaatcatctatcagtgtcataaaatatttctttccccctttagtcaacacgccgttcatttcacgcagatcggaatgaacaagttctagaggtgccaaatccctcgcc

SEQ ID NO: 21435 - DNA, 2975 bp, Oryza sativa
  unsure (1)..(2975): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaatttagaaataactgaaatttgaaaattaaaaagtgtaatatgaaaagaatagtcaatcgtagtacaaaatacgagattaattaaaattagaataataaataaataaatttcgaaattagaaaaatcaaaatatgagttcatgtatacaatttatcaacaactaaattcatcataaaaataaaaactattaaaacaacacaagattaatgaaaaaccgggataaaaattttataaattctgaaagttgacaaataaaaatgagagtttgagaatgaatattatttacaaataacttaaataggaaatagatgaaataacaattcatatagactacaatacggaattaactaaagttagaaataaaaataaattaaattatgtgattagaaaaactaaaatgagggttgagtaggaatataaattataaataacagataagatattttaatagaacatattacatctataacataacggtggtaagtgaccataaatgcaaaagggacatcagacaaaccataaagatagggttggtagaggttgatgggatattaaaaataaaaaccaaaactcctaatgattactagattcaatatttagaaaccaaaggatgattagaaggaaagattttgggtaggctgtaaattaaaagagaacggtggtgatggttgacaggacttcttggaagtaaaaagaaaacgaaaatccaactataatcatgttccatttcataaatcctaatgataataaagaggttgaaagttagtacaccgtagaggagtacaatgttgacgtttaaagggacttccaaaactacaaatcaaaattcgacaagacaatgaactagacaaactatccaatttttaaagtataataaaagctgtggcaggtcgggcaggagaaaaggattggcggctaacgtgacatttaaaaattataaaataaaaaacttgacaatgataaaatttgatcttttgaaatcctaatataactatatggctacttaacaaattttaaagaaaaatatatgtaaacaaaatattttatacggatgcttgccgcgcaattacacgggccacactcaactatgtaattatgaatcaatctaataatagcgtttgttaagacacatgatgttgcgtgcaaaacacattaaattcattcatcgtgctgtacaacctaccaggagcagtgacggctctgtagatggactctaccatggcattgacctcgtcctcgctgatgggcctgagagcctccatccgacgcggcgcaaagagctccaggttgcacagcttccgcaccttgacgtagtgcgggccatagtccgcccagatgaggtccgtgccgccgcggcttaaccgctccgccgagtggttccgcgggcggtcggcgagctgctgatcattgtacgttcttgaacacctctctggctagctccgacgtcgacaccacgatcgtcggcgacgtgcccagccagaccgtcatgatgggtccgtacttgcctgcccactccatgaagcaccggcaccgcaccagcgtgatgtcgaacaggttaccaccggccacgcccggggcccgggggacagcctgccgaggcggatccgattgaagatcaagaaggatggtgatcgggatggcaacaagggcaagcgccaacgggagcaacgccggggtgtccatggctgtcggtgtatgtacgtgggcaaagtggttcttgatcgtcggccagaggcttggagggtttatatagagcaagagcaccataacgcctctgaattattgagggaaaaaaatatgaaagagctagcgagcagcaaagtagaagtagagggcggataggttttttatctagatatcatggcaaccattatttctatacgacttaaatagttataaaaagttaaaaaaaagtaacatctattgggatgctatgagtctatagacaaacatgtaagattaaatttgatctacaactcgagaaacaaacataataaaatcaggcagtggatatttacttgtacaacgtagataaaatttggtttttcttttaacttgcacaattgtatagtgctttatactatataatctacatgcatacatctgggtgacatgataccaagtgtagaaaatatttttccgaagcgaaacagctagctaacacatgcaatagtagtaatgcagctgccagctggcgttgaactggtttatggagcactggtttgatatttttaacgaagttaacaaaaaataatacatgagtgtttatagctaagtacataataaagtcaaataaataactgtcaagtaattgtccaaacataaacgataccacgtttatctgatggaacaacatgacaagttgagtgcaacatattttttttaattaaatagtgaggcccataaggtgcctatatctacatcaacatttctaagaatgctcttgacacgatgtggcataggttaatgttcttcggtgctaaacatttgggatgctatatgtctatagacaaacatgtaagattaaatttgatttacaactcgacaaacaaaaataattaaatcaagcggtggatatcacctgtacaacgaagatacattttggtttttcttttaacttgcacgattgtatagtgg

SEQ ID NO: 21436 - DNA, 3672 bp, Oryza sativa
  unsure (1)..(3672): unsure at all n locations
ctacttaaattgataatatctttatcgagtaattgagatttactttgtgcggttgagcctacgtgatgtctatactgttgaatacctatatttgctgcgtattcaacagttcgtttgaggctgatgtagaggtggtgacagctctcgagatcacttgagtccatcctgtttgggtacggattagagcgcgtttgggtagcaacgagaaagctagtgcatgaagtagtgtgataatgttaaatttaagctttcttaagaccctgttccttactagaaaatcatctctatttttttcccaatttatgccttgtgtcccttgggtgaatctggagaagagttaagcacacacgtttcttgtgaaaattcgataccttggaatacttccggtgaagtgctacagcaatatattcgtacgtttgctgattttatctgtgactaacaacattatgaattgatagaccaacaacttttttcgggccatagctgaggatgtaattggctgagaacgattgcatggtcgtagtaggtaggattactggtgcatgagctgccacggtttttgttttgcatgaggcaactggttggataattagctgtattattacttgcatttttcgtcttcctcgtacatatagtccatttatcagtgcaaattctatatgtgtaccatctattttacatatacgaagcaactgacttataaaaatattgtatatgtatttgttttgttacgatcactagaacggataccatcatctcaatcgggcggtaacccccatctcaatcgggcatggcgtccgtcacaggctagaagccactgatatgaaaagttatctcaatcgggcaaacggccgtaatagatgaacctatctcaatctggccataattaaagcccgtcaccgatagctttgacccagacgatcagtcaaactatagcccgtcacggatgacctatctcaatcgggtttaaactatagcccatcacagatgacccttatctgtgacgggcattaaatatagcccatcacagatgagtcatctcaattgggcataagttaatgcccgtcacagatgagtcatctcaatcgggtctaagttaatgtctgtcacagatgagtataatcccaaaaaaaataaattttatttttaggcatgccgtctagcatctctcaggctagtcttttttgtctttactcatgtgcacctgagaagaacttcccaatcagtcacccatcccgaaattgctataggccaagcatcggcttacgaaagagtagttgtaacttgttggtatgagtattctattaatcctaacatctctcattcatatacattcattcacatacacaaccatcaaaaatcctaaacaataaaattgtataactcaccgagatccacaactattgtatcggtcctttgtacaaataagttcatttgaacaattcaaattttgaattttcaaaatttgacaacttcgaacaaaaattagggttaataaataatttcaaatggaaaagtcaccaaaaccaaagttgtagagcttatcgaggtgcaaacaatttaaaacaatttttattttggtcatttctccatccgactctatttaaacaatttgaaatttgaagttcaaagtttgagaaattcaaacagaattttttgttagtgaacgacttcaactgaaaatgtcatcaataacaaatttgtataactcatcaagattttataacttttattttggtcatttttctatataacattttttgaaccgtttgaatttgaattttaaaatatgacaatttcaaacaatattttcaaatactaaatgatttcaaatgaaaaagttatcaaccaacaaagttgaancaactcatcaagatctaagacttttattttggtcatttctttatctgataaagtgattgtaacattgttcacaaaatttacatatctcttgtctggtttttataaactataatacatatatgtaaaatttgtgaacaatgttactaacattttatcagatgaagaaatgaccaaaataaaagttttagatcttgatgagttattcaactttgttgttgattactttttcagttgaaatcatttagtgtttgaaaatgttgtttgaagttgtcatatttttaaattcaaatttaaacggttgaaaaaatgttatatagaaaaatgaccaaaataaaagttatagattttgatgagttagtcaactttgttgttgataacgtttttagttgaaatcatttagtatttgaaaatattgtttgaagttgtcatattttcaaattcaaattcaaactgttcaaaaattgttatatagaaaaatgaccaaaataaaagttatagatcttgatgagttatacaactttgttgttgatgacttttctatttgatatcatttactacgcgtaaaattattttgacttataaattgaattattatactgcaagttatttattttgctatagttcaacttacaaatataaacatttcttatgaaaaatggaaaaatactcatcagtgacgggctttaattaatgcccgatagagattaagtcatgtcaaccggggattagtatatagcccgtcactgatgagtcatatgtgacgggcctcaagttggtgcacgttacggatgatggtcatatgtgacggaccccaacttaaggcccgtttgagatatggaatgttatctcaatcgggcctaaactatagcccgtcactgataggtgtcatccatgacgggcttaagttttatgcccttctaatatgtctgtgcgatcatatctcaatcggacactttttcggcttgattgagatgacttccttgtgatggcccgctatttccaggcatgttagaggccgtcatagatagaaggatctgtactagtggatttttcttattaaatatactttaatcacggtttgtatttttcatatcaatataaaatatccattaaatattctcacaaatgcttataagccactacatgtcaattaggaaaatcttggaggcgactacccgtccggcgcctgatcccggggtgggtaatttgggcgcccacgtcatgctggcatgacctcagcacgatacatgcgtgcaataccactttaaactagtttttctcttaaattatttatccaaatcatgatccgatcgcaccattaaattcgttgcaattaaatctttaaaacataccacacatggatatattccgacgaaaaaaaattagcttagtattgaattatttttaaatgttgtacgatgttccaccaagtatatcggaattgtttaactaagtagatcgaaaatgtttcaatcatttaaatcgtgcgctgtttcacctcatataaaaacaatgtttcagtaaatagcgaaagaatatttcagttcactgcatatttgatatatccatacatagtgaaacattataagtacactagatgaaacatttttggtggaaaaaaataaaacgaattctcttaatagagggtttctataatatgtgggtgatttattgcaaaagaatattttaattcactgtaacattagatctatatatagtgaagcattgtgagtatactaggtgaaacatttttgtgaaacaacaaatgaaacgaattcctttaatagagtgtttccaaaatatatgagt

SEQ ID NO: 21437 - DNA, 3476 bp, Oryza sativa
ggtgcatgtggtatccccttaagatataaaaggaggaccttgcccactgagaggggggactggacttttccagattagaaacccagaacaagggagaggctggctgatactttgtagctccttcatacacagatgtcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggtgagatggggagcgtcgcctcctcgtctacggcgacggcagcacgcccagggcgcgctccaagctgcgggcgcgctcctacgtcacccgcccgtcgcccatgacccggagtctccagcccaacgttggctggacgacgtggccaaattggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgagagcgtcaaccccaccgagtttctccaggtctatacgaccgggatcgatgccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcggtcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatgatgctccagccgtctcaaccgatcattggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccctggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatctggagtggctggcgaacccggtggtcgttcccaaggcgaacggcaagcttcggatgtgcatcgactacaccgaccttaacaaggcatgtcctaaggatccttaccccctgcctcgcatagatcagaccgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttactttcagatc

SEQ ID NO: 21438 - DNA, 708 bp, Oryza sativa
tagcggcgaccccccaagtagttagtgcagcgttggtgtggagcgcgatgaaaacaatcctcatttcgtgcacccccattctgtgctaacttggcccgggagcgagcggggaggagaagcccccgagtcggacggtggcttacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgggaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtctta

SEQ ID NO: 21439 - DNA, 5633 bp, Oryza sativa
  unsure (1)..(5633): unsure at all n locations
cttgtgtttgatgaggtatgatccttcccactttgattcaagcttgccaaccgctactgggttcgccttcttccttaggacgagatgaccaggcatcagctccgtgggtcgaactttttgttgtaagttgccgaagtgcttgtggtgtacttgtgcatgtgctcgagtgcttcgactcttactccttccaagagttcgagcgatacttcgcatccctcttcgcccccagagaacatcacccttggtgagttagcccctagctttactggggtcattgcctcatcgccataaaaaagcataaacgggctaaacttggttggtcttgtgggggtcgttcgaagggcccagagaactgatagcaattcctctggccatttgcctttcgctgccccctcgagtcttttctttagtgcttctaggatcttgccatttgtacgttcggccgccccatttgactgcgggtgtgcgaccgacgagaacctgatttccaggttaagcccttcgcacatttctctgaacttatcatagtcaaactgcttgccgttgtcagtaataaactcttttggcactccgaaacggtaaacaatgtttttccatacaaacttctgtactgctgccgaagtgattgccccaaggggttcggcttcaatccatcgagagaaatattccacagctacaattgcgaatttatacccgtttcgcgccaccgggaatggcccaatgatgtccagtctccatctggcgaagggccatactggtgcaatgggctgcagatcatactggggcgcggcttggcttcggccatgacgctggcaactttcgcacttcttgatttgctcaacacagactttcaacacagtgggccaataaactccttgtctaaatactttggaggccattgttcttgcagcctagtgcacgccacatagaccctggtgtatctcctttgccatttcttcgccttcggcaaaagagatgcaacgaagtaaaggttgaagtaccccaaagcggtaaagctgacccgagaccatcttatacttcgtggctctgagttgcaaatgcttcgcttctgcttcgtctaccggaagccagccagtttcaaggtgtttcacaaatgaggttcgccagtcatatgggtcttcgcccagtttctcctggtcgattgccatgacttccaagctgtccatgggcacacttggagcatgtaggactttgaaaaagatgccaggcgaatgtgggccaccacaagcagcagatttcgccaaggcgtctgcttcctcgttctggtctctaggcaagtgttcgaccgttatgccggtgaagcatttttccatggaccgaacagcctccagatacctcttcattccctctttttttacctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcagtcttgctacgtaccgaatcggcacaccattcggcaaaaataggactgccgcaatgcctgctcccctgtgcgaccacgagccgtctgagcacatcacccagaattgttcatcgggctcggggtcgggggcaagtaccggtgtccattcagctacgaagtcggctagcatttaagacttgatagcagagcgtgcaacaaaatttaagtcgaacggggatagctctgtcgcccacttgctgagccggccagtgacttccttgcctcggagtatttcgcccaagggatactgtgatggcactatgactttgtgggcctggaagtagtgcttaagcttgcgcgatgccatcactagggcgtcagtgagcttttccatttcaatgtaccttgtcttcgctccttgcagtgcttcggagacgaactacaccggtttttgtccgaactctgtttcttggacgagggcagcactgactgccaccggcgaagctgctaagtataatancagttcgcttcctgggggtgggcttatcagaactggcgggctttgcaagtattgctttagcacgtcgaatgctgcttggcactctggtatccaattaaactttcctgcgcctcggagggtcttgaagaagggcaaacctctttcggctgcctttgagaggaatcgactgagtgccacaattcggcctgcaagcttttgtacttcatgtacgcttgacggaggcttcatttgctggatggcatcgattttctcgggatttgcctcgatgcctctttcggaaacaaggaaacccaacaacttgcctgcgcggacgccgaaaacgcacttctccggattcaaccttgtgcctgctgtgcgcaagctgtcgaatgtctcctgcaggtcgatcgcatggtcgaaagccttgcggctttttacgatgatgtcgtcgacataagcttccacattctgccccaactgcttgccaaggaccttgtacaccagcctggcaaaagttgctcctgcgttcgttaagccgaaaggcatcctgaggtgacaaaatgtgccgaatggagtgatgaaggatgttttggggatgtcgagcgggttcatgtggatctggtggtaaccggaatatgcatccaggaaactcatgagctcgcatccagctgttgaatccacgagctggtcgattcgcggcaaggggaagtcgtcatttgccgttcaggtctgtgaaatcgacacacatgcgccatttgccgtttgacttccgcaccagcactggattcaccaaccactccggatggtcaatctcttggataacccccgccctgagcaatttttgtacttcggctttcgccgcttcttggcgatcggcagacatcttgcgcaacttttgttttcttggcttaatgtccggcttgactgctaggtgatgcatgataagatccaccgggacaccccccacctcgttagggctccaggcgaagatatcgatgttctttttgagcacctctaggatactctcaacttcttcttcgcccatgtcgcccccaagtgatacgagctttgtggggtcggcatcatcaatctacacttttgttatcttgccgtgaggggtgggctttggtgtgtgcttcggccgttcatgcggttcggtctcaacactgtgcactgctctgttgattatggctagatcgcctttcgaagcggccgaaggctgaagccccttgactactatcacccctgtcgggccgggcatcttgagcttgagataattgtggtgggaaatggcttcgaacttgttcagggttgcacggccgaagatggcgttgtagttgtacgggatgtcgacgacgtcgaacagtatttgctcttcgcgtctattctcccccgagccaaaggctatcagcaaaagtgtttggccgagaacttgaactgcttctctgctgaaaccgcggagcgatgctggtgctggggtaagggcttgggtaggcaaccccatcttggcatatgcttcagcgaagataacatcggccgaactccctccgtcgaccaggattcgtcggacttcgaaaccagctatctcagctgagattaccaggggatcttgatgcgggaaaataactccttctgcgtcttccggcccaaaagaaattagctggttcagatactgcggcgccccttcacccgccgaagtgatgctgtggaccatacggatctgcatcatcttctgccgtttggacaactggcttggcgggtcagcccttgtaatcacttggattacccttcgctgtacatcttggcgttgttcggttgggggtgtttgctcctgaactgcttcgcggggtgcttcgacaattgttccctgctgcggccttaggtcttgcgcattgccacattgcctaatgtttcgacattgctccgtggtgtgcgaagagcatccgtgaaaggcgtagtagaggtcttttcggaccttcttgtgggctggctgctgatggttgctcgcttgctgggcatcgaactccttgcggagggcttgcacttcttcgaccgccatcacagctttgctcgcatggtctgttctgaactttctccaagttatgggggcttggctttgccttggcggctgtccttggatcgccggctgagactggcgaacgaagaggggaggtggttcgacaacttgaacttgtgcttgagcttgagcagcggcgatggaggctttgtcatactcagcttgtatagcttgctgtcgcttggaattctcctcgccccttgcgaacccgtcaatgatgcgaagtaggtgctcgagcgtctgaggctccttgttggtgatttttcttgtgagttcgtcctcgagcagaccggccgaagtggcatttataaccgacgcctcggttatgtcttgaacttggcaccgggcttgcaagaagcgacgcatgtactcccttatcgactccccctgcctttggcgaatgccaagtagatgttgttgcgtcttcggctcctcgttggtgcctcgaaagttaaggacaaaaacatcgtgcaattgctcccatgagtaaatgctattggctggtaaattgaaataccaagaacgggcgatgccgtctagagcgagatgtattaccttcgctttggtatttttgtcaccatgagctgcttcgatcgctgactcgtagatggagaggaactccttcgggtcagtttcgcctgaatagcgcgggacgggtgggaacttaaactggggtgggattggacgagtcttgattcccccacacagcggtagccctttttcgcctcccgccctgtttaccgcaccctactgcgggtacggtgtggcgaagggcgaaatcgcagcttgtgcgtgtggttgggccatggcattcggctgcccggctccaactggaggtacttgctgagccgccatggatgggtcaaaaattggctgtgaccacatcatggcagcttggattggtgcttggtttgttccgaagcctggagttggagcttgctgccgaacggttggcgcctgagcagcgttgatgaagtcgaactgcggtccctgattccacagcgaaactctcaggcccggctgaatcggtggcaaccaattaggcgcactttgacttgtatttgtcgcgaccgagaaaaatacattttcccgaacggtagtgtattaatccccatcccagtaaaagccagggtacaccacacaaacatgatataaaagacacatctttattatatcgataatatttacattattacaaaggcccttaaggcctgacaatcaaaaataaacagcagcggactagcgggcctacggctccatcttcacaggcgctcaactggggtataagccaggactccacctaagaattcttctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21440 - DNA, 897 bp, Oryza sativa
cttcttgaatgcctccgtgaactccgcccaagtgattggttgtccttctgctctgttcatccggaaatgatcccaccattctgatgcaggtccttgcaactgatgtgaagcgaaaacaactttctcctgatccgtacactagagcaattccaacttcttctcgatagcgtgcagccaatcacctgcttctactgggttggtagtgctagaaaaggtaggtggcctcacacgaagaaaatcagctaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctattgcatattagagaagatagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaactatacctacacacaaagcaagcaacaaacgttctaccctactaactattcttcaaagatagtttggcggcataggttctaaggtaggatccaaacttcattccatcttgaacacttggcacttcagatcgatcatcaccttcatattcctcgatccactttacttaacctccgtaagtagacctcattggcgtcttcaagtttcaatgtctcagaactactgaagttgaaagagagaggggagtagacaatgaaacaatttgcaaagaattctagataaggaagaaaggagaaattttcacaaatcatatttt

SEQ ID NO: 21441 - DNA, 12406 bp, Oryza sativa
  unsure (1)..(12406): unsure at all n locations
ggaaaggagttgtgacaataccccttgcacaacataatccattacagcgcacctttcctggatcataatcacccccttataaacaaggcatggactccccagcgacccccgtggacttctcgccacttctcagtctggcgcactataatgaatcacgctatacaaaagataaagccgttgcccatgctggcttgtggttggcacggtaaaggtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatataaccatcattaataatgtagtatataagattcatcccattagtgagctaatgtttctaagcattgctaagcaattatatatatatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggatcgtgtttaggatctgtgtgacttgccttgcaataatcggttttcaattaatcttcttgaatacttccggcgcactcacgaaccttcgcaacgacggaaacgacaagctaacacgcaaaacgaagaaaaagactaataaaaaccaaataaacaatacataaaaagtaaacaaacatgtagatcatgattttagatgaatttagcaacttgaaccactcaaaaccgagttacgatgatttagttatgaatttctgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggcggcgacggggctccggtgatcagcggcttcggtggtcaggcggccgggcttctccaccctcccgcgcacctaacggtggtgacggcgaccggcggcgacgacggaggcggcggcgcgacgcggatggagctcggccggcgacgacggcggggtggagcacgtggcggcggcgctacgaggcacgggagaccacgggggagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaattttagaaaaacacaaggggaaaggtcagatttggaggagaaaaaccgagccaaatcggtctcagttcggctgctagaggtagaagaaggagcactgtagcgacagggacgaaaaacagacttctatgcgggctgagaggaaggaagagagaaggggacgcaaattagacttttcgtcttgggctggctgaaaacaaagaaaagaaagaaagagaagggggaagctcggctgggccgactagggctgcacggccgtgcacacaaaagagggagatgggccggaaagggcccaagactaggaagaggattattattacttttccaattaaattaatcaatgaaatgatctttgaattgttaaaaatacttccaatgctcaaataattccaagaaaaatcttgaacatacttggacacccaaagtatttaacaatattaaaaccagaccatttaatgattaatttaatatgtgggtaattactgaaatgctctttgtatgattaaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacattccactacagaacggtcatcgaccatcttgtagtcatagaacttctccatgacatatagctcgctgctggcgtcagaaactccgaacttggcctcaagtgcatcccacatgtcgttccctgaagccattgtgcatatacatgtccactatgttgtcagcgagtacattgatcaatgctccacggaacaggcaatccgaagcctcgaacttaacctcctcctcaggagagagaggtggttcacttcggttaccccatgaaacatagaaacattgcatcgctgtcaaccacagtagtgcacgtgctttccatcttttataattagaaccatcaaaagtatgtggttttagtgcagcaacaaagacaactaccgaaaatgatatatcaggtttttggattgttggaaatatagtcatatatcggcatattttaatccaaaatattaagacaataatcatgacatgaacaatgtgaggtgatctagtgataaaattaaacataaccaggagcatgcttaagatagaataagcatcatcatcatgtagagaacgcaataacattgcaactaacagaagtaacaaaaacagagatagcgacaaaatgttataccctgtgaaagtcccttcgctggattgtgaggtagaactgtctctgttggtgttgtcgatcggtgcgccagctccagctccaggtgcgccagctttgcctccgggtgcgccatctccagaagacatggtgatgcagacgaatggacgatgaacagaagaagaggagcagtcaggtgatgcagacgaacggacaacgaacagaagaagaggagcagtcgtgcggaagcactccccaaaagccttgctcgttccgatctctcgtgcgcgcaagcgatcagaaccggggaaacagaaatgggaaggaaagcgtggagatctaatcgggatcagaaccggggaaacagaaatgggagagaaagcatggagatctgatcgggggtctctgtttcctaatagcgcaagagaggaatccgcccgttgccatagtaacgacgcgatcaatgcgtattgaatcgcctgcccgttacagaggcaatctcgcggggttggattccggtccattgcaaaaggatcgagagagagacgcaacgcaacccaacccaatgcaacgcacgccacgcctcgcccatggctcggcccggccggctcggctcggcgcgcgcgtggctttccgatccccacctcgaccggtcaacagggagcctccaataactccctatttaagttgagatactccacttttaattcctaagctggtattattatccttaacattattattggcccttgagattttaatagaaaaatcgggcctagcccatttattctaacatcccttactcaattcttgaatttaagccattcgctgctagaggaacctatttgaatgctttaatttttcactatggaacttgatcccactgcagtgaaaatctgcgacgaaaattcatattctgatcatgataaatcattcagttcactttttttagcacatgaagtaaaaactaataatattggatatgtaattatccaaagatttaattgcagcttgtgcagatctttactcatttcttctattttatctatttttacaagctgtttttttttctcattttgttgtatacaattgatacatagttgtgggttgtggccatgtgcattccccaatgtgctacctcaagctcatgcaaatgcatatggagtcaaactaacatgtgctgtgatttcattcatttgaaaatcgtaatgatcaaaaggtctttatatttaattttcttcgctctcatagtgatttcttgcatcattgatgtcaaatgtttttacgctttctgagcaaggtaggagtactcaacttcgatgcttgatgatgaggatcagtagatttttttaaaaaaatctactatgtaaatcaagttatgcccgcaacaacgcgcggggtgtcatttagttctacataaatcataggaggcaagtcatcaagctgcaatgggtggatgtgctgctaaaccaagtcacaaatgaaatcttgtaaacaagttatggttggcacccaggaaggatattagagtgaacacaatgcgagtgacacannnnnnnnnnnnnnnnnnnnnnnnnnnnacttggagcttgtgtgtagttcgagttctgcttttcctgctggaattaaaccctaccactatgttggatgttttatatttttagatttatgcatgtattgacggtttaaatttggtatttaataactgtcaacaaagagcaacggggactgactttgtagcctttttgagttttctattgtcgatagacatcctccagcccgtgacggtacgttgtgggatcaactcgtttttttgagtttttaacgattgtcattccacctttcttagacactacctgaattgggctaacccactctcacatcctgattttcgtttcagaatttataaattatttttagaatttatattaaatgtttattaatttacaaatgaagttaaatgtgggaaaataaaatttcctaaatataaagcatggctggatttaatttgtattaaattatccattattaattacactcaacgatgcatatcatagaggatattcaaggaatggttaaaggttctttttgtgtaaagctcattttgtaattcttttcataagcctaagacctagcatagactgatcaggttttaataccattattcattaaacagtaacgcttctgtccaccatccgttgtgatcccaaggatagcttccggccactggaccatcatggttttctagggtctaccctttctcgcttttcgagaagttcatccaccagtacaaaatcatcatgcatatcccacccatcattttaagaatttagattctaggcaagtgtaacacatgtcccggtgctcaatatccacgcgcacagctattcgaatatgttggtttactcacactgtagtggatatacactccacctgtacgccgtgacttgcccaacacatgagccaaagtccgaacgaatgagatgcgtcatggcaaagcctttcaataacctcactttggcagtacccgctccatgaacttgagccctcatgcactctaggcatacatggtttctagtagtgagaggagttctggcgttcccgaggagggaaaaactcacacatgcgttaagttatagttaagttaggttttaatttggttgcccacagatggttacccaccgtaggctccccgcctattcacacacctagatgaaaaccagtgcacttgggtaccacctctgctcggctatttactccgctaggtctatacccatacgagaagtatggttgtactagggtcatttcatgcttagcttcaaggcacggtccttaacagaccaaggacggcactagcctttaccggacaccacccaagtcatccagccactagtctaaaaacatttgtttagtttagatttcctttcacaaaccattttgttcatgttatatcaaagtggcgctcatgtctccacatgccgtatatcaactagcttccccaaagtagatgcccaagcatttaggggctgtttggatgggactaaaaatttagttcctatcatatcggatgcttggatactaattagaagtattaaatgtagattattgacaaaacctattccataaccctagactaattcgtgaaacgaatctattgagcctaattaatccatgacagtaaacttgtgctaattatggattaattagacttaaaaaatttgtcatgtgaattagatctcatttttgtaattagttttgtaagtagtctatgtttaatactccaaattaatgtctaaacatccgataagtccctggatccaaacaccaccatagcatttgataaacatggatgtgcatgaatctaagtggcattgactaagcagttattagatttacgagacacaatattgcggatacaaataattgcagggaatcaacatcaaagtatggtgtgtgtgtatatatatatagcatgcaaattttacttaaatcaacataacttcacaataggtttaacatgctcaaagattagagatgacttgccttgctcacagccttgctgaccctggtcttcactcaactcatcaacttcctagggatctagatttagacacgaaagattttatttgaattcgaatagaattcaaataaaatcaccataaattcatataatacaaaataaatgataaaagtgataccatcagatagatcttgatcttagataaatttaggtttaagtttcattcaaatccaagctatgctagtttaaagattcaactttgaattaattcgaataattgtgaaatggcatttgacggagctcggggctcctcaccgggagaccgcgcaggcccccctttgccagttcggccgggggcttagggtgagatctcaagccctcgctgtgtgtggaaagatcgcgtgccaggaagaaacgcgagacacggacgatgtatacaggttcgggccgctgggaagcgtaataccctactcctgtgtttttggtggatctgtgtaagagcaagttacaaaaaatcaaccagccctctcctctctcgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacaacccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcctcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgttcccgaaggtgccaggccacgtgggcgattccatctgcctcaagcctccgggcgcaatactcccggtcccatatcaccgacagtagcccccggcgttatgtcagggcaatcatccctcttcaaggaaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctgaagatatggtaacgtcgcttcggtcagcgagcgtaattaacgcgcgcacgatatgatctatctcgactgccacaaccgcatatctaccttatgcgccgcaagcgggcgaatgggatttagtggaagcgtgggcgcgagaaacgagggagcgaaatagcgagtaacgagggagcgagatagtgggcacgagaaacgaggagccgggctccagcgatggcaagggtataaagctatcgaggaaaggacttgctcccttccttttcgccactattcccctttccttcgccgtttgcgcccctaactctctctttgctgcgcctcaccttcgccacacacactcgttctcaaccctctctttctccgacgacatggcacggggctccgctctgctcgacggtagcgtactaccgccttcccgcattgtgagcgagaggcaggctgggctgccgcgccgcttcatgccagaatccgccaccggccgtgagatagtaatgctgggtgagggacgcccggcgccagactacccggggcggtccgtcttctttctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggcggctgctatttcctgccgcgggggccggtgttgaaccgctacatcccctgcgtcctccgcaaaaagtgggatgactggaagagcgactggttctacacccccctcgccgacgaagcgcatctccgacttccgagccagcccccggtgcaggcctccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatgcggacccaccagggggtcagatgggattgggcccccgaggacttcaagatactgatccaacgggtgctaaatctcaactccgtggaggcgtccctcatccctcacggtatcctccccctctgcagcgacccagatcgcgtctccatcttgaccattatgacggcggtcggggcctcagaggagcaggctcctaagggccatggcggcgcaggtgggagccgccggggggatcaatctacccccggagggggtcgtgcttctgggccccgcgtcgggggctcggggagcaaccgccctaccgacgcccgggggaagaggaaactgggaggaatacctcccccatctcctccccgagggggcggggcggcgcgtgccagcagcaggcgcccggagggggccgcgccaacatcgcagcccgagggggagcgcaagaagaaacggctgcgcaagatgggggagacagaaccatcccagggaaacctaatttcccctccaaggtggtcatttaaccgaccccctcgcaggttcgtcccgctctctttgcgaccgtcttttcttctatcccaaaagcaagttttaccttacccatcttgtttgccttctggttttttcttctgcttcagcgatgtcccgtcgcgtccctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagctgaagaagccgctcgggaggaggccgcccgggcttgtcaggctgaagaagccacccgggaggaaaccgcccgggctcgccaggcagaggcgatggcgtcttccgaggcggtttacgacaagaccgccggcgcgtcgctcgggcccactccctcgggtgacgctcaggcgacaacctccggggcggcttgcgacagggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccaccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcgtcgccaccaccgcgatgattgaggcgcaggactccctccgccttcaacacgggagctgggaggcggagctaaagaaaaagctcgacgccgcccagggggtcctcgacgccgccactgcccgagagcagcgagcaacggaggctgaagcggcgtcccggcggcgcgaagaggcccttgaagcccgtgccatggcgctggaggatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcaacaggctgctaacctcgagacgcgagaaaaggagctggatgcgaggaagcgcagcggcggggcggctacgggcgaaagcgacttagtcgcccgcctcgcagctgccgaacacaacgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggcgaggacgacggtggcgacgaggccagcgacccgggcgcattggaatgagcccccaggcccccgccaatctccaattttttctttttctttcttctttttgtatagatcaacttaatctgcaatcaaaaatgatgaaaaatttctatgttaactttgttttgttatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctttaggaaattgaaactgcttttattgaaatgctaaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcaatgttccacgggtttcgcagctcagtgccgcccccgtggccagccttacggaacccggccgggggaccccgatcactcgatacggaccctcccacattggtgaaagcttg

SEQ ID NO: 21442 - DNA, 4504 bp, Oryza sativa
cggctccccgaggagctcgagaagacaattaagtcatcctcgagggacttcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgttgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattctttagttttttcttcttttctttcttctaaggccttcgggcctcttttttgtatatatcaacttaatctgtaatcaaaaatgaagaaatttttgtgttaatttcatcttgctgtgagtatgagatgaggatgatctgtgccgtggtccttttgtgtcttagcttgaataagggtttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaatggtcccaggatatcgagtccccagacagcaaatggccacgaaagtggtatggtctgcagggcctgggccggctgatggatttgcttggtgtggaattgacacgctctacatcgccggaccaggtcgactgcatcattaagagctgtcggccaatagaaaccctggcgaaaagctttaccaaccaaggtgcgcgaggcggagtgggctccgcattcgccttcatggatatcggcaagaagcacaacgccttgttctcgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccatctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgcacttggcgtacataggcgtccatttgcgggtcggagcaccggtactccttacagacctggttaacgaccagctgggaatcgcctaacaccaggagacggcggatccccagtccggctgccaccctgagtccggcaaggagtccctcatactctgccatattattggtcgctcgaaagtcaaggcggaccagatatctaaggacgtctcctgtcggggaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggcggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctcccccgggccaagtcggcacagggtggggaagcgtgaaatgagaattgttctcatcgcgctccacaaccaatgccgcactaactacttgcggggtcgccgctaagtagagtacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaagacatgccttgttaaggtcggtgtagtcgatgcacattcgaagcttgccgcgtcgcttgggaacgaccaccgcgttcgccagccactccggatggatgactcacggatgaatccggctttcagaagtcgcgccaccttctcgcggatgaag

SEQ ID NO: 21443 - DNA, 1478 bp, Oryza sativa
agctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcgtctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccggccaccagcatctaggcgcttgcgtgcagtcatgaccaatttggccacatcgtccagccaacgtgggctggagaactccgggtcatgggcgacgggcgggtgacgtatgagcgcgcccgcagcttggagcgcgcccttggcgtgctgcccg

SEQ ID NO: 21444 - DNA, 4826 bp, Oryza sativa
  unsure (1)..(4826): unsure at all n locations
ccgtagtcggaggttccgttcctggacctactacctcatcctcgagccctctagaagtatggggatctcaagttttgtcgtcgtcgtgtgatgtcgtgatgtcgttaaccttgtccgttgtcgttccgatgtcattagtcctggacgttgtcgtcttggtgacaacggcgatctagtcggtcttggttgtcgctatcacggcaatgttgattgtcgcgttagatgtcgagagattgttgtaaccaactggtcaacaatctactggtcacctgaagatcgctaagatctactggtcgaggaccaggtgtaggcgtatctcgatcacctgaagatgaatttttaggtggtgagagatcactacgatgtactggtcgaggaccaggtgtaggcgtatctcgatcacctgaagatgaaacttctcttgttatccacgacccccctttatcaatatttgccgtactcacttggtcgatcctggtgtaagaccgtagaggcatggagtcttggacaacgatagatggagttcaacggtccacaagtgaatttaaattgataggcgatgagatgtcgctacaactgtctggtcgataactaggattaggcatctcttaatcacctataggggcgctagagttggttattacatgtgcatctcatgtggccagcatgactcacatacccaacttatagcatatccggatgtctgttcgcaatcatgtcggatgatcaagccgacaacgttcgcgggggaattatctgttaacaatattttctcaaatagtctagccgtagccaacgctatatatgagataagtcgtcggtctttgttggtaggttgggtgcgacaactcagcatttttcgagaacgttctcgataatgcggtgtactcgaccacatcgtactcgagtgctcaattgttcctgaaaaatattttctagaagacaatatagtagacaatatcgagtatttactcaaaaaactgcatgaatcttctagagttatagtattatcaggatataacaagcaaattaaatatcgggcattatgtaaaccgtaaacaagcatgatttatacttgaaaaaagtagggcgagccccagtattaaaccgtggttggcttaatattggaaacactcgcacaataaatattgtataaaaaacacggtctaggtaaacataataaattattgatctgataatattgtatatatatctgaaaaataggtacggtaaattgtatataaaatattgcgtatctttgtagatatatgctggatatatctacgaatttagtagattaattttaaaaaaaatcaatctcactaattaccttgtgtgcacgtgtccgagtagtatagacatgtcttaacgaagcaattttcacatgcactgtgtggatgcatgttggctggtccacgcatgcatgcatgctcttggtttgtatcctcatgtccgtcggcgtactcggtcgatgatagtggatgtcatgtccagcttggactcagcgggccaatgccttgcaccagctagcagcgcgacgtttgatctcggtacgaatcgggccaacgtgtccgaggacaccctgttaggaataagaccgacacatattggatcaatctctcatgtcgtcgatactgttggttttccgctgtgacgaaatcttaaatattggtcgatctcgacggatcgaatatttggcgatggtcccgatctcgtcgggggacatactccggtcgggttagatttccctacagccgaagtcgtcgagtaatttgtcattggagaatccatctcttgaacccatgtcgttgaaaccttgaagcaccaaaaattcccctacctggcgcaccgctgtcaacggttggtaccgcgactacgttatttgatggtatggagatcgttggtactagggtatgtgcgagattgaggtaaaagagatagagacaaggatttttatacatgttcgggccccttatctgacaagtaatagccctacatcctgttagccgaagccggtgttgctctttattcatctggatcacacaaatacagtatttgggataacctatctagttgtcgtcgatttggcggctagataaccatctcgtagtcgacgacagggtagtcttcctcctgaagtacgaacacgtcgagatcagagatggcacttgatccctcttgtcggcttccgtaggcaccggatgggatatgtctaggcttatctctgatgttgatatgcgacgacttgtcttggcgtatattggcttgtgtattgtgcgcctatggtgggtgtgtcttgtggctttatgatgtatctcctctcctccttagagggcttgtatttatacccatagatgcctccttgtccaagtaaaactagggagataaatatggatacaatccgagtagtccttatcgtttctatatagaactctatttatcctttcttatccggaactccttatatatacgggatttgttttcgtataagatatcgtatgtggtgggccctgccaagtttagtcaactactattaggtatgtgatatccatgaccatgacagagagtgtattaaacttttataacaaacatatgacatgacataatttatgtggctaaaaaatctttgaccactagtaaactaaaggatcaagatggatatcccgcgtgttgccgcgagaanaatgtgtgataaaatagtatacacaaagttgaaagattttcttttcttactttactactaccttcgtttcagggtataagactttctagcaattgccatattcatatagatgttcataaatctaggcgcacatatattgtttagattcatttaccatacatacatatatatatatatatatatatatatatatatatatatatatatatatatatatatatatatatatatgtaaattaactggtgctacatggagtatgggctccaagattcaaattgcgtatatacccaatttgaatgtttaaatgttttttttaaatgtttagattatgaatattaacttctttactaacaagttcaaacaagtttgaactgagtttgaacttttttttttagattttgggtctagatatataacatctaaacatataattccgtatgtatgtaataatgaattgtgaaatgaagttgagtttgagttggtttgttgttaggtatttgtatgaattaaattcatatacctagatatctacttacaatttgtaattttttaaaaatttgagagaatttgtgttttttataccttagagcccggacaccataaagtcccctatggatatcatatatatatatatatatatatatatatatatatatatatatatatataacacgatcatgctacgtagcgcgacacacagaagtagccgctagggacttacgagcgccttctcaggagcgatctcctcctggtcttccggttctccctcctcacattctggttctggggtttttcgaattttccctcccaccaagagtgttttccgtttttttcctgcacaactgccacccggtctccacgtgccctcctcaagccccttttctcactccatcagttcacacggtgagtaaaaatattcttgagagaaatcaggttcccataatcagtaaaaaaattccttaacaaaatcaaaccctctttctatgggcaataaaatttttactcctagagtctccataatcagtaaaaaaattccttagcgaaatcaaacactctttagaccgacagtaaaattttaactccccaaatcccaataatcagtaaaaccctctttggacgggcagtaaaatttttactccccacaagttcagatactcatcaagatcacactctttcgaccgatattaaaatttttactcccaaatccccataataactagtaaaagaagcgaaatcaaaccctctttagactggcagtaaaatttttactcccacaagttcggggctggataatactcatcaagaccaaggttagtgaaatttttactccagcatatttcttacatcattggcgttcatagtaatatttttatcacatatattttggtaattcttttactcaatctgttcgtatggagaagagaaagagaatttttttcaggcattaacatatgagaaccattatcatttttacgggacatattaacacatacaatcaaaattagggagtattacattcaatcatgcatatgaaattatcaatcacacaaaatcttctgtgcgtaaaaaactacagaaacaacaggaggaaaaaataacatctccatccaagggaggagaggagacacagcagagatgttgatggcatgaggtgctgacgtgctgcagcagttggcggcgactactcgagacagatagactagcagctccaatcccatcccagccaccagcagctgttggcatcgaagcaggagcaaggcgacagggctccagtttagccccgcacaaagcatggtcggggttggactcgggttcatctgccagccagactacgccgctgtggcctagagcaccgccgcgcgacgtccaccatctccccgtcacctactccttcgccgttcctgtcgggataggacaaggcgctggatcccacaccggggaggagtttggcctgcaaatccggcgcagccaaagctcaccagcaccttcatcggcctcctcaccatccttaatcgacagcggcctagtccgcctgtaagctggtcaccggggctgacgtccattggcgcaacattctcctcctcttctggcttgaacgcagcctacgcacggtgagcaagaagaggcgacctaacaccaagg

SEQ ID NO: 21445 - DNA, 426 bp, Oryza sativa
accattgttgccttccagaattaacatggcatgttgcgtacaagaattatctttctttctatttctatgttctatggagttgatgtattgttctatggtttactagatagttgatctatcaaaatcaatcctagcattcccaaattacctataacaagaggtattcatggatcggtacaacatatatatctacagcaggttagtttcgttctgttttgtcaacacagaatcatgaggaattttagatgtgttcattctggatgctgtctataattctatatgtattaaatttatatgacacgtgagtgtatatatgcaatgccattacgaactgctactatagtctccctgtgttcttctctttgatacatgaataacaaatatggcacaatttaaggcaattgcagtttacaggctctgtgcaag

SEQ ID NO: 21446 - DNA, 2078 bp, Oryza sativa
ggcagaaatggtcagccgaaactggtgatttcttggtacaatgttgtgatttcagaacaaatgctatcgaccattgttatctgaaactgttcatcgattataaagcaatcttcatttctaattcatattcttggataatcctgcagacaaaatgtaaaagtgcttgggaagacatgttgaatactgagcatgcaggtaatcgaaagaaaagttgaaatggatatattatgcctcctaaggtattaagcaatcatctgttttgttctaactcacgtatgccctatgtttcagtgaccttctgaaagataaaacatgtttacacgcttgaatagcgaaccatttgcatcttgcagctgcgctgaactggtttgaagatgtttgcagacagaattgtggtttgtaatgagctctttccacttgtagtcctttatggtggagaagaatgccaatcatagcatccactaaatgacccatttgaaagtgtttgtcctttttgttgatgaaaattatagcccaattcacttttttattgttcatctttgttggtgtgttgtcttctattaagccacctaatggattcacaaggactacttatactttattgtactctgtttattaaacaaatgtagaccgtatttatcaaaatattatctactatctaaccattttatgcagaactatttgctatcgcgcggcgtgcgccgcgctctcctttctagtatatatctatgtttctgttaattgcagcaagcatggctagcaaatgcctaacactagccaataaaatggatctatttttttttataaataaactcatcggtgtcaggttagaaaaaaaatcatgtcacgagtcacgacggcgaacaactttgtcgtttctaaacaagaaaccgtcaccgattagttatctgtgacggtaccccgagaaaggtgatcaagccttatcggtgacggtagctctcccgataaagatgagttttcacataactgatcactaatccgtgaccagaccgtccgcatccgtgaccagaccgtccgccaccacagatgaggattcacgcctgatacagatccgcactagtgaatattaatagatctttataaatacttagtttgaaaacataaaaaaggtagattaatcatgaaaagtattgttataaatttattaaattttattaactcatttaataaaccaacataggcatactgcgacaaggaagaagaaaaacggcattttttttattgaaacaaataaccaaaagagtgtgttccaatatgagaatatacatatagaacgaagttatccaacaacagataagaggctagatccaatttttcacttgacacctggtgtgttacatttcattgcaagggggtcctcgttgtcagctaccacttgatccatgccatgtctggtggttttttattcatatcaactagtgttcgagtttacactagcacgggatggctcatctgtaacgggcgggaagccacatctgtgtcgggatagggtaccgtcacgaacaaaaggtcactgatgtgaaaggtcatctgtatcgggccccttgctgtcacggattacagttatctttatcaggccaatgttaaaccccgtcaccgatgagttcgacctagcagaggagtcaaactagggcccgtcattgatgagtcatccgtgacgtgcgcgcacttgaaaccggcaaagatgattatgtcacctttgtcagtatagtatggtgaccatcacggatgactgatcggtaacggattctaaggtacactcgttgcctttggtattaattagtatcgggtttttttataacccgtcaccaatgagtaatttaccaaaaaaataaatattgtttttttcgctagcctcagtcctttactagctatgttcactgcaaaataagaaagaaacacatgtttatatatttccttcatcccagcaaacccacatcccaacatttttcacaaatccatcacatgccatctataaagccatacattcacaacagcatatatgtacattcacaacgtcaaattcatttgtatcagcgtcttcaagagctaagcat

SEQ ID NO: 21447 - DNA, 847 bp, Oryza sativa
tcctgcagccccatgtgcttcagtttaaaaatattttctagatgtacaatatagtatgtttgcttttatttccttgtcctgatttcttaagaaggatgtggtgggagaaattagcaaaagctgatgttacattttgatttttccgtgatgacatttgcaccgtattttagaatattgctaacactgtgcccattggtaatgattctactagcatcctgcaaaatcttcaagcttatcctttggattcttttaaggttcattgaccttttttttcttgaatatgcaagagaaatacgtatcatttcattaagacaggaaaaaaaaacgaggagggaagaaaaaccctccctcaccctacaaacaaacaggacctgaggttacatatgaaaaggaacaaaaacaaccttacccaaacggggttagcgacctactagggaaatatgtgagcttagaagctccggccatacaccataggtcatactcatttgccaccgtttggatgacagacattacattaggattgacgccgttaaacaaacagtcgttcctatgcttccagatttcccaagccaccaaaatgataactgtattgagccctttttttttggagttttgatcaatgcctcttacactgccttaggccaccaacagcataagcaagtagaattttgacttggagaaatggaaatcagccccaacctttggagaattagtgaccacacttgttgggaaaagacacaagtaactaggatgtgattaatggattcctcagcctggtcagaaagcatacaagtagcaggatgtggcagtccacgcttggcaaggcgattagccgtccagcaatggt

SEQ ID NO: 21448 - DNA, 548 bp, Oryza sativa
ccagcttcgcgttttcctgaatagtgattgttctcttcggcccaggcatcttgagcacttgatacgcatagtgagatgcggccatgaacttcgcgagtgcagtcctcccgatgatggcattatatgttgtgtcaaactcagcgacatcaaaggtgatctgctccgttcggaagttgtttgcttggccaaaagtcacaggtagcgtaatcttgcccagtggcttggacgatgagtgaggagtaattccgtggaagggttgatcagtgggcgtcaactcacttcgtggggtccccatcgcgtccaaggtgctggtgaagagtaggttaatggagttgcctccgtcgatgagaacccgtgcggaataaatgtgcttagggacgtcctagggttgccctagggcgcacaccccttgggctaagcccacgacacaattacaaggcccaaaactcaaaatcagattcggactagatgagatatgtgtcttgttttgctgattgtcggcagctcggtaggaattttgacatgggaccaaaaccatatgaaagtag

SEQ ID NO: 21449 - DNA, 3170 bp, Oryza sativa
catagttggcacctcataaatatgcataccttaagtagctgtagcaccattatcattaccttttttctcatcttcagaaattataggtgcttggttaattaaacattcttcaagcatgcatggagctaaagataggtctttttcctcttcgtctttcttctctttcccattaccttgtttattctcagatgcctgcaaaatattagtatccaaaacaataggcacaacattacgttcattttgtaataacttagacttagttgaaggcatcataatagtatctttcctggtatctctgaaaatctcatcgattctatttttcgtgcctttcaatactatctttgaaaatttcctcgattccattcttcatcctttcaagattatcttcgaaaatttcagtaaaactcataggtaccaatttcattttccgaccattatgtttaaatgtgtatgtattagcaacaaaattatgcgatccattattatcatatacccatggttgacctaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcaccaagttattgcaactctcactatcgattatagtacgacatgctctatccttaaccacaaactttgtttcaaataattcatggtactgccattgctccgctttctccatttgagaacttagcaaggtaaatctaatatagaacatatgcacttttggttgattaatacataaagtagccatggttatatccgagttagttgtgtcctcatcacttctccaacgccagttgcttcgtgagtgcctttttgaagacgaaacaagtctcgagagagtgcttgtccgactcgtgtatcgggcaccatatttgcttcgtgtcgtcaccttgtgggtctaggtgcttgggtgggtcagcatattctgctgtgaggacctctgtttgagctttccttttcctactcctgcgactcttcctcttgcttgcctcaggtgcatccttggctggtttcttctctccccctgtcttcggcttgtcgttcttgcgtctcagggcgtcgtccgcgtgagtgcattgatcgacaatctcgaataacttacgagcagtcgtgatccatcttgtcgccaactcctgggtagtgtagcgatctcgaacatcagacttgaaagcgcggattacggaagcatcggtgatctcggggatcgtatttctgcactcattaaagcgccgaatatagtccctcaatgattcgcccggattctgcttcaacgcgtgtaggtcgtcttcgatcgcgtggcgcttgtatgttccttggaagttagcaacgaactgctgccacagatctgtccatgaagaaatcaagtagggtgggaggtgaaccagccatgaacgtgtagatcccttcaacgccgccggcaaataatttgccaatgcgttgtcgtctactccggcagcatagagtactgtggaatagacctgaagaaactcctcagggtcggtgctttgtcgtatttctctattgttcctagtcgaaatttctcaggccatctaacctctcgcagaaaacgagtgaaagctctgcacccgccgctaggggcggtgggttgtcggtgatcatgtgctcgtcgtggatgcctgttcgatgatgaagatgatgaagatgacgaggatgatgacgagtcactcggcttcggagtgcgattacgaggatgacgctcaggttcttgagaaccttgtcatcgcccaccgttgttgtcccggcgctgatctccatcgtcgtcgtcattacggcgtcgtcctcgactggtatcgcccggcatctgttgctcgcgattagtgcgttcgcgacggttgtggcgatcatcacggtctcggttctcgctcggatgccttccttgctcttcgttctcgcgatgtcgcgaagagacgcgatgtcgggaacgattttcgttatcttgagtacgtcgcgcttctccggcggccattcagatggtcgcggagatcactagtgccgcgaggcagaggggtggcttgacgaggtggcgtccgctgttcaggctgttccccatctgcgccgtctgtcggcggttgtctctggtggtgccctggcagcggcttcctcgaacgcgtttctgaggttggccactgattcccgtagtcgtttcatccactgatcaagatcagcgttcaagacgggatcataaggggtttccctcagtattgcattgatggttctgatatgttgggcctgcgtagccaattgatcctccgcttccgtgttgccgcctgtagatgtgctggtcccatcaatagcgtacacgttgcgtgctgtacttgttgatgatgaggcctggtcttcgagcagatgtaggaagacggctcgtgggggtcgatatcgattaccccgacgaatcgatctgaaatagtcgccactcctcgctccttgtccgcatctctaggggagatttgtgactgctagaccttaggaggcgacgtcctcatggcactgagaaggaccttgtagctcgagaggtcgtgagtctttgccttgtgaatgggacaatagacatcacgagtgggggaagtacgttgaattccacgttatttgcaggcacggatttcagcttgtacgtcgggaaaaaccgagcaagcttgcaaggtgtgccttttggtcttgtggataggacaccaggtccttgtcgcctcggaagttatccttgtcggctcgtgcttctcgtcggggagacaagatttggccgtgttaggatccttctcgggctcaaatgttgtcgatgttccgttctccgcttctgcaggaggatctttcgacgtggagtcgaccggggtcgtaaccacgccattctcgctcctggtaattgctgggccattcgagatcggcatcgtggtgtagaccgggaagacgatttcgccgacttgagtccacaccagcatcgttgaagttgaggctccttggttgatgccggggtcgacgctgtcgtcgaagaggcttgaagtcatagtagtagaaccttgagcacc

SEQ ID NO: 21450 - DNA, 734 bp, Oryza sativa
ccaaggattggggtgcgtgctcatgcaggatggttatgtgggggcctatgcctcacgccagcttcgggctcatgaaggcaactaccctactcatgatttggagttagccgcggtggttcatgccctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggtcgccgacgctctaagtcgaaaaggccattgcaacactcttaacgtctgtggcattccacccgaacttaatcaacagatggaagccctgaacctaagcatagttagtcgcggattcttggctgcgctggaagccaagcccaccttgctcgatcaaatccgcgaggctcagaagaatgatccagacatgcatggactcctcaagaatatgaaacagggtaaagccgctggtttcacaaaggatgaacacggaaccctatggaacggaaatcgagtatgcgttccagataacagagaacttaaacagttgatacttcaggaagctcacgaaagtccttattccatccaccctggcagcatgaaaatgtacttaaacttgaaggagaaatactggtgggttagtatgaagcgggaaattgcagagtttgtggcccttt

SEQ ID NO: 21451 - DNA, 2561 bp, Oryza sativa
  unsure (1)..(2561): unsure at all n locations
acatctgcttaactctagtgcaagtccaaggctagcctctagtgtgttaagggcgtgccaactggtttgattcaaccaacaagaaaaacaacaaacagagtaagtcaacagatagccgatcagccgataggccgatgacgtatcgttggcgatcctagcgnatatagttagaccaaatcggctatggattgatatataaattaagcacaaaccctaaatatgcctcatcggccgtgatatcatctatttggtttatcaaatctattttagacaatactatagaaataaccgatggaacaatattcagagcaagatagataaataaagataataatactctagtacaaacttatataaacaaatcaatctatagaaatatatcaaatactgataagttaccaagtttgataacccgactgatactgatctagacttgatatatttatatagggtgatctatctatataagtggcaaatatacataaatccagtaaagaagcatgtatattaggtaagatcggctaaaactttgatactatccttaattatgattaattccaagttagtttttagggttcaagacatgactagggatgatgtatcgcaaattatgtaaagaaacttaaaagtataaacaatcaagtaattaaccattttttaggatggtacatgccttagctaatataatctagcaaaacaatttagctgatatcggcgagaaccctaaagggagaactggccaatagggctaaatcgagatactaagactagattaactaagacatataatagcagatggtcatgataaaagggctaaacatctaaagggacataatagccccgatagtacaagtcatcgaatcaagttacctcttgtcgagagaacttcccgaagagaagaacaaaagggtggtgatgcgccgaagttgtattggattttgtcgtccttttttttacaactagtaattgtgcacgtgcaatgcacgtagtttaacagcatttgtcgcaataaatatatcaacacttcaaattttaagaataatatcagcaataatgatatggcctatttttataggtccctgttacacacttgccatgaaaatagtgcaacgttagagaaaattgcttgacgaacacttgaaaagctggaataaaaaagatttgtctttcagtgggattgaaggtaactccactgtcgaacaaaaagaaaagaaaagcataagcataagctatctaaaagtaaaaggctgaaaaataaacttcgatgaaaaacccccaaaatctacttcaaatttaagggtgaaattcaaattttggctaataagcataagcctaagcaaaaagacctttgaacaatcacgcaccttttgcgccactggacatgttatatatacataacaaaaccttatttatgataaactagttcaagtatgaactaaattaatatttcaacttcagtagacagtgagttaccttagaacatatgcttgtcttgagggctattataacataataagtaccgtaagtatgaactaaattattttttcaactttagtagacagtgagttaccttaggatatatgcttgtcttgagggctattatagctgaataagtacaatgaactgcaaaaatactaaaagttttctcaaaaccaacaactgcaaccattgcaccatgtagcccattctctaaagaaaggagagatagcagtgaataactaacctacaactacaatggccataaaacatcatcaagtacaaactttaccgagatgtagaaatggtataataattcaacttgtctccccaggcactctgacatattgtctaaattgtgcatgttgctccatagatagcagagggaggcccatatctctcccataattcctgaaagtgcatacctaaagacatttgtttctttaatgctgaagcacatgtattcataggaagaagtcacaacaattgagatatcagcttcattaacaaaattttttgatacaacaattgtccaaattgagatacaaagaagtacttgcaatacacaacatcaggtcaggaggcccttatcctaattggcttcctcgtaattcctgaagcccttttgtggatgccatggtatattcaaatttaaagcacccatggaacttgctgcatatttcacccaagaatccgcatggccacatcaagccccaattgcattttcagatacaaaatacctgtcagtccataggggcagaactataaaggaaaagataatttgtaaatttgcaaagtagaacgtgatgccatgaagattccatcaaccatgtaattaacatacttataggaaatcaacctccaacatgtatacatgaaatgaaacttgtatcctgctgcatctccttcagtggagctgacaccaccgaccagtggagcaagagaggatggatctaaaaactatatattgtttccattagcagactaacaaacaaaagcttatctccaatcaaataataaattgtagaatatattccttactttcaatagtaagagaaaaaacagaaatgcactgacactgcttt

SEQ ID NO: 21452 - DNA, 972 bp, Oryza sativa
ggacaatccaatacaacttcggcgcatcgcgaccctttcgtttttacttttcgacgagttcgcttcgcaagaggtaactcatctcgatggcctatgctattggggctattatgtcgttttagatatcttagtccttgtatcatgaccatcgatatcatatgtctatgttaatctagttttaacaaatcgatttagctctatcggctgcttctcgctttagggtttctgccgttatcggctaaatcgtcttgctagattagattagcttagacatataccaccttgaaaatcaatcaacggcttgattgtctagacattgtgtttcttttcatacttagtgttgcattagtacattcgacctactaagtcgtgttgatctctaccctgcttcttgatttctaacagggataacatcagggtttcagccgctcttacctaatatacatgcttctttatctgtttcatgtatatttgccatctatatagacagatcactttatagtaatatatcaagtagaggtcatatcggctgggctatcaacattgactattgacctctatttggtatattactatagattgatttgcctatatagatctgtactagagtattagccagtatattatctttcttacactaaatattgttacatcggctattttaataatattatcttaagcttctttatcaatcttgatagacaatgttacaaccaatgaggcatattaagggtttaatattctttaatatatcaagtctatagccgattggtctaactccatccgtagagaccaccaacgatacgctatcggccgatcggctatcggctgactaactctgcttttctctttcttgctgattgcaggatcaaatcagttggcacgcccttgatacacttgaggctagccttggacttgcactggagttaagaagatcccctaggccgccgtgttttcacatgaacagcatgc

SEQ ID NO: 21453 - DNA, 1417 bp, Oryza sativa
  unsure (1)..(1417): unsure at all n locations
tgccctactgcagacctgggaagaagggaagaagaagaaagggaaagaaggatgcggagggaattgaggtgaagaaggaaatgaggggttttggttgccgctgcccatggaggcctaggtatctaatacatgatcttttccccctgttttggttttctattagggtttagatcaagtgttggaagcgagtaagtttgggatcaaccgatttattcctcagccaggtttttgctgatctgtcccctgcacagttctggtttggatgccttttcggccatcataatgggatttcctgcgaaacgtctctatacaaaagttgtagataacgtgtagatctatcttctgaccaaatggcatgagtttatatcaagtggtttaggagatatcaatttctgaagttgactgtctgaatatcgatgcattttttctgtagtcgaggttcagagggattttagaggatcttaatgatggaatcagagaatcttgtttttacagaagttgtagcatatgttgtgatctacctcctacataaaaattgttagcttttatcttgtagtttgttgtcagtgctctcttgaatggttgttgcacagttttctgggcagatgcacttctctgttttgtgccatgttttaggccagctaaatggaagaattcaattttgttatctaaatgaaagttgtaattcttgttctgtagatgtcagaaatgacatatttttctgtgttatgtgatgtagaattggaggtatcaaattgttaatctatgctgcttttataggaagattatcagtgatttgctttatgttgtttggggtgggatcccagcgtagaaagcgtatgtgtgattcttgaaatgataatgcatgtttgtntaagtctgagcnggtgtttttttaggtgatgccacttcggaatgcaactagagttcatctcatcatcggtgaaggcaagtaaacgtagcggtggtttgctacagccttgacttgttatttgattctacctccacgttgaaattatatatcatcaaccaagattattatatattacaccgaggatttacctatctgaatcatacttattgattttacactgtttatggttatactttatgctcttggttataataaccttatactgatctccatcgaaggaatgtggttccgatgttatactctggaattcatactgcatttgcatcacttgcattgcatttgaagttatgtcgtgaacctatggttgcgaccgtaccggtacagcatcgtatattgccgtaatacgatgcagcttcacaccttgttgggtgtgaaggcaggagtacatatcattgcattgtatatgcacatattgcaggacgttatgaaaattattgatcgaagatgtctttgagaagtgttttcttctctaggatttgtgag

SEQ ID NO: 21454 - DNA, 1423 bp, Oryza sativa
gcccataaccgagggggcggctatcgaataggttatactctgatcagaggtgtacatcttacccacaagacacatcttcttcacgtgtaaccatgtgccacataccaccccggtatacggacggaagacgtgacatagtttccaacccatcctagccatagacaagagtaccgacccaaccccacctacggccggaacctccaggacaggtaggcaggactgagcccatagcagtaggacaccagccctgtgccatgacatctcgactaccgggccgcagctcgtgtagccttcatttgccctagagatgtccatcgacccccgacttcgtccatctccatccgtatacttttgtttataaccagactgagccacaaactaagccttacccactagacatgtggaagtacggtagtgctttgcaacagaggcacgagcttaatccttatagtacccaaggtacgacaaacaaaacccaaccacgcacctcgagcccagcctaaaaccattttgggggttttgaatagagggggaggtatgtgtccaattccaccataatccaaccattccatagtgtctaagtgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgcttttccaaacgtcggcttcaacctccacgtagagcggatcttccgaagctacagcgtctacacgaccaaagaaaaggaaaaagtattttactctaataaactccatataacaagcaggaacaaagtacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaaaggatttattgcgtcagccgaggggagagcgcgcgcggaccgggtccacgggggtggggcccacgcggcagcctcacggtccacggtggactgggtgcacccgggctcacaccggccggagccgtgggccccacgcgtcagcctcactgagggcacgggcggctgacggccgggccccacgcggcggccactcggcgcgcccgaaggcggccacgacggcgcggtcggcggcaggcggcacccgcgcccctatggtcgccggc

SEQ ID NO: 21455 - DNA, 3642 bp, Oryza sativa
actctaagccttatttgacttttactttgcacattttaattttttttgaggctttcacgaggattttaattattctaggcataattttaaaggatatattttagggtcgctttgggacgtgacatagcttgaatataactgacagagatttggctggtcttgcttttaatagtttaattgctccttttagagaaaaactagatggccaacaatttcttgatgttagtcaacttatgcaaagggctctcgcttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccgcttcctctcttgggccggctcggcccagctccctccctctctctcctctcccctgcggcccatcggccttcccccgcgcgcgcgtcgctgacgggcgggcccgcccgccaccctcgctgatgggtggggcccacccgtcatcccctacctcgcgccgcacccgccgcctcgcccgtgccctagcgccgccgccgccgcggattccgccgcatcccgccgcccccgcgcacaataaagaggggaaaatcactccccgtgattccctccctctttccccccacttttccctctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctacccgtcggaatcgagctcgcgccgtcgtcctctctctccgccgtcgccgccgagcttcggttcgccgccgtcgtcgccccggacctcctcccacttcggcatcgcctccttcggcttcgccgcgtcctcgtcgacctcgtccaccccttcgtttcgctcgccgaccgccggaacgccgccgtcctcgtcgacccgagccgcgccgccgcctctctccgcttcggtcgccgttcccgtcgtcgccgtcgacccggggtgagccgaggaccgccatctcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgagtgcggctgacgtgtgggacccacggcgccggccggcgcaagccgcgtgcacccggtccaccgtggaccgtgaggctgccgtgtgggccccactcccgtggacccggtccgcgcgcccctcccctcggctgacgcaataaattcgattttaaattaaaatttaaatgaagaaattcgcaaatatccatttaaagagcatataaacttcaaatggccatatcttggccatttgaactcggaattggaccgttcaagtatctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattgttattatttctttgttcaccctagattaaacaaaaccccaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacgaccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtctactaatgattacatcgagcatattgtaaatggcatgattctcattctcattctactaatgattgcaatgtgtttcgacgataggttcaatcggccatagatgaaggacgattgaagttcactgatggctccaagatgaatcttgatcatgatccttttccggtgaatacgattaatttcaatgataagaaggtgttgattcggccggagcaagccgaatctactaaaggaaaaggagtatcattggtga

SEQ ID NO: 21456 - DNA, 1675 bp, Oryza sativa
  unsure (1)..(1675): unsure at all n locations
ggttatatggtaagaatcgggctaatgaagaaaagagggaaagaaagcgcatcaaggtggaggtaaggacttcggaagtattacccatcaaagtggggtctcatgatgtgtcaataccttctggagatgaagttggagagtcttcaaggaaaaaatccgaggccggtaccagctcatcgcagtcggatggtctgaccaggccttctggccggtctgaccgcagccatacagccggtctgatcgggccatcaggccggtctgaccgccgacccgacagcggtccgaccgacacctcaggctggtctgaccgtgcgccaaatgtcggtctgaccggcgcatctggccggtctgaccggtggtctacgtccggtctgacccggctccagcgccggtttgataggaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaacggttgttgtagaggagaaggaggaacaatcggttgataaaggtgaatcatctccaaaagaagacatgaatatgaacatggtatgtatgttgcctatgcagttttgtgctatggatgaagccgaggttgctcaattctcattaggtcctaaagacacggtttttgagaagcccgatgagtcaaaccgtcacatgaaccctctctatctcaaaggccatgttgatgggaagccgatctctaggatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggagggatctttctagctacgattttattagtatctccgatggcaaatttgtatctatctctgtaaagccggctagtatagcacgactaagccatataaatttgtataatgagtaaggaggctaatttagaatggttacaaaagagggtgcaagaatatcagtctacaaagaacgatattggtgaaatcgttgaaggttttgatgaagtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21457 - DNA, 610 bp, Oryza sativa
cctgcagccccagacaaacaaagccaaaccccccgcctcgcctacatctcgcgctctccgccccccgcccgcctccactctgcatggacgcctccgccggctcgtcggcgccgcactcgcacgggaacccggggaagcagggtggcggcggcggcggcggcggcggacgggggaaggccccggcggcggagatcaggggtgaggcggcgagggatgacgtctttttcgctgacgataccttcccgttgctcccggacttcccgtgcctttcttccccgtcaagctcaaccttctcgtcgtcgtcgtcgtcgaactcgtccagcgctttcaccaccgcggcgggagggggttgcggcggtgagccgtccgagccggcctcggcggcggacgggtttggtgagctcgccgacatagaccagctcctcgacctcgcgtcgctgtccgtcccgtgggaggccgagcagccgctgttcccggacgacgttggcatgatgatagaggacgccatgtccgggcaaccgcatcaggcggacgactgtaccggcgacggcgatacgaaggcggtgatggaggcggccgggggaggagacgacgccggcgacgcatgcat

SEQ ID NO: 21458 - DNA, 466 bp, Oryza sativa
tacaattgatgttcccgcaactttcccaataccagacggagatggtgctgatggtcttcctctgattgtgagtatatcagaatgtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgatcgaacagatcatcgatccggggaagagggtacttggttttgatggtgacttcattgagagctctgtagtcaacgcacatcctctttgtttggctttcttctccacaaaaatcacaggagcaccccagggggaagtactcggacgtatata

SEQ ID NO: 21459 - DNA, 2814 bp, Oryza sativa
aaatttcaggaggttattatggtatttatattaccgtactctatgataaacccgataactatggtaaccgcgcggcagtaaaggaaacctgctcccatctactccacggcctcactcactgctctgctctctctccccgcggttaaacttaaagctactatcgctagcgctttgccttggctaccgtgcctcttgacaaaaaccaaagcccaactactccccagtccccactgctgcaatgtcgctcgtgttctgcggctgttacggtagtttaagagcaagtttaatattatagcctattactggcttcaatttatctatagctaatctaatagctaattgatataatagttgtttactatactattaatatatggtcccacctattatacacactgtgttttgaaatccgtgctgcagctggctacagatctctagcccatttctcttctctctcatcttttatctaattaaaatatatttatagctgactaatagtctgctattatacctgctctaataactctggtttactgctaattataatcaccagtagagagaggggggaggaaactgtgatctctggtctccatcttttagcaatagtacgcataatttataagtaaatattttatatgtatggtatgatttaaatatcaatattgaaaattaattttatataaatccctttttaaaatccaaatttgacagcagctgattctaaacgaagcaaatcattggggcctctgaacagagtgacaatagtgtgcacctgttgacgtactagtagaagaagagtagtaccactaccgtggtagcagctgcttaactttgcccaccgccaaccgtcaagggccattaatggcgtgcagggccgctgctgctgctgcttgctcttgctcttgctgctgggtggagtgagcgagagatcccatgtggcattggagcgctgtctcctgctgctgcacagtctactctcacttgctccgcctctcccctcgttaattcttggcggctgtgtggcgaggaagaaaaagcggtgatggcatgctgatgggctgcgggttcttggatgcatttgggtggatatgcggacatggtggtgagttcgctgctctcgcgcttctctgagcctgtattgattttagaaatttcttgtatttcgttctaactctagatggcattgatgctctgcttgcttggttcttgttatcttcttgtactctgtgtatgtgtgtgtgtgagagagatatttgaactgaagattctgcagtttcagattttctttggcctgtttctctctctcccccgagcggtagccattctctctttcttgttcttctgccaatttccagctgtttccagtagctggaaacttcgaattgcttaaagttcagttgtttgcttgctatgaacttcgtttccccttcaagtttcactgcatttcctttccagtttttccttcaaagctcggatttgtttcttgcctcttcagcattcttttttccggcctcgattttgtataaagccgtttgtttgtgtcaaaatgttcaccaatatgcctttctcatgagcctcatctgttcggtttactgtacatatgctcttaatggtctgtcaatagtctgtccagaatgtcattttctatgtcgggaccgtacagatttttaaggctgcagcttccatattttttaattcgaacaactgacaactactgccttgttttttctgttcaatctggagtaaaacttgttcgcgatgttcttgcatccggtctccaaattgtttttttttttttggtttttggaaataagtatgattcagtcccgtggcattcacatcttgcttctccttagtttcttcattgattagcgctgtaaatttaatctttttcttttgcggaagctgtaatttgagagcgatgggagcatcttcttagggatcctcttccactggctagcctacagctgtttttctccttcattggtactccaatcttggctggaattttgaatcttttgtccgggaagtgataaaatttagaaagacaacacaaccattggcacttcttacagttgtgagcgctaagctgagcctccaatggcgtggcattttactgcggctttcatgatcgcaacctgtttgatgttattcccaagaagcgagcagtcctcgcagggtgaggtgctgcagcagctaaggaagcagctggagtacccaaggcagctggatgtatggaataacccaaacagtgacccctgctacacccagcctacttcggtggtcaccgtggcatgcgaggggaacgccattacagagcttaagattatcggtgacaggatcaccaagccaccaaagttcagtggctatcctgtctccaatatcaccctctctgaagcctttgttctcgattcgtttgttactacattggcaaggttacctgccttgcacgttgttatcctagtatccttggggctatggggtcctcttcctgacaagattcaccggctgtcatctcttcaagtgcttgatttgagctccaatttcctttatggatcgattcctccgaagctgtcagccatgccaaagttgcacaccttgacattggatgggaacttcttcaatggtaccatgccggactggttcaacttgtactcgaacctcacggttcttcgcttgcagcgtaaccggttgaaggggcccataccagcatcaattggtaaagctaccatgcttagtgagcttgctcttgctggcaacagcatcgctggcgaggttccacaattaggcagcttgaataagcttgagatgctg

SEQ ID NO: 21460 - DNA, 1265 bp, Oryza sativa
atctatgacttgcaagaaacacttgtgaaatagaaaaggaatctatctaactaagttttcttactctgggtatgttgtgtatgagcgttttctcactttgcgacttcgatcagtcacttgagccatacactcttcctagcccctagccttgtcgtcggagaattattctcagaggataaggctcttggactcttgacttgccttggttgaaaaagcgctgaccctagcccccagccgtgaagttggaaaactcaatttccgattacacggcttggttaatacgcacggcgagaactcttacatgaccagaacttacatggtcgtttgtctctacatgatccgacaaggccttatccgctctaggcgtccccagccgaagttcccttaggttcctcagaggccttgtcaggatggcgtaaagggacatgaggataggtttcaactctaggtgtcgtcgtggtaagggatcgccgggaaggaacacttagactgtagtctttacctgaaatcaatctttattgaaatcgtaagatgtcttacaagtatggatactattgatttatacataaaattttcgtaattgatcaatgttccatgaatttgctaactcgcgaccatcgttgtctgcaatcttgaatgcacctggccgcaagaattgcgtgatcgtgtatggtccttcccacttgggtgagagcttgttacgccctgcttggctttgaacccgtcggaggacgtaatcgtcgatcaaaagtgtgcgtgctctgatgcgcttctcatggtatcggcgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggggcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggcattgatgaactgggagccattgtctattatgatgcggtgaggcaatctgtatctgcagaatatcctttga

SEQ ID NO: 21461 - DNA, 760 bp, Oryza sativa
caagaaagtacgaccgaactgcaagtttgagcactccaatcacaccaaaaactattctaactttaggatttgtagagggaccacgaggtggcaactcttccactagactcattgatccatttgtccgatcaactgacaggaacaaatcagcaagaccgtcaactggttcaaatacgtaacggtctgcaaactcccacagccttagtcttgtgtgtagctttggtgaagggcatgcttcagttgcaacactcatcgtgtgatgccctgatagaggaatacatgagtaaatgttaaatcatcagaatgataaatatgggccacagatataaccagtcaagacatgtgatgcccataatatactggaacaatagtaacagatgaatacctgaataatgttatcgtgctcttaaaataaccaataacagtacaagtgtcaggattttcctagtaaggataagcctattgtaatcatagaatacaaacacatgcacattaaactaacatccttaaaaaactaattgggatttgtgggccatggaaccaacatccttcagcatctagaactgttagatagccatggtccgatgatcatatcatatcgcatatagcaagacaaaaagagcatatgagacaagaagccaaacaagtatgacgaaaagggccagggaaggtaccctgccatgtatcctttttatcacaatagatagatagggaaatcaaaccggataactataaatgtcaaataaacaagaaagctatt

SEQ ID NO: 21462 - DNA, 2981 bp, Oryza sativa
  unsure (1)..(2981): unsure at all n locations
acacacccgcaccacgacgcaaaaccgagaaattttggcaagcagtacgttcagcgcctcaagatcgatccatcacggtctcactgtcaaatcatgcgccccaaaattttgtataaacaattcaaaattgccgtaggaaacgaagcacacaaagagggattagatcctgacgcacctagcactccggcagcggtaggggtcggaggagagtggaatggatacggaccagcggcggttggggatcggaagagggtggaatgaatggattgagaaggggaatcgcctcggagaagtggagaaggggatggaactagcggtagtgagatgaacgcgggagagggaaaggccacactagaagcggggcgatggtggccatttttggtgggtagcaacaatgtcggaggcctggctgataaaatcctcacgttctagtacttttcctttttttttttgattatttttcttatggatgcgactacagggagcgcatgcactcggttgtgctaaccaacgaccatgctttttaccaaaaatagtgcagtgtgtaatcaacttgttacccttcttactaaaagtagtagcacctgccacttgcatcctcatacccatctaaaattcaaataatttttctcttaaatacttatctgatctacgacccgattacatcgtttcgttgcaattatatctgtacatcaagatcttacatgattatattatgatgaaaaaaatatttatgcttgtaaatcacttttaattatatactaagttacttttatcatatatatatatataagagttggattttttgcacgcaagttcacatgtacccacaaggctagtatattaggtgctaacaaaatgtaacatacatgttatactatattttttacaagtgtaaaataccttgtttatataatttttgtatttcttatgcaaaacttgtttatgtagtttaccttgtttatataaattatcttgtttatgtagtttttgatggtaggatatatatcattttggaaatatcatttttgcaagatgacaatttggtgatatagtagatatattgttttctcattttgactaaatatcatgttataaacaaaataagggttagaaaaatacaatgcactagatatataaatgttatatatgattattattgaaaaatttatttggtaaaaaatgcaacatacatgttatacatatagtgaaccaacctaatcctaattatcttttctccctatagtaagcattcatttcgttaaggttagctacattttgcagcaggaatcttggaacacatcaacagtgtagattgtaggtacatatgaacccgagtgcgaatctgcattatacacacacacacaagcaaaatgcccatgcgttgcattgggtgaagcaaaaaaaagaaaaagtagtaatgggtgtgtgggaggagtgtaaagccaccaaggttaattgagctcctcatagtcaaatcgaatattcccggtgcaagaatgctctaaatccacttacatggattattataagaaatcaattaataccactataaaatctctataatataaaaaataaatttttttgccggtactttagtacgtcatccgtgtatgagtcggtttttaacttcgtttacttttggaaatacattttcgtatttgagttagtttttaagtttgctcgtttttggaaacatagaaggagtcgtataagaaatctctttaaaaaactcgcatgctagcttgagatgatcggactcctaattgcagcttatgactttctaaaaatatatatatctaagcaaatttaaatagtgaatttcacattaattaaacagtataacaataataagattaaaataactctcatccattgcaatgcacggggatttttatagtgaatactaaaatttgaaaccatanaaagtatttatttttatcatgagtcagttgcaatgtacggttatttttttgtcattgatattgataaacacttttttatatcataaagagtacccatagtagaagaaatatttttagctagctatcagatcaagctcactgcactccagtagcagaatcgttttcactaaaaaaaaaaagaaggaaatcgtacgataaatagaaaaaaaaagtgacgtggttaggtgtcctacggcgaatgagaaattgacgcggaaaacaatcttgatgcaaacacaattaattttgttggtgattacgtgtttttcttgaaaaaaaaagcatgcgattgttttttatattttaaaaagtaaatcattttgttggtgattacgtgttttttattttatttttaaatagtaaaatagcatctatttttatctgatctctggtacacgtgagtccaaactttataattcagtgtttataacgacgtgcaagcctcatatttaagcaggtgcttgagtgcttctcaagctgtggggaagttattcgtgttacagtaccacgatgctacagtctcggttgctacagtaccgtgcagtactgtgctggctggtgctcctctgttatgtgggctggctgttgggttgagactgctgggccggccttatactgctttggttgggctgcttgctagctttctgttttttcttttctcttttatttgtgggtgtaagagatctccatcacgcttacggattgtggattagcgacaaaatattgtgtgggcccatgcttaacgacggacgaatgattaaccggaagctttacttatttttttaattaggtactgcggactctaatatgtcgtgttttgttgatgacgaaaaaaaaagatgtttaattttcaaattaaaattgattcattataagatttctgaatcataaaatatctgttgaagaaagcggtgttaaacgtttgatttttcagtgcatggtccgtgctagtggcagagagaaaaaaattgggattaaatagaatttgagatgtgagaggcaaaatagacttattct

SEQ ID NO: 21463 - DNA, 698 bp, Oryza sativa
atgttattcttaacattaagctactaagaggagatgagggtatgattacacttgtgaaatcctactatatggacaagattttaagtcgctttggctacagtgactgcaagccagctgctactccttatgatcctagcgtgctattaaggaaaaaccgaagaatagcaagggattaactgagatactcccaaatcattggttcattgatgtacttggctagtgcaacgaggcctgacatatcatttgctgtaagcaagctgagccggtttgtctcaaatccgggagatgatcattgacaggctctggaaagagtaatgcgctatctaaatgacactataagctatggaattcacactaccgggtacccaaaagtactggaagggtatagtgactcaaactggatatatgatgctgatgagataaaggccacaagtggatatgtgttcacacttggaggtggtgctgtttcttggaagtcttgcaagcagatcatcttaacgaggtcaacaatggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgatcagttcaaaggacaacatgaagtcatctaggcatatcaaaaga

SEQ ID NO: 21464 - DNA, 8840 bp, Oryza sativa
  unsure (1)..(8840): unsure at all n locations
ccgtgaatttggattgcgaaacaaactattgtgtggctgagagaagagactcttgaaaaggagatattgaactatatgccacttttagatgtggcaattaactatttgccactggacccacatgtcatagacacatgtggacctacatgtcattgagataggtgtggcaaatagttaattaccaaatctaaaagtggcaaatagttaaaagcccccttgaaaagggctcattttcatgatgtacttctcttctattatgcatggtaggatggcttatgccttaatgtggttcaagtggcttttctaagcagagatattgacttgcaaaacatctcagaagaacacacctatatgagttcgactgctagtcacagtctatgagatttgggcgatctctagatactcatgaaagggcctggagtttgacttatatgctccaaacagagcggatgcaaacggcagcccagtaccagtcaagggtttgagtgaaacctgctcacacaagactgacaattcaaggcatagtccattgttcagttgtggtctgatgtaactcttttcctaggtggaagttcaacttaacagtctccaccaaaacactggtatatcaaacaggttgaactttgagaacatttcttatgagccatgaaatttgttggggattgttagaataaatgggctaggcccgatttttctattaaaatctcaagggcccataagaaatgttaaggataataataccaccctgggaattaaaagtggagtatctcaacttaaatagggagttattggaggctccctgttgaccggttgaggtagggatcggaaagccacacgcgcgtggcgtgtgttgcgttgcatctctctctcgatccttttgcaacggaccggaatccaaccccgtgagattgcctctgtaacgggcagacaattcaatacgcattgatcatgtcgttactgcggcaacgggcggattcctctcctacgctattaggaaacagagacccgcacccagaggcggagctggcgcacctggagctagagctggcgcaccgatcgacaacaccaacggaggcagttctgcctcacaatccagcaaagggaatttcatagggtataacattctatcgctatctctgtttttgttacttctgttagtcgcaatgttattgcattctctacatgatgatgatgcttattctatcttaagcatgctcctggttatgtttaattttatctctagatcacttcacattgttcatgtcatgattattgtcttaatattttggattaaaatatgccgatatatgactatatttccaacaagggaaacctaactacttaaatcatagccaaggtgacaacatcctgaaactaataagtcatgtaaatctataatcatccaaacgattaccctaaagatgtacaatagtaaaaatataattttagtgcagtggtgacttatacctttgagagattaaaaaaacagaggtcatcaggaaactatgatgccttgtgaaagctacaatttatcgagcagaatcagtggcagtagaccgcccccgttattgaaagttgagagtggttagctcgaagctgcactactgatgataattaatggccagaaacatcagagatgatgaaaaattcagtttgcagcaaagcaatgaaacaaatgttgtgtggtgctcaaatgtctaattatactcatatagcaagcaattgatctgacatctggatatatagtgacatttatgcatgtgtatacaggttgtgcacttgtgcgaaaggatacagcatagattcattaagtaaattcaaaggaagatacacatagaaaatgtcagttacagatgatgagagaatcaggctgagcaacagggcaagtacatggtacttcttgttggtgatgcgatgggatcaggggaagatttcaagtgacgcagaagaactatatattgatcggacggtctatatatattgagagtaagctggcagctagatcgacgataatgatcgtgataatttctgggttagtggaggaagatggagaggattacatggcgcaataaaaacaaaaacaatcgtggtgatgggtggaataaaatggattaaatgcgatcattcgcctgctctttcatggcgacagtttcagcattggcgaatgatttccatgggtggaaggagcgcagctttaccatttgattaggaggtgggtctacctgggctgacccagcaatttgggcacgttttcttgtaggtaaatgaagatctaatggtatatatctgatgtacatattgatcgaatggctgatatgatgttaatgacgtggcgaattggaggtagctttgggttttaactttatagaaagaagggataggcaaggaagaaacccaaaagcataaatatttaattagttccacggaatgagaaaacaatttatttctaaaacaacactaatatctaatttggcagatagaccactgaaaaaatctattgttcactgcattccaaacaaatcgagaaacttaaccacatgtgcatgcatctcctgatcaactcatcccccctttacttaatcatctaaaccttctttcagaacttttgccacggtataaagggtatgatattttcatgcccacaaagatgcagcttaatttaacatacactcacctccaccacaggcagcgcatcagtccaactccctgacttaataatctaaccttcttccgctgcctgatgcttgccctcgctgacccagccgccgccatcagctggcgcacgtggccaggagttaggcggagggggacggcgacagcggcgcataagttgatgagacctgaggtagggcaattgtaggtgagcgagccgacggcgtggaggagaggtgattctagtccaatggagacgagatggggagaagggaaatcacggccagagaaaggcgaaccgtcctgctcgatgactccgctcaccctaactgagccttctcacaatgcgcctggagccgagcggcctgaaccggatcccgactccatccacgcgtcgggcatccgactcgggattgcagggattggggtttgcagctggtatccacaacgtgcgcaagcgtgaggagacgtgcggagtggtgggtcccacgcagagtgggagagtgctaattggatgagagcaaggctaataatacagccaactactgactgtatagatctttatggcatatctatcagctcactcatatagtggttagctcttcagtataaatatatagttcatctatctatttaatagattatcttggttcctgtacctaagccagctgtaaggttacagcccgcttctcatctctctcctttcctctgtcatacacctcagcatttagccttcttattgccctctattatacttgctctgatggatccaactcttggtatgaaccattggatgaatagatctaagagttagaaaatgcttgttttgatgaaactggtgtgttttatattagtagagatagagatgttgggtgactattgcaacttgattcttgtcctgaacaaaaagacacaagctcatcaattaaggtcaataagcagcagcatcgcatgtacctaccctctcaccaattaggagaccgcatcatctcggcactctcgccaggcaacaaccaccaccctacgcctagaagggtgttggttgggcgctggagtgggaagcgatgacggtgccgatggcctagggcatgtgcaggaagaggcaacggcttagtatgcgcgagacgggcagttgattgggccagtgaggcatggaaggaaaccggcgagtaaccgcatcagtgaaagccagggacaagactcgagcccccctctccctcatagcgcgaccaagatgtgccctcgtgatcgacagtgtgtgcagtggaatggagactagagagcatgcatgaggcggtgggctaggggtgagtgcagtaggcggtggcagccgggtagggcaagtgtgggaggaggcgacagcggcttagtgcgcacgatggtagcggtgggctggattcggtggagcggcgttttctggaaggagtcaggagtggagaagtgttattttttaaccgaccactattttggcggtgtgtagtggacatcgaggggagggatccctaattgcagatgttgaatccaactcgtaatatggaacaatgttagattaagagatcctatggataggaaacatctgtgtacatttttctacgagatgaaactggtatattttatattagtgtagatatagaaataagagaatagatgtatggggagtgagttcagtcaatgacaagtgggttgagatgagaccttgttaatcttaccattttgctagctagctcacattgtccaatagaaaacatacagtaactatatacgtctggttcagcactgaacccaacgaaccactgaccaacttggtgatgggtcgaccaccggtccagtttttttcactatggtgtccacgaaacactcgtccgcgtcaacaaaggtgggtgcatgtataaatagtcaaatgggccaccagacacgtcctggcccgagcatgactcgaggaccgaccaacttgtcatgacgtgccgtgcccgcccaccgactacacctacggcccaggcgcggcccaataaagcacaggttgtgccatgccagcacaaaggcacgatcagcccactgtgctcgtccttcaataaagtctattgtacctcactcatttctttggtccatgcctcatatggctggaataagtttattttacctccctcatctctttggacagtaccttatatggctggaataagtatatttttctcccttatctctttggcctgctgatcgttgggccgtgccgtgccaggccagcacgtcatgctgagaaaaaggcctaggcatggtccaacggtcaggccatacctaggcagccatacattggtgaggacctagcactatggctccgtttctcctctagtcgaatgcgtcgaaggcctcaagttactgtcttatggggctggaataagtctatttcgttttccttatctctttgggcatgttgatcgttggggcgtgccatgcttggccgacacgtcgggctgacaaagaggcctaggcagtaggcacggcccaactgttgggctgtgctgcgcatgtgccaagccaaatctccatgctgtgagtcaggctattgggctgcaaaccttctggctaactataggcgcctaggcggtgacacatcggtgaggacctagcactatgactttgtttctcctactagtctaatgcgttgaaggtctcaagcttatgatatggcttttcctcgcattatccaattagagacaaacctactggatgcatggattgctcatcctcgttgtcctaggagtaggggaaccgagaaaatgatcttggcgaaactgcagcagatgtgaaggggggaaggggagaagaaattcacgcctttggaagagtgattcatcattcaaagggacaaattgagtgggcccgaggaacaacgatgaaaattttgtggtaggagagagaaggacagtacatttgaggtggcatatggacttctaaatacgattatgtttcctttttgcttctcccgcgataacaaccatggacggacttcacgctatatgtgcattcccaagccagacttgtagatgacagactaaacgaaccaactgtgtgtaacgaatcatctttatttttataatagataaagataaagacataatagatagatagatagattgattgataaataatattaatatatactcgctctgattcatattataggtcatttgactattttactactttaggtcgtttaggtttaaccaagtttataaaaaaattatcaaaatctactatactaaattagtttcattaaatgtaacattgaatatttttagataatatgaattattctattcctctcttccttttcgtaaccgcagattagtggaggcgggatagctaattgcaggggtgatccaactcttgatataaaccgttggatgaatagatctaagggttaggagagacaggtgtttgatgaactcgtactttttatagtagtatatatgaaacggagggaataatagatatgtaacgtaggccgctccaaggttacaagaggagtttaatttaattattttcttttatcttttccgtcataagtaatagaaacaaatttataaaaagctcacattacaaactataatgagcgaggtaactttacaagttaaaagtatgtgcgcatacattaaagggaggggtgtattttacaattaaagaactgatgaaaatccaatagcctgtgcagatgaacaggtagacacaactgaatacaattacatatattgtagtactccactaagtaaaccgattgtcccactaaattagatgtgcacaactagatcgatcagaaatgatgaagtgacagtgataaaaatgtgctttggtgaccattagctgtttaagaacctttgcttgaaatgtgtggcaacaactacagcgaactcataattgtcaagctcttcttgtcatctttgttcaacaaaacggccatctccttcttgaacctcgccatggccaccctgggcagcagcatcgacaccaccgtcgacacctcgccggccgagttcttgcacctcgtgtggtcgcttccgagcttggaggtgagatcgcctgcgagcggtatgccgccgccggcgaactcagcccacccgaacttgagcaagttcacggtggtccacttgatgtcggagacctcgtacaccctgtccatgctcgacggcggccactcccgcagctgcgccaccgtctccaccatggcgctcatccgctcccgcgtcatcccgcgcttggtcctccgcacgagctccaccgtgtcggcgagcggccgcccgaggaggtcgccggcggcggcctcggcgacgggggagacgtgcgcgttgccgtagaagccgcgcgggagcggggtgtgcgcgttccacctcccgcgcgcgttcatggtgatcattagccggacgcggaggtcgggcccgtacccgagcgccgccgtgcggcaccgccacatgacggcggtgagcagctcgaacaccgtggtggagtccgccaggtgcgccggcagctggccacgcaggtaggacacctcccgtggccggaacagaaagtactccaccaccatccggtccggcggggtcgacagcatcgcgtcagccgcgnggncggcgcggcgagcaccgttctgtagtgccgggctcgacgccgaggccgacgccgccgccgccgatgcaaagggcgtgcgtgccaccgcgccgctacctaggcgtgctgccgtgagtaggtccctcctccatacgggcagaatggtcggggctggctcaccacgtgcgaggtcggctatggccatgatcagctgcgccatgccgaagccgtcagcgatgttgtgacagatgtgaaagcccaggacgaatccgccgcatttaagttgcgtcacctaatgaaaccgccacatatagaaatcagtaacagtcaaattaattaattaattagacatggtaagtatggtacctccatcctaaacacttctatatgacattggtcagctcaatcagaaataagaaacagaggcagtatatattcttataaaacattaaaagaattcttccgtgctcgagtattgtcagtattatgtgaaaatccgaccttttatgttagtatgaatatatagtcggaccatgcaacttgatcccatatgtatatgtgtttatatatctgtacaaattcatatggatgctagtgaatttaaatgagggatggagaagctaaaacgttttataatattgaaaataatacaacacaacattaccacattcttaattcgcaatcttaatattgccggcccatatatatatcatccaactgcaacatcacactccagttggaacccctcttgatgggcccaaagccagtccaactaatcgttgtgttgaataaccatttcaatgcttttctggtccaatcccattcaccactacttcagactaaatcttagttaatgtggctgttgtatttgtattttaagtttttgttatcaaaatatgatgccacattcattgtatttctcatgtttgtggcagtgttcaaaagaaaagcagtttggcaactgaaaactataaaaccaattgcacagaaaagagatttgttaactccagaactaatttgtgcataatcaaatctgcaaatctaaagttggattatttcttgcgtaaatgaagatcagtgggttgctgtaattaatagtaggtacaatccctaccaaccatgcacgaagctaccatcactgttctcgtaacaatgtggcgtccttacgaatccttattaagatcacggtccctagtaccagtgaacctaaacccaaccaaagtaatattgttgtcgaatgaatgaatcttgatccatgcctacaaccaatccatagggtaaataagatggactgtaaattaatcatgtcactaaaacacaaataaagtatttagctacccctccaccataaaatatagcgatataatactggattagagacatcacaataaatataaatttaaatataccacagttcagatctgtaatattaaaatatgttttatttagttggttatatcttaggacggatatatagtagacaggttagttaaacattaactgagtggtggattgtaaacaaaaatgaaagaaacaaacgtacgtcgtcgtgggtgttacctgcatgaggagcaatggtttgccaacga

SEQ ID NO: 21465 - DNA, 299 bp, Oryza sativa
taggatgcctcaactgcatacatcactgcactttcacttgacacctatttaaacggctcgtctcgccgctaccttatcctatttccatgcttctgtcgctccatccccgtatgggtggagaacccgtcacctacgcccctcccctctcgcaggcacgggcgtgatatcgatccagtggctcacatgatttctgtcaaatttcagacaaaatttgatcaattttcgcctgttttaaacgatcatatatatattaattgatgcacgttgtgaggagcggatgaaggcgcgggcggagcggc

SEQ ID NO: 21466 - DNA, 627 bp, Oryza sativa
gatggagaagcagaaccaaatcaaaaacaagtcttgcaaataacccttgagatttgcaaggaggatgtcctttccctctttgttcagaatctgccttcgcttggttggggagtaagtgttttatcacttaaaatctgtttgcattctccatttaaccagcctgttgaaatcgttagctctgaattgcaggtacgaaaagatctggttcactgctggtgcattttgctcaggcagaagtttgatgagagctactgctgtgtgaagtacattgaaaacccaatctggagcttttagatttcctagttggctggtaacacatcaatttcttgacttaatatcacagataatctttcgaacttctagtacaattctgtagtaataacatgatcgttcagatatttacaggatattgactactcacggcctttagtcagtcagctgtcacattttctcctttataaacttttgtaattgttggttattgctttagccatagcgtacattcaaagtgtcctgcactttggagcctaacttgtggtttcttggtcattttctgcctacagtgtatcttttgaaggataattataattgatcaactcttgtgacagctacaagaacttggacgtt

SEQ ID NO: 21467 - DNA, 471 bp, Oryza sativa
caataaaaaatattgaggcaaattcgagatatgttaatgataacagccatgtacacttacaatgtttgttgcatttgtttctgatacaaaaccatctttatctagcatgatggcatcctcagcctgtgcaagggtaccctctatctgcataaaagcattagcaacttagtgctattacaattaataaagggctccatttaaaaaaatgtatgtaaggacagctatacaaatctaaaggataaagtacctttgccagaatattgttgataagattgttgcgatgtatctttgaatctatgctctgaaaagtcgtaagagcagccaaagtcaatgtttattcccaaacaccaaggggaaactaaacaggatgctttgtgaactttcaaattaacatggatcatgtatatgtttccaaatggaccttacattcggagaattacgccgcgtggtggcagctaccaactttattcc

SEQ ID NO: 21468 - DNA, 846 bp, Oryza sativa
tgacggaatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccgacccccgaggcccgtcggagtccaggcctcgggacccgaagggagcgctccaagctcccttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaaaagcatcacggcccgttttggagtgcctaaccgtattattacggataatggcacccaattcactagtgaact

SEQ ID NO: 21469 - DNA, 428 bp, Oryza sativa
ccctcgcattctcctcaacacccaaagagccaataagatcagaaacactgaactcttgtctcttgtgctttagagaagtgacaaagtccgaccaaaaaggtggcaatttggcaataatgccacccgccacaaacttgtccggcaactcacaattgttgttctcaagctccttagccagcatctgaatctcatgagcttgttccactacagaacggtcatcgaccatcttgtagtcatagaacttctccatgacatatagctcgctgctggcgtcagaaactccgaacttggcctcaagtgcatcccacatgtcgttccctgaagccattgtgcatatacatgtccactatgttgtcagcgagtacattgatcaatgctccacggaacaggcaatccgaagcctcgaacttaacctcctcctcaagaga

SEQ ID NO: 21470 - DNA, 584 bp, Oryza sativa
ttcctgcagccccgtgttcatcgcgctcaaatgctacctgtcaaatccccctgtacttgttgctccccaacctaatgaagaattattcctctatattgtcgccacaccatattctgtgagtaccgtcattgttgtcaagagagagaaggtgcaaagaccagtttactatgtcagcgaagctctccacgacgcaaagacaagatactcacagattcaaaagctgctttatgcagtaatcatgacatcaagaaagctacgccactacttccaagcccacagagtcacagttgtttcctccttccccctcggagaagtcgtgagaaacagagacgtcgtcggctgcattgcaaaatgggtagtcgagctaagccaatttgacgttcactttgtgccacgaacaactattaagtcccaggtcctcgccgatttcgtagctgactggactatgctcgacaacaggtcagacagtcagaccgacagcgagacatggacaatggcgttcgatggcgcattcaatagccaaggagcagggacagggttcatcttgacatcaccttcgggagatcagttcaagcatgcaattc

SEQ ID NO: 21471 - DNA, 3690 bp, Oryza sativa
gtgctatttatccagaaaaaatgatctcatgacaagagatggtggcaagttaatttgttgcatggtcagttactggtttttaagtacaaataaatgtggcttaatctcagtccttgaagtatacggaatggcacatatttggccaactccaccctgtagagttatattcatctttaggggatctggactcatgttgagttttagatgtttagtgagcattagctttaaaaaagaaggggtaataaatatagatatcgtggtgctattttgaaacagtccatatatgataatgtagatcgaaacaaaatttctcatggtctagattctttcttcaattagaaggctagtaccacacacgaatatgatactccatatgtacatacgtatttgatttggcctagctaatctgctcgagtaattatacaaaagaatctagcttagctcatccatgaaaagtagatgtataaatgtcatgacgcaaccacagcatgctataatacagttgccaatagtttccagtattgcaatccctatagctagctttaattaaacaattgaaattagtaagaacacgtgattacaagttttctagtggaatagtggcgacgaagatatgatgcttagttggtgacaatgaaactgcataaccagcatatctgcatatactttgcaaagcaatgagcaaaatgcttaatcgagcatgcatgctctatgagagagacgtaaaacgtttaccctcgatcatgcccataatgcaaattgggcgttaatgaaagctttagcttctccctttatttcggatatcaagttgtttaatttcttggaataatatatattttagggtatgtgcttaaacgatactagcgcacctagttcagcccataaggatgaaccccatttgtttatacttcagcatttctccctcacgtacgtgaaggctgtcttagaaacctgaggaaacacatatactctctcctcaagaaacatgcatatatactctctccattccaaaaaattaatatagatgcctttaacttttattttttttcacctctcaaccagtcacagccatcatattttatttagtgttgtttatacctcgttccccatttcaaccaatcacaaccatctatcattttattttaccttttttttattgatactcaattgtaaaagtctttatattttcggatgaagtgagtataacgtgggatatgatttcctttatttaactataccatatataataaattgtttgcaccggctaattcattagttcaaaagattatgctaatgaaaaaggtatggatgttatctattccattatttaaaaatatatggctaagcaatagagatgatccttgtgcagccttaaatctttgccatatacctatatgactccaagtttttcccttgtcccctgtatggctccgattttttttgtattgatccctatatagccatttagttagttctgcactagatttttttagaatgattattttacccctcccttatgtacatgagttagctcaaaaggcataattttcaatgtaaaccaaattttaaatttataactaaaggagataattatatcaccccacatttaaattttgtaatgaatttctttgatgaaaattttaaatggaattttcaccttctctctacatggggatctcttcaaaagtagttgaagttgtttaaaacatatagaaatttggtttctaataagtagaggaaaaataaatgttgatttgtgcaatttccctatttgaagttttattaaatttgattgcaattcatttgaaaattttgaattgtcaaacaattatctcccttcaattttccgtactgaagttttcgccttcatgattatgtttcactagctcttatataaagagaggagtggtaatatagtcattctaaaaaagtaatactcaactcacagtcaacttatgaaatggatattgaggagtagaggatgtgagacaaagctcggaggaatgaaaagggtagagtaccgtactcgagggcacacaaggaattttctctgagtgataatatgtttaattaacaacatgtacaagaaagcacacaccgataaacatgcattttacatctttaagaaataaacatgaatttattgaggaattatactgtacttcctcttgtccttgctttacgtattatagtgcaaaattcctcacacctcacgataaaaggtgtagtggtcggtagatctccaaattgcaggaaaaggagtggacacaaagtttttcatcaaaaactaagacaatctcacaccaatcaatcgatgtgaagcaattgagcattcatgaaatgcatgataactcgtgctgattctccatggctgctgtacttacctacatatgctccgtaggagtataaactagtgacactgatgttcttgggtaaagcttgcaaaaaaaatatgtggcacatcattgatttctcctcttctttataagtggcaactagagaattaatcctagtaacccagttttggccatgcatatattccctcttaaaaatgatatcatgattaatatagaaagagattcgagccaaaattaaagacaaggttgcttgacctcgagatgctcatgttccagaaagaagagctctgctgaagctccatcagagagagattcagagatgtttcgcctcgataggcttcagcttcaagcctgcatgcatgttcggatgttctgttctgttcgtcgcctgaagacgacgttagatatcaaggagcattttactaggttggatccgatcattgactgcacaaaatgcgatgtaaacgttgtactaactatgaaggaatcaagatggcaagagaaaagagtggacatgcatgtttccctgcaaaaagaaaggtaaggttcgtcagatacgctgatcgagttgtgcatgcaatgcaggctttgctttgctttggtgctgcatcgacatgacattttctgccccaaatggtccccaagtcaccaactaagattgttcctcttgtgattgatcagcatctagtcatggatcgatcgagctcccaaccaaaaggagagaggtttccttcattccccatcctagtgtgagtactaggaccattggaccaatccttcatgaagaaagatgctcaaatctgagctcctttttcatgttgcgaccaactcagcagcataaagaatccattcgagtttgagatgcttgcactgttgcacaggatgggagaagagagctactccatccgtttctaaacgtacttatcagccttgactcagttctatttcaaccattgaccatcaataaagaaatatagtttagtttctaaattgttaggttgtgataatgtgatggagaaaaatatatatggttaattatacctcaattccataaggtaaggtgttttagtttcatccaatttatttaacttcgacagagtttacggaaaaatacaccatcatctacagcatcaaaattagttccactataaaatatgacaatgtattaattggtagtaaaaatgtttatttttctaaatatttgatttagggtcaaactaaaacaccttataatttaaaacgaagagagtatttagctacaatatgataatatggtatgttttaatatttgtaaaattattgctgaaaaataagggtgtgttcactttgatgc

SEQ ID NO: 21472 - DNA, 2369 bp, Oryza sativa
atgaaaaaaaaagtgcattgaaagaagttagttctttgacatattgacgcactttaaagatctgagatctatcactgcctctcttttgctccccttgaaaagaggagagcagggcggtccctgacaatcataagctgattcaaccttcacaataataaaaccagtaacttagtagtttgcacttgactattgtaccatgtaatgttaatgaatgcaaaagcaattggttctcacagactaggacttgatcgcattcaaaaaatacaaagttgcagagatacaacaaggctgaagatcctcgttatgctgtgagaattacatgataaggaacagtaaactgacaaaaatgtttagtgactggaagaaccatgaatatggtagcgtatactatatgatgattgccatgagaaaaccgatcctgctatgaggatgccagtttcctgagaaattcaggcactacctgaccacagcttgtaagaacctcagacaagggttttgcaagcagagcatcagcgctagaaaagatgcaatgcacctcccccacaagcacatgacagcttgcaccagcgaggatttcaatgtattcgtcaactgaaggaggcaagtctgcaaccaacacagtgtcgaagtcctcaaaatttgccgttgttatgttctcccagtctttcacaaggacattaatcagcccaacactgaagaaaatccagagaaatgtaagttgtcaaagtaaaagaaaagcagccaatctcaaatcaaaagataatggtgtgactacaattccctttcaagtaaacccccagtcttagtgaccagttttcagcttggaagagtttagggaatgttaggtgcattgcacagctcttggtttgtccccatagataggatgttcggcaataaactacatactgtaaatattttccatacctgctgcatatggtaaaagagttgccatgcgagtcattggtcacggtacaattttgcaatttcaaggatgatgacagatgctgtgcttcatgatcacttgcggttaccagtaggacctttgcagtctttctagcatgatcatttagaatttgttcaagaatttccttcacctgcatgttggaaaagcccataagcttaccatggcaggcaaaaaggcatattttaatcgcacaagagatttgtaactgtttctgttccaaaatcacaaccgtgaaaacagtacatgaggttaaaaggcttaacaacacagagaacaaggctacaagagtaagataggcagatcaaggcttagcaaggtgatctaacagactaatcttcagtaacaggaagcagattcctttaagtgatattatgaagccaggatgactgtaaaggaaaactatttttcaaaggcaaggacatggagcaaataagtaatgaactagcaatacatcagtggttattggttatgataattaccttcggtgccttttggtcctttgatgggcatatgtgtatcttttgtgttatgaatgcacctctagaagtaactgaatcattcgtacaaagccttgtgatcttttttccaccgactagttttgttgccagtgcagctacccttcggtcagacgggtcactgaatatagttatttgagggttgctcaatatggcatccctaatagaacaaagcttgtcgctgacattaaggtccgtgaaacacttcagaccatcaatcacctgtcaaatggagtttccatatttaaattaaacttgactgtaggatgagtaggcttgttgggaataggcttctaggttgtataattgctaagagtatccaaaacttggagatacaaatataatttgatatgacaacagcattcgttttgcaaactgaaattacataatcactaagatggtgaatggaagtgttacagatgatctgtcttagtacaaagaagttcaacaaccaaattaactcaccagcatcgatacgcctgatatgtcaatcgcctttaaagctattagttcaagcagcctctctggcgtggatataaggaactccggttcgcaactctttaatctgaattgagtgtgcatgaaattaacatcccctaccctaacacgcttatacgcttacagataacaatgacactgataataggattagactgataattaatttggccaaaacatacccagaaatctggtgttcaatggaagcgccgggatgcagactgacggaatggataccaagtgatttcagaggcttgcaaatcgaacgcacctgcacaaaacaccatcaaatgaatcactgattcatcatttaggaatcaatcttaagtgaattaaccaaacgagcaaaaatggcggcactaacttgcacggccttttcctgggaggggacg

SEQ ID NO: 21473 - DNA, 4842 bp, Oryza sativa
cgccggctgcttcttggcgctcgaatccttcttcttcttcttcttcttcttcttcttggattcgtccctgcctgcggcggcggcggcgggggcgtctccggtcggctcgtcgtcgcccttccgcttcttgccgtggcggtcgttgaaggggtcctccggggtggggagggagaagcacatgccctcgcaggcccgccgcttgccggacttgcggcggcgcttggaggcgatgatgccggcgacgcgggccgacacggcgttctcgctgctgcgcatccgcttccgccgcaccttgttgcgcttccgcgccagcgcgtcgtcgcccttcgccatggcccccctccccttctcctccgctccgacactcgcggcggcggcggcgacgcgaggtgcgagacggcggcgagagagacggttagccgccgcgaccccgagcacgcagagggaaaaaacctagcgaagccactaaaaaggccgggccggtggtagtgggccacattttctagatgggcccacttaagttgcatcagttgctcggtgaggcccattactcagtgagacctatattggcccaactggagagtcaagctttagcatgcgttggcccatgagaggattggcccaccagtcagtgacagacaagggggcctttctttcgtatgggccgcataaattacgcagtggaatgattatgcgttcggccttgttggcaccaaattttagcatttctcatttttttattcgcagcagaccatacataaccatcacaatcttatgataattaaacttctggtcactcacttggtaattttagaaacatcaactcacacaaaactatactgataattctagaaactcctcaaaagaccatattaaaacttgccaccacatcttatcttgtcaaatttaccaaattattttagcttcatcgtgtagttttagttttagagtcccactccggtgctttatactcggagtagaaagtaatctgagccattgatcatatttaattgaaggcttaagatctagttctactcccaccagaattagtgggagtagaaatgtgaaggggtgttttcatccaggaaaaataattcgcgtagggtattatcgtatattatcagtctcttactcaccctatccctatcctatggattcgtatcgcatcgtcgccatttcactccatcccgacgccattcccctccatccccgcctccgtcgccgtccatctccctcgccatctatgtcgcccgtcctcgcgtctcctccccctccagcgccgttgccttctccgctccctccgtcgaagcccgtctccccgccatcgccaccttctcccccgcccgcatctccacgccgccttgtgagccccctcggtagccatcctcctcccccgctcccttctccagcgagtcgcctcacgtcgtcgcgcctccacccgtcactgccgccacgttctcctcgccaccagccctctccgccgtgtcacctccacccgccaccgccgccacgtcctcctccccatcaacccctgcccccttctccactcctctcggcgatcccgcatctccgtctgggatctccagagctccgccctatcccgccgctacccgcgtcggcacaccttctggcgagttccaccttagaccccagcaccgcgccactcgctgccgccgagccttcgtcctcctcgctatccccttactcgctgtcggcctcctcccccacgctcggctccagccccgtccatctccgcccgccatcgctcctgcagccgcgtgggagagcccccaatccatcgcccacaagcggaggacgcagcctctggatccaatggcaacgcacgcctggttccccttcgtccccatgccacctcaagcacctccttcggagcatgaggaagacttgccattggacaatagcggaaggtaatgcccggaaatttgcagtaagatgcactcccctaatgccgcccctcaactttcaatctcaagttgtttgtttttcttaaattttgatttgatttccgaggctacctgtttcctattaatctgtagcatgaaggatgagatgatccatctatatctgaacaactccaccatggcgttggcgatcccgagagaggcatgcttactgggtgctccgaggtgccatggcattgggatgctggtgggagcattcagtatttgcaaggagcaagagcaagtgcgcgaagccatcttggaaggtacgtgtggctgcttcgtcgtaccaattggatttggcacgcaatgttgtgctattgaattatgatgtctaaagttgtcatctttctgaatgaaactaatgttcacctgttgtgggggctttggaatgggtggctgttactagtggctatatttgcattggcattgttatgccaccatcaattaattacgagtagatgatgcgtggtgtctctttcctttgaactttggtgtccttttcaccaattatattgctcgttttggttcagtaaatacattgtttatttcataacagaacggttaatgttaacagcatttttacttacttactctgaaccacatgccggcgaaggggttctcggtgttcaggtgcgacattgaagcagatgcacgttggtgacgtcgactgcttactgccctgagtcaccccgaagcgtaaggtttcatataccgctccttctcaaatggatacaaatatgaactatgagtacgcggactggatggtaggcccatcatagcaaacaaaaagtttgattatgacagaaggacatttgtagaaaataagaaagataacatatagttgttgtgatctatgcaggaaggcatcgatgaatacataagaaagctagcagcgattctttacaactctccatccaacaaattttgaatcatgcacaggccatctccgaagaaatctaagatgttcagctttgtattgggaggatattctttcattaaattctgagatgttcatttatcattgagatgttttattttggagattcttagtttgtcttgtcggatgttcatttcgaataagctaggtgttaattttttaatattaaactctatctgttatttattaaatgatactcaatctcgttattcaacgatgtcagatgcggggacttattcttttttttggaaaaaaaataatgttctgctataatatatgcgcgcggtcgattgaaaaaccatgattttttatgataagtactttctgcgagtttaaagaaacatctcgtaccacgacgaagcacctttgtgcttctgaactgcaaatcttacgtaaagaagctgctcaatgcaacatcttacatcctgtcaaactgtcaaatgtgtaagctaatgttgtatcaaaatcggatgctacggagaacaaaatgatgtgtcagtatcattttttcttggggacgacatgttccccctggaactgttcctatggtttgcttcgctcctgaatcagcatcttctggaggcctgatggctgaggatgccaaatctcccaccaccaatcctttttggtggcttcgagactccgaatagagctatcgcaattcgaagttggaactagaaaaatatggacagaatgagtcctccagcagcatgtgcattcttattgatctggtaggctctgcatgaaaaaacaaccagtttcagcagcagcagcagcagcattacagtttcagcagcaccagcagcaccagcagttcagtttcattccagcaacaacagtgcagttctagcagcagcacaatttcgaatagtagcagtatcattccagcatcaacaatagcatcattccagcaaacagcaccattaaagcatcacacaagcatcacaaaatgaagtcaccattccagttgcagatcatttaatcctaatatttaaaaaggcaactaaatttatttgttcattacactcctttaaaaataaataagcagccttgcaacgcaaacaacagaactgtgcttgcgccggaatcatctcagggtaaccaggtgcgccacagttatgctgcccagggacgtcgccccaacgctgaactgcaggaggggctactgacctcctgacagggtaaaccacagctccatgatcgtcatccaggacctattttcagaaaccaagcagcaacaagtcaagttaggacacaggaggcagctcaattctgtaattttctgaaaatggattaaatcaagctcaattccgtatttatgtaatgtttctgacaaagaattcttttatagttctaaagcattttagcttatttgcctctgtacacatctaaaataaattaagtgcctcagtttcagagtataatgcaaatgcagagatggccaaattatgccctgaattctttattctttcagtttcagagtgtaatgcagatgcagagatggccaaattcaggaagacaggtttgatttgctataaaagagtatccatctcacagatccatcaactgcataaattcattgccactctaaactattgaacaattactacagttcccccataatggctgcaaattttgtatgtatgataaaagaactaaggcatgcactaataaattaattcaatgtactactagtactactgatgaactagcaggaaatgttggatgctttaaccagttgacaaggcaatcatttggtagaaaagatcaaagatcaattgcacaagatatgatttaacttgccacctttgctgaggtttaatgttggacttatattagtaacacatcaatttcagcaaactgttttgagtggaatttcaagtgacaggtgtatttcatttgcagcttaagaccaaaattattgttcagttttatcgttca

SEQ ID NO: 21474 - DNA, 8889 bp, Oryza sativa
aaggggaggagacgcctacggtgccggaggtggacagggcgggggcgacggtcggcgacggagagggcagggacaacgtacggggacggagggagaggagaaggcgcagagggtgggggaggcggacggcgattgaggaggcggacaaggcggcgacggagagggcgggggatacggatggtgacggagggggtggacaaggcggcgacgccgggggaggaatagcgacgagactgcgtgcaacggagtcggacctaatgcgatgcgataaggagtccgacctgatgtgatcgaaccaaagaaaacaatccatattaaaattacccctaaacgatattaggagattacttaattgccctttatatattagaagattacttacctgccctttatttaaacaatccatatcaaaattacccctaaacgatattaggagattacttacctgtcctttatatattagaagattacttacctgccctttaaaataaataaagggtccctattaggatttatacccatcaggtttgctttatggtttaaaacatgagaccagcatcctaaaaaataaaaaggggatgctcgagtaagatgatagagcttcagaatgctattgagttacaccgacatttgctacagagcaacattctattattacaatctacagtctattattacaatctagcactctataaaatctatcactctataaaataagtgtatttaaaaataattgaatgaaatcagcacacaaaaataaatttaaccaaatacaagatcgggagaacacattatttcggcaatgagttgaacaatccctaaatccagataccacagttcatccaagttcagtttgatgctcgattattattcatacagaggcataaataacacgcatacaaaaccgtaaataaacactcaaacaaagtaacaaacacacttcgaaaacaccactcaaatggcggctgggcgcccctactgcggctgcagctgcagtttctcgtgcagctgcggcggcgcgacgacgtcgaccctggcgacaccatccctggcgtcgccggcgaccttggcgacctccacctcgccgacgacgtcggcctcgcgctcgtggtcgccttcctcctcctcgtagttggggtcgttgcggtcgatggcggccgggaggggatcgagctggctgtcgacgatgctgtcggggccctcccaggtgaacttgccgccgcggccggacttgggcggcggcgcgccgatgccgcgggagccgttcgccgggtggcgctccatgcggtggagcccctgctggtccagcttccgctcgaagtgcctggccgtgtccgggtgccgcgtctccggcaccgccaccttctccgtcaccttcttcccctcctcgtcccggtgcgtcgcgcgcatgtacatcatcgatcttcgccgccggtaggtcggtattcacaactttctccggcgaattggttgcggtggttggattgcgatctgggtgatgaatcgatgagcgcagagacgcgggtatataagcggcgcgcggcgaggcgagcggcggaggagtggagaagaagagtgtgtggagagggggaggaggtggcggaggcggaaggcgacgcgtggagaggaaggcggtaagggatggatggatagggggccacgtcatgtgcaggtgtgtgtccaggtgcaacgaacgccgaaaggatttgttccaggtgttgcacgcagcacgcctggttggttgcatgaattgcatcgatagcgtcacgggaaatttaaagcccgtattattttctatcaagaaacacagtataaacacttagtgaaactataaacgtgcaccctacttataggctgagtttttttttccttcacttttccgacctatttctttcttttctatgcgcatgctttcgaactactctctccatttcacaatgtaagtcattatagcattttctatattcatattgattatctatctagattcatctatctatgaagagttttactcccgtccggcagtctgtaccagccagtactggtactaggaggtaccagattaaatctggccgtccaacttgaaaggatacgattggaaaacaacaaatagaagcggaacaattccggagtcacacgccgccgctttcctccctcgctgcgctctttctttcctccctccccgcatcggttctttctcatctattcctccatctgagcgcagaaacggagcagttgcgccgcatccacgccccgccgaacggttttttcccatccatctgccgtccgtggtcgcggtactggagaaacggcgcgctcgccccgcatccatgcctctgccggtgccgattttttcccatccatctgctgtccgcgacagtgtcaccaacaacgccgccgcattcacgagcgaagatgtcatggtattctgtgtcccctatccccctccctcgacagctcaagcaagtacctaacctcccccgctgccatggcgcagcctaggcccccattacggctcaaacactactccactatatgggctagttattttgtaattaacaattcaatctgccatgtttcttgtaatgaatttgtgagaaaagcacaagcttttgctggagactttaatctttgaatgaaaattttaagctcatctgtcgtccgttttttggtatgctgtttacagggcatgatctatcgttgaatggagcttttgacttaatttttgtctgctgtgaacagagcatgatatatatgtcgtattgagagccattaatattttgtctgatgtttttgctcgatctcctgtaaaatatatatcattctgtggagtgatcagcagcacaacaatggttacaagcaagtgttttcaatgaacagcaatccagctatagatgtaaaagttgaggaatcactggagtagagtgctagacacatgggcaataattactgaaaaaaagtataatttacatgattctgaaagaatgaaacaaacatactcgtactagtgtgttgtaattcagagtttcagacagtgggagatagataaacagaattctgcaaattttcagccaaacagaacgaactagaacttagcaagaatctaaaattgaaggataagttagacaacccatctgaagaagctgtaatttagagtttcaaatagtgggagatagataaacagaattcacatggataggttgctgagacatcaacatgctgagtgatccccatccattaattctggtaattgacatgtacaaaatcaacaatggcaagcatagtacatattatcaaatagcttcatgagaaggaacacagctacaactactgttcctatgaaccaatttctaatgtcatcagtctcttttttctgcttagacaacttcttgaatgaattttctatgtctgaaagccggtcatggtcaaccatttccagctctagcttcattttatctcttctgccttcgttttctcaacataacagttgagtgcttgagctgtgggcaatgctacagaataaccagaggttgaagaaggatgcccaccacgaaccacccgctgccgacgccattgccgccgccacctcactgacacgggcccaagcaccacacaccgccgccaacaccacctcaccaccgcagcccacggaccagccaccaccttctcgtcgcctcccatggaccacctactcgtcgcctcccacgaatcagctgtcgctgctgccgcctccgagcgttgctcccgtcgagcaccaccgccacctctcacggatcagagctgaatcgagatggatccctacgcgaaaagacaacattacccttccacccctctaactattccagtaccacctcatgggcaaatatgtacctggaggtaccgtataatttccaccggccgatcgagctaaatgaatggctgagatttggtaccgggctggttacctgctggatgggagcaatcctctttgataaaacttctataattccaaccatttaataatttttcagatgctttctttgttttaagaaaatgatatacgtacctaccatagtatcaaaaacttattagtagattttacgaacttattttattgtaagattgatggctcaaattttaaaagtttaattaaatctttttttcgtggggagtttaattaaatcttgtaatcataatgtagtaaaatgtttataaccgtacggatattagattttgagactatgagattcatactggacacaaaccgagcaacaatgcggaggaggaacacaatgaagcaggagtacaagagaaggtcacagcgagaatgaatcacatccaaatgtcccagcaaaatgacacatccccaactctaactgagagcatataaactatcacattctgtcagattctggctaaactgttcttatgttggcctgtttcatcccccaaccaaactgcaaactactcaagacacgtgattagatagaattgaacccaaacacatgtcacgtgacagccatgccacaacaacgcatgtcaggcacgagggcaacaaaaaaataggacaaattgatcctactcttgaggagtcaagcagacattgatgtcaggtgaaggcctgtgcaccatggactgcgagcttgcagctgcaggccacccaaccatggcgaaaccagtactggagctcgatgaattcaggttcatggcgcctctactctgctccacaccggcatgtgcttgtggaggcatggatgagatcgaaacctgcggcgaacggcagccattgttgccaggagctgcctgagaaatgggcatcgcagctgtgagcacaggaggaggatgaagaggagccatcggtgctggaaatgccggagcagcagatggttgtggatgtaggcccattcttctctgatgctgcttcaggttgttgggcaagaagctccccacaatcacctgtccatggagatattgtgtttagagcttcagagaaaaaaaatggctacagagtctaccatgcatgagtgacagagttaacaacgaagttctctatcttcagttgtaaaagcatggtacttggttcgactgaattacgttatcgaaaaatcgattaattttgtccaggttcttcagttgttgttgttgtttctttacctgaatagggctggcggctcgcagcatcccagctactacaccgccgacaacacggccatcagggccggcaagcgagacactgagcccgccggttctcctccgaacgccttcctccgcaattgtaaaggagccagtcagttgaagaatctcaaagcagccctggcaaccacatatccataaatgctgccatcttagagttcagtgaggataactgtaaacacaaatgtgtatgcacgtacgataagtaacaacttcgcttcaattgttatcctacactgatataggcatacagccgctctgtctcttaggcagggccctgtttggcacagctctagctcccaactccaacttacctggagccggggctgtgccaaacggtccagatcctccattttttggagtggagctagcagatctactcctagaaaatgaactatgggggtggagctgggtttttgtgttccacagctccactccatcctaaaatacctactaccctttaattttttagtctatttataaaaaatgccattcaactacccttcactcctctcatcccgttctctctcctccccccatcttcctcacgatgccacccgagctgcgggagcgggagcgggggagggggcgataggccggcgcggagaccacgggcgggtggcgcgcctggggacaacgtgtggccggcggcgcgcggcacgcctggcgacaacaccggccggcggacgaagcgcctgggaacggcgagcggctggtaggctggtggtacgcggccagcgattttttcaattttttttctttttttttcatatctagagctgaaacgtagccaaacacttttcaacgagtcttcaactctaataggagctagctctcacttgagttagagtttggagccctaccaaacggggatgggagtgggagacattagcacaaatcacatgctaatctagtaatataccactgttttttttggccgggcatcactgactgttttctggacaacgttattgagactcgcgtacaatttgcagacttgagcgtatactccctccgtcctataaaacccaccataataccagatgtgacacattaatatgttacatacagttctagattttttttgagtaaagtccatcatcgatccctaaacttgtaccgctgtgtcatcccggtccctaaactcacaaatcaaccgttcaggtcctcaaacttgttcgactgtgtcatcccggtccctaaacttgcagatcactcgtttaggtcctccaacttgttcagttgtgtcaccccggtccctaaacaggacggtctaaaaactttatatcaaaaaataatttataactttttcatgtgaactctaatgaagacaaactttatatcaaaattgtatccctcgacgtgacctacaactttgtagttgaaaagtttttgaattaaaactgtttagggtcccaaaatattgttgcatgtttatagattttgaaattttaattttaaaattacattttgggacaaaaaatgacttaaaataaaataattcaactacaaagttgtagatcgcgtcgagggctacaagtttgatataaagtttgtcttcattagagttcacatgaaaagttatgaattatttttaaatataaagtctttagaccgtcctatttgacccaaatgatattcaaatccaagttttgggaccgggttgacacaactgaacaagttggaggacctaaacaagtgatatgcaagtttagggaccgggatgacacagtcgaacaagtttgaggacttgaacagtcaatttgcgagtttagagaccgggatgacacagcagtacaagtttagggaccggtggtggactttactcttttttttttatgggacagagggagtatgttactacagactgccggaattgtatatgtgctatcatgaacatagaaaaattgggaagaagacttcacccttgatctgtcttcaaaagtggctcgcataaggtggttaagacttaagacaccattacagaaaaaatactttctcaacttaggcaagaagaccatttattgtatctagtactataaaggtggtgatactgaaactaagagattaggtagagacaggccaaaaaaactgaatagaccgacttgagacatacccataactccatcagaagttcaggcagccgtcaaattagctcacaacatttccaagtatcatactatcacacgatgcaaggagtgaactccatttcatacctcgtaggagaaggtgctaccagacgagccaggctggttcaatacaacatttgagatggtgccattggcagcgagaatgcaaaccgagcgaggacccttctgcgagaaggacattatgcgagccgccacatcctaccaacgaattgcaccaaagaaacagtcagtgttcatcctttcataatcaaatcacaatgccaagctaactgttaaaaaaaaaacttcagttatggcttacctcccctgtggcgacaatgatgacatgaggcgtgaagctccctccagctgataacgcataccattcccctttacaagcattgagaataccaatcagacaaagcgatgtgcactttgttgtctactaccagactactccttaactgaagtttatcctcatgaaaaccaacgaaatcgcccaaaggattgggtcgattagttaaaccacctaggaaaatcaccaaataattcatacatatccaaaggtttggactgagatgaatccggacaaacacaagagcatgaacagcagaaatgtgcttattcctaacggttattgactggtaagcagtagagccctcttcagctcaaaaggcaacattacacatcatcctctccactggaccccatgcaagcaatgaaacagaaattcacccccaaaaaaaatgaagaagagacaccaataacaagaacataaacatgaaaaaaaatggaaactgggtattttccaaatccaaagaaaatcatgtaatgaactctgcatttctgaagaagcaatatatactgacctagattggcaaggatctggcgccgcccggaccctttcggccggccacgacgccgtctggagctcaacccagcatgctcgccatggccactcacctgcatgctgccgctgtcccctgcacccaaactccgcgcggctggcgttgcaatggcggcggcggcggcatcctccgctcctcctcctccatggacagctgccgccggtggaggtgacggagtgggggacatcgacgacggcgaggagggagaagaccggtaccctttcgctgctgctgcggcttcttgttgtgcagctgcttcaaccatggaacaatctgctgttctgatgaacaggccgtagcctgctggcgctgctgctgcttcatggccacttgccacagcaatgcactcccttgatcttgatccctccatgtacaagcctgagagagagagagagagagagagagagagagagccaaggttttcttgcttgtttttcttggttttcttgcttggaccccacccaaccaaggaggaagcccaaccacagtgagacagtgagacccctcactctagttttgctttgggtctggttatccccaggcagccagcaagtatagtagtagctgggaaaaagaatttgaagatggggagatgacatgaataaaaatgagattttggaggtggagactgcacaaaaatggcggggttaatgtgactgtctctatctctctctcctttg

SEQ ID NO: 21475 - DNA, 10802 bp, Oryza sativa
ggtgggtttggcggcgaggtcgtattccttgtggttggccaggttaccactatatttaaggagctcttccccttctttatagggagcttttaggcacgggtacaggcgatggccggcctacagggaagactcaggttgccaaggcgaggttgttcccggtcagatcccataggccggattcgacgtggaggccgacaggcggcgtggcagaggtggcctgggtcagcgtgctagggagtaaccggcgtggtaaagggcgctggcggcagggtcgtcttccttgcggtcgggcaggctaaccctgtttggggagctcctccccttctctgtggggagcttcttggcaggatgaaggtggtggtcggtctacaaggaaaactctggttgctgaggcaatgttgttccttgtccaggcacccttgggccggattcgactgggaggccggcgagcggcgtggcggaggcagcctgggtcagcgcgctggcggaggtgaccggtgctatggcagtcttgtcattggcaggactggaagtcggccggtggaggggcgtaggtcaggtgtggcggaagccatgtgccgccggtgttagatggtggattcggattgagcgacggaccacggcagtaggggatttcgagcgaaagcttagcccaatttctttgggccaacagtgaccacgctttcgggcgtggtaagcctcctgagggcattgttgaggtaccccctccttccttggaaaggagctctgggtgaaaaccttatccagttctttggatggatgacgacggcgtctttcggcgtcacgaccctcgtgagggtgtcgttgtagagtcttcgcgccgtggtggtttgttgtcccggtggtgatcggtctcgcatagcgacggccggttccgtgcttggcttcctctctgtagcgtgtttggacggttggcacatggttcgaagcgtgtgctctggtgcacatcctttctcgacagccagctgttgatgtaaaacttttcttgtaacatttctttctatcttaattatattgaatgacctccttcgataattccggcaaagaagcaaaaggaaatactggagtatcaaaacatatgctctacactagaaattgcagggaagtttgtatataagagagcatgggagagggagtttcagtttcctttaattttacttggaaacaatgatgtcaacagctgtaactctggagctgtacagcagctggagcaaattttctgcagcatctactgcggcatgccggcatctactgcgaaagatggaaatgtgtgaagtgcagatcaaaaggatggatacgcaatgcactagtaataactgttgcatttattgcatttcagatactggaacatgcacaaacaattcagaatgaatactacagtttttccatgtacaacatttcagatacttgagcatgcccgtgtttagttgttttggtaaaaaaaatttacgtatacggacacatatttaaagtattaaatatagactaataataaaacaaattacagattccacgtgtaaactgcgagatgaatctattaagcctaattaattcatcattaggaaatgtttactgtagaccacattgtcaaatcatagcgtaattaggttcaaaagattcgtctcgcaattcacatacaaactgtgcaattggtttttttcgttcacatttaatgcttcatgcatgtgtccaaacatttgatgtgacggaaaagttggaagtttgaagggaactaaacacagcccatgtaaacaacattattcaggccacattaccaaatattcatttgcctattgttttcagctttttcatatcaagcggttagtgtctattccaaatctttttggaataggtaccttgcaaagaagcaagatctcctataactgtcacaaacattttccccttcaaaattgaaataattttctaaatataataatcctgttataacataccccctccgtttcacaatgtaagactttctagcattgctcacatacatatagatgttaatgaatctaaacacatgcatatgtctagattcattaacatttaaatgaatatggacaatgctagaaagttttacattgtgaaacggaggaagtatttgctaaacaaaataaacatgtataaaatatttaattagaaatcaatatgcccatttcaaaaatttgatcagagatctgcccaaaaatggcatgtttgtggagaaatggaaacctttatgaggaaaagggtaaaaagatagatcatactctgataattgaaacaaaatacaatgcaaaagagctgtatttcattactgcacttactttattagttgttagtaggaacccttcgtttgaaaccaggaattttaaacagcagttgccatccatatggacatcaccattcatgaaggacattacaactcatgcaaacatgggccatgcacataacaggataaatgtgctactataaattttactttcagcgtgataatgttgccagttgttagtttgttacgcagaaaataattttgaccttctttaagttttttttccctcaatcatttctattcagataaatgtttggaacagcattttctttctattacttgatctcaacaactgagcaatcataattttgttcagccaaacccacataagcaggatcactaatgacacaggtgtaatcgacatgaaaaccaatgcaaaatattgtgatagtatcgtacattactagtgattttgtgtgtagatacttgatgtgaatccccaagtcttaatataaagatgcgcaatacttgtatgtattctcgaaaagaaatttgtgtcttaatactaaaacagaccaattagaaacctgacaagtttatgaaaaacccatttttggtagacaaaaactagaaataaaaaagacagaaaaagactatccttgaagtttttggagatatttgacttggcagatgtggagtatggatcaattgatagccctctttgcttgatataagtactcacaaggagccaaaactcgccgcccaaagtttaatagtagtaatactaatagggtgattaccgataaggctttcatgattaaattaggcatgatggtggtattttatcctaacacaaggaaggggggaattctgatctcaaacttttttgcaagcctattgtagatataaaagaaaacaggacgagaggaagcagctagcacacctctgttgtttacaacttttaatatgctaaagaagtgaaaacaatacgggaaccaaaattataaagctgccagataataattaaagtgaaaacaaacagagaattcagacctagagtaccatcatatgatgctttttctaacctttcacatgaccttcaagcacccttcccagccaacaagctcccccacttggctgaggtctggggacaatacaaaaattactgaatgagttaacagatcgatgttaactcaagaaaagagaaatccttcatgacttcagatcagaaaatgcataccttctttatgataatgatatatatgtgaaaaaaaaatgtctatcacgctagctattatagatttcctcaaaatgttattagtattgttttgagattcacgctaaggtcgagtatacaatatattcaatgaaatgtggagcacatacctgtgggtttgcatctatgttcacagtaaaagcaaaaggttgtttacctcctaccttgccgatgtatatagtacatgtggcgatcgcgctcacccaattactaaatatttcagtgacttcaatgtaatatacagtagtttgtactttccaactgaggccctgtttagattctaactttttcttcaaactttcaactttttcgtcacatcgaactttcatacatatacaaacttttaacttttccgtcgcatcgttccaatttctttaaacttctaattttggcgtggatctaaacacaccctgacttgaagctgaaaaaatattggtctataaataacataatgaggatgaggactctatgatacggctttcactgacacaaaacaatgaaactaatgttattttatatctgaaacaaaataaataaactgatctatgtatagtgcagatctgggaatgacgcaaaacttcagaaatcactccgctgaacaaaacggaggtaataccgcaatacacaatgcaagcaacatgtgtggtaaaatataaacaaacataactactgaactagagtggtccaagatcaacaacttcaattaagcatctagtgagaaccgagatttcatatgcaaatacaaaatatatccttccattattcattctataatccttagtgttttcacaggtgctatcatcagtaaaattcatgcttctaacaagtcacaaaaggtgttcatcttagctctagaggttagtggtagaaaggggaaacaaatgtagtcatcatgatgaattcagggtggcaaacacattgctgcatttccagatcaacctgtgatttccgaaccattatgctaagtacacaaacacaatatggcaacaaaatgatcggcagaacaccgaattttaaattcggcgcgagagaatttcataacgaattctgggaactgcattgctgccaccccaaagaaaaatccagaccagcatacgtaccggcaacacctagcttgatttccccagacatcggagaacaagattacgcagaagatcgtgccggatcagcatcatcaacctcgctacaatgttgagtgactgtgttagtatcaagcatgaagatgagaggagcggaggagtttgtgggaagtgattgccggagagggtcaccgtctcaccgatttagccgaggagtttgagagtcgacgccgcgtccgtccacgacttggggaggagacggagacagtccgccgcagatgagggtaacggaaccgggcgattgacgaggccggcgaatcaatggtgggtttctgccgttccggcggtggcggcccgcctcgatcgccggcggccgcggctccgttcaccgtggggtgggggtggggcggcgccggcgtgatcgcgtcgtgggattggaccgattctccggcccagtgggccggatgggcccaggaggccgcatggctcgctcgttcatttcgaattggtgcgtgaaattttccgggaggaaagatgctatgttaaaatttgcatggtctgttcatgaagaatgaagatatcgatgatatcccagcatggtattttgagccaagagtgtgtttttttctgtgaaatatgtgtacaatgtctcctatgaaaacgagagagatgggaggagggtagacagggaattaattgttgcgttattcgatggaaaatcaagatttaggggatgttaggcacaactcaaatatttcttagagctgagtattcctagttctacaaattcatagatctggatcattgataatatctatataaatcattttatttttattttatataaaatataaagttttaaatcactataatttaatatacaaactctaaatccaacatggatataagatctggagctattctaagggtttgtttggtagagcgctctagctccaactaacatttctagctctatctaaaatggaattggaactggttaaagtgctatcataaaataaactagagatgtgaagctgtggtttaggttactttagacctaatctttaacttaaatttagagttagagccttgctaaataggcctaaatagaaccttagaaagttgttgaggtttaatataacaaacaagacgaagaagagttttagtttatggcttgtttggatcactaacgatttaaatcccgcaaaaaaaaaagaagtttctggttgagcaggggagccggtgagacggtgcaccgctactgaatggttccaaagaggatgatacatcaaggacaatggtgatgttaggttttggatctgttaggaagcgtaggtagcaacatataaaaaagtatattttttattgaaggtgatccaaaactgacatgaattcatacatcactatattagtttaagctgtagcgagttacatacttgatttcgaatgagctagttctgtactctacgctcttctcaccttataatggaatgataaaatgctcacgctttttaaaattctaaatggtgtattttttaataactttatatatatgactctctgagatataatttatttttaactctataatacttaattattcatttccgctctcgaataactatcataatcattcggccattcaacattcactctggaagggttagtgatttaccatatatactttgaacttaattttagctcgctgatgtttgaggcttaaaactttaacccttctcttaacaggtagtcaaatgttctagtattgcacacattttcagaccaacatacctatagttatatataccctactggtatatagtagaaagcttgccgttgcctaagtcctaactgttctttctttcgtcaagctggaccagtctggtactataccccaacctacttgggccggtagaaatgatcttatatttggccgctttacatgatgccattagccatagacaccggcaaattgccaaatcctcttacatcaaaactagttttgaaaaattgattgcaatcatctctgcagccagtcaaataggtcaacaacacgcacaggcatccaccgagtgaaatggttccgaaggatgatgcgttatcatttatcagggccaatagtgacgttatgttttggatcagttcggatttaggaggctccgtttcaaagttataagatgtcttgacttttatcaaagttaaattgctttaaatttaactaagtttgtagaaaagaaaataatattttcaactcgatacaaatttattatgaaaatatattcaattattaatttaatgaaactattttggtattataaatattactatatttggcataaacttactcaaatttaaagtagtttgattttgatcaaagtcaaaacgtcttataacctcaaactaacctcaaacggatggagtattatgttgtaggcttgtagcacctaacaacgagtttaatagtagagctaactattagctataaggttgaaactaatgttgaaactgatatgtataatagatgatatataatgttgtctttaattttcttctcttctctctttacctgtttaatccatttactttgaaatatgtgaaaagctaagtcttgcatgagagttaacatattttttatttgttttttatatagcatcatgtcaaacttgttattgtaattggtcgaaagggtcatgatacttcatactacaaacgtatacgacttattgttatcgaaggtgatccaaaactgacataaataattcagagtacatcattgggttagttgatatcgaatgagccaaagtatatagcaaaaaaataaataaaatgaagaaagaatgagccaaaatacttgagtgagaaggatttattagtatactttggacttaataattacctagatcactgatatttgacactaacgtgttagtatcgcacacactgtactagtatgatggaccaataatcgaacccacttcggccggtatctcacacaaacacacaagaaatgaaaccgaactttaaatttggacgcatcacatcataccgcatgacacagacacggggaaatcgccaaatccaccagcatcaaaacctgtaaattgtactggcggtactctcccgtctccactactgataaactcgtaattatccgtgcagtaatataagccagtcaaagaggcgatcaaagtggcaggcctgccaccgagacgaacaaattaaccggctgtccgcttccaccctctccatcattggaatccccgcgccgcggggaacatcccaaccctccctcccgcaccacaacacagccatgcaacagagcatcgcctccgtctgggtagtggatcctgaattccagaggtgcatgttatcaaataattatgaaataataaaattattttattaatacccctttcgtattttagtgcatgatgccgttgactttttctttttaccaaccattcattttatgcaaattttttttgcaaatatgaacatattatgtcatacttaaaaaaacatttgatcataatccagtcacaataaaataaattataattatataatatttttttaataaaacgaatggtcaaatgtaagtcaaaaagtcattgacgttatagaataacatatggaggaagtatatgatagatcactccacaaatatgcaaattaaaacaaattaaactacgatcagttaacgtattctcatagttaaatttgttttcgttgtaacttgcacaagttaaattttatactgcatatttgtggagtaatttatcacataatatatattattaatttttttatattttttgtaactatttgaaagagcatctatgcccctagtgggttttggtttattgatgacaaacgattaagggactaatgcacttattgagtgtataagcaagtgattagtcctatgaagaagctaggaaatagacttatcgatggatgagaattaaagagaagatattgaagatgcgggtatgaagtgactacctatggcaagacggtgaagcacaagcgacgctcagttgcgatggaccatgcggtggtgaagggcaagcaaggggcttggcgccgacgaaccgaaaccggtggtgaagggcgagtgaatactgtgtcgtgatgaaccgtgcgaggccatttgaagccatggattatccacattaatcatttgagaaatggaagatgaaatgtcaaagatcaagaagatgagatcttcccgatgatcaaatgactttgacgttggtaaccctccaagtgaagaatcaatatggtgtgaaggtactcctattggtataactttgctttttaaatttgagtttaggatgctgtactattaagagggataccacatgcatataattggttaaatactagtgctcaaaatgcttcatgtttgtgtgagttgaaaaacctaagccaaaatttttaatcccgagttgtttcacttgtcacaacacttacaccgggtttctttgcaagtttttcaatatctcttgaaggttttggaccatgttttatgttgggtttgatagcccacgaaactagctttccatagagtccaagatcttcgaaatcggagttcagagtaaaaagttattgcatttttgcttgagcaacattagactatccgatttgaaatcagactatccgatgtatcggactatctgatttttcacagaacttcactctctgtctttgtttgaaaaatcctttcgagtgagtttttctaagtgtcggagtatccgatgttggatcagatagtccaatgatacagagactccgaaatttcatggaacttgagtctctgtttgaagatgaagtttttgcttctaaaatatcagatactccgatttaatatcagatagtctgatgtctcggaaaatccgaaatttcatgaaacttcgttctctgtttctccttgccttggaggtttaaaatatcggactatccgacgtggactgaaagattccccttcaacggtcacattttgggggatctataaaaaccccccactaaccccttttctagggttgcccaaactcattttattcaaatcttgttttgggttgagctttgtgctaagtgctttggatctttgagctatctccctctctatctcaaatcccccttgttctttgtgacttggatctttgtgtgtgaatttggagtttgggagtctagtgtatatttcttttgatcttgagcactaggatttgtccaagagttgtgtggtgtttattactcttggaggttgaggactcctagacggctaggtgtcgttcttgggccaccgatctacgtgtggttgttcaagagaagtttgtgaaggccggatctcgcctccgcaaggaaagagatacccttagtgaaaggaggagtccatttgtgcaacctcacgaggatagggttgaaaaagacccggctctttgcgagcccctcaacggagactagaatcccctcaaggattagaactccgggaaatacatcggcgcataaacctcggtgatatcctcactctctttaccttcttgttgcattgctttgtggcatgctaatattgttgttggttgagctcacctctttgcttgtggattgaatctagatatcttaggttgttctcttgtttgtattgttgttgtgcaggtcagatagtctgatctcagttcagactatccgatcacatagaactatccgacctgatatcagacaatccgaccctgttttgttttagcttccgtatttatttaaaaatcgcctattcacccctttagacgatatcaagatcctttcactatttaattacatgtaaatattgaaaagataatgacatgcaaataacgaaaacgatattcgagaggttagaatagttcccctccgtctgctgcgcagcgctgggcgacgggacgcacgccgaatccacccaaatcaccccaacttctcgatccaccgaataatctcccccccccccccccccacctaactcggtttcaactcccaccgcgcaaacgcaacccgtgacaccacctatgctttcgcttcgcctcgtcgcctcgcctaaaacccactcgcgccgcgcgctgcccgcacgcacccacccacgtcgcgtcacgacatgcggaagctgagcggaggcggcggggagaggagggtggtgggg

SEQ ID NO: 21476 - DNA, 7416 bp, Oryza sativa
  unsure (1)..(7416): unsure at all n locations
cccaagtgttcggcctggagcccaagaacgtcgccaccatggaagacgacgccatgatgtcgctcgccaccacccgcctctcatggactaattccttcgtcggcagcgtgcattccttggtctatccttcagatttcgccgcagatacacatactccccggagatcattgctcgatgcaaaatccggcaaggtcttcaatggcggcgaacatgtccgtcggtttcttgtctccaggagccagagcttgagacaactcaaatggccaatggccgggaagcacctcatcggctgcatggtcagtgggagcaggtctccggacagcgagaggtggaagatccatggagatggtgatcttccactcagcttcagctactacgtgtcagccagcaacgacgattattccagcatcaattccccgttccaaggcgaccacacaaattcgaatctctcaatagtgttcgagtcgtcatcgcacaactgggtgatgaacgcgcccgcggtgacgacactcggcgccgcggcgctggccctgcattacgcgaatctcatcatcttcatcgagaagctcgccgtcgcgcctcgccatatctgcccagacgagagagatgccctgtacaacatgctcaccgatcggattcgggcatctctcagagctcgcctcaggccgatcgccaagaacatggcagcctcttcatcatcttcttcttcagcttgtgatcctgccatggctgcagagtggtctggcacggtgcagcgcatcctcggatggttagctccgctggctcacaacatgctgcgatggcaatcggagaggaatttcgagcagagaaatgttgcgtcgagcggtacaggtgtgctgctcctgcagacgctgcattttgctgaccagaagaagagcgaggctgccatagttgagctgcttgttgggttgaactacctgtggaaagctggaagagagcttgatgcaaaagctaaaaaattggtgtcaggtggtggaaaacgcgatgaattcacagattattatagtagtaataggatggaatgtcgataagatgcaactgaattggatgagcctgggatatgtaagcagaggtagcatcagattccctttgctgatttgctccttcaatccctacaattggcattatgacacgcatctattctgtaattgatgctcctgcattttagtgtataagtgtagggcagctgatcattttaatgtaaatttaccatgtaattcattagtgaagacgtatcaggtttaataaggtcaccggaacagaactgaaacagtgaaaatagacttgcactagttagtatgtttgtacatgatgcattctgaatcctgaaaagaaagaagggtatcttggatgggcatgcgtcttgtgcagcatctgcagttccagaatatgttgagaccaatttcagttagaacttatattttcaggttgttaggaagcgataggcaaataaacgataaataacaagagatcaatcacagaagacacgagatttaacgtggaaaacccttccaaaacaggagagaaaaaccacgggcgccagccagcaaaatatcttcattatatcggggtgaggttaacaacaccgaacaacggcttataacaggtatatatgaaggtgaaaccctaaaaggataacgattcgtaacaagcctctggcgacggacctccgcttcactccggtagaaactggcctttattatgtgcaaatgaatttggatcacaacttaatataggttgcactaaaattgctacacttaaacagtatcgtaatattggtctcagattaagcccatcaaggaaaaaattgttgggctttacatgggccgagctggccatcagaacatgatcaaacggcccacaggaagggcttcctgctccaactcgccgtcgccggccaccgccgcggcgatctctcccctgtcccctcgtcggcgatggcgctctcgtcctcccggccgcgccacctcctccgccctctcctccggggcctccacgccaccgcgcaggccctggcgaggccggagccgcacgagttctccaaccccagcgagcacctcggcagctggggggagcccgctggggatccccgcgaggcgtgggcgcggctggagcggctgcgcaagggctacgcgcgcgacgtgcgggctgcgggggcagtacgcctacgaggcgcagctgctcggcgccgagcggcagcgcagggcggaggcccgcgccgaggccgcccgcctcgccaccgacgagcgcaaggccgccgccgcgcagacgcgcgccgccgagcgccgcgccttcgaggactacttccttcaagccctcgtaaacatccctcctagtcccgcttcatcccccttcttttgcgttgatcacccgttgcacatgagttgcttgttgaattgccggagtgggagtcttacgattaccgtgcgggtttttttagaggatcaagtgaattacgttacttgtttgtagaaatgaatctactaatttaatttttttttctggtacgatatgttaaaaatatcagcgaaatgactttataactgagatgagatgatgtacagatgaaagtaagaggtgagaagctggagaactggagggagaaggagaagctcaaagcagataagagggcggaggacagggagctcttgggcaggaagagctctgtgtggattgctgataatgaactggaaaatagaattctcaaggctatcaaatttaccacgcctctctaaggacaacttttgctgctaaggtaacttgaattcgttaaaatttgtcaatcattccatattgcaacacgaagaacgctacctatgttttatctctttttgaaagaagaccgatgctttatggtgttatcaatcagtggcggagctggagcccaattgaggggggtgccccactttgccatatgtatggtggcataccactctagataatggtatttaaatattcctagacaacttttaactacaacatcagtgagcagcgaggaaaagtgcttaccgaaataaaagatgaaaggaagccatggagggaaacataaaaaaatataaaaaaaacaatcgatctatgaaaaatgtatcctgaattgttcaaaccctaatatgaaaaaaaaagaattataaacagtcacatagttcaaacaacgctatttaactttgagatttgcttggaacaaattaatcaaactaactagatcagaaataagaggagaaaaatcgatacctttaatttttgtggcatatttagatgagcaaatcttagcaagtggattgaactgcttcttgccatgctgatcgatcggttcctccagctacacgtaagagaagatgtcgacggtgatgggatgacggcggatctgttgcctgagggcattaacacgagtcagcgagtggtcctgatggcgattagagaaaaggaaaagaagagaaagagagatgggtctctgcgaacgaagtgatcgaggcgtcggtcctggcatcgagaacgagtgctggcgatctcagcgagcagcctattctcagccttctcctctgcgtatgggccaacggggggtacactgagttgggccaaggggggtgcccctatggtgaaacttaacggtaagcagtaaatttagaaattgggccaggtgcctgggaaccccccctggtccattgtgctccgcccctgttatcaatagaaaatgctgcagattttagagcggtagccctatgtaatattgccatcagttccattgattctgtctagatacagcgtaacttgaaattatgtgtattctgaactggataacttccttcagaagatcggggcttcaaagacagtatcttctgatacactattcatgcagtaccagtgtaccatctgtgcagtaaaaatcagaattttatttgaacttgctaaattgtaattgtggccaacagaaaaaatgcatgctttgtagtctgatgttttttttttgaaaaccatgctttgtagtctgatgtactaaaataggaagtctcaagagtatagcggatgttaactttaaagcaatcttcattacacttgaatcattttaactcttaaagtcactgggtccctgtgcttaggtagccactgactttggtgggtattacataattatacactcttgatcttccatgtgtattttttgtttatgcctattgggaatgctccttgcagtcttgtggttaagttactgatcattggcatacttctaccatcaaattctccaatacagcttggacagcagagggcataatgctatgattaacttttcatctttccaatttatccgtgcacttgagttagatgaatgtccaaaatgcaattgtatattttctgcagtcagtagttacatggtttagtacgtctgctcatgacaatttcttcttttgtatctttaagatacttttcctaccttttcgttagactaactatgactatgttctttcagataccgagaagcatcgttgttttccttgcacaagatactagataatgtcttctgagaagcaggatgtgggatgaactgaatgagttcctggaactaatcacagctgtctaagcaataacgatcaattttgaaaattccgctgcagcattgtatgttatgttggtggtggatgaaagtctaggtgaagttgtgttcaagcattccttcgcctgagagagacagctttcctcatgttcatgttaaaaaaaattctttcgcaattgaaattactttagcactagctggataaactgatttgtgaagttcaatttcgttgtggacaaactactgccccgattttcccataagatctcctataattgcatagtgcgtaatattttgaattttgcttttttttttgtatgtgtgtgcaggagatgttattgtgtgtgagtatatcaattcatgtaccactgtgccagtgcagctaattgctagtattatgtgttcatgattatgggcaaacataccatgtgttcaaggatatactccctccttccctaaatgtttaacgccgttgacttttttaaacatgtttgaccgttcgtcttattcaaaaacttttgtgaaatgtgtaaaactatatgtatacataaaagtatatttaccaataaatcaaatgatataggaaaataattaataattacttaatttttttaataagacgaacggtcaaacatttttaaaaaagtcaacggtgtcaaacaatttgggagtatatggatggtctcatcaatttttgcagcacagctacttcatgatggagtgactctgaactttatagtgtatttctttctcattacaccaggagcctatcatggtctgtactctgtaccttccacaaatggctgcaataccagatcaaattcaagatactacccctctcctctttatatataagcggtgttggtgaagcgagaagagataccccaacatttcatagaaaccagatgatcgagtagagtacagagagacaagagattcatgttagcacaatctaaacctcatgacaaacataacatgtccatgcaaatcaaatggaagtagtactacgaatgggatggattaggagacacaactacagtgaaagtgacggctttgggtatagctcgtagtcccaaatctctccgcgttccaatcactgcagtatggacaagctacataggcctagtggtgtgccagatgtaagagcgagtataataagatgatgtaaatgggctatatatattcacatatatttgtgcttatgtggagcagaaaaggagaggagagagaggaaaagcggcctatagattttatagctcgtagtcccaaatctctctgcgttccaatcactgtagtatggacaagctacataagcctagtggtgtgccagatgtaagagcgagtataatatgatgatgntaatgggctatatatatattcacatgtttntgtgcttatgtggagcagaaaggagaggagagagaggaaaagcagactatagatttatagccagctgcagcacgagctccaataaaccatgtaagagaaatgcggggaatgcactaatgatgtaatatatatctatagttgactattgtattagtaggctattgagttagctatagatgatatgttaatttttgaaactagttggctatattattaaactgattatacagttcttaggagctattgcgttaattaaaaaaaacttaccgttgatttggtgtatcgtattatcgcaatcacacatcgtgttgagagtccctataaataaccataaaaatatatctgttgatttagtggatcgtgttatcatgatcgtagatcatgtacaaatcccatacatatcgtaatacacacacacacactatgtttcacaaataatcctatatactatatactatgtttatagctattggctttaacaaggtgaagtgccaaaaagctattggcttcctttgttcctttactctgctcaggaatacggcaggattacattagctcggtaggcagtagtgagcagggtttacgattccgacaggcccttctgtttcaggtactggcggaatacggaatttcgcaaaatccggtgaaaaaccagtaaattctgaacaaatttcataaaccaaaatttgaatacaaattccctaagtttgccgacaagttctcgaaaaccggtcggttttggcgaaattctgatcgaaatcatcgaaatcagtaaatgttttcctttttttatttccggtcggtttttgcccatgtaagtgttttccttttcttgattatttattcttttctttcctgatgtaagtttcagtaaatacatacaatacatcatttttttcgaaaatttatatcccaataggttctatgaatatcatagtatttataagattttatttgatttttcttttttatcaattcaaattttaatttggatgaaacttctcgaaatctcagacgatttctactttcgagcctcgtcgaaacgtcgaaatttcacgaaatccggtcggttttcgtcggaaccctggtagtgagtacatgcccaaccaaatgctactattgcagcccctttgtagtgagtgcagtttaaactacgtcaagtgaaaaatactacactctccttaactatgagaggaccatagagatattcttcattaatggaaggtagcaaaataagagaggaaataaatacttatcagtagtttttcacagcttcctggaaagtactcgggaggtgatcgatgatttatagagttttttgctctttgttttccatgacaaaaatcaaaacttcacaactgtcatgtatagcagtgatgattaggtcagccatgagcatttgcaaggctagctaggaactggaggcgtttggaaatgctgcaaggcctcaacacact

SEQ ID NO: 21477 - DNA, 2743 bp, Oryza sativa
caggcttaatttcagaatcagtgaaatttctacaaattgcattatatgtggcatgattgaaaatgatttccatcttttcttggactgcccttgtagcaaaatcacctggataatctcagatatcaatctgaacactgacattttttctgataatgtctcaatggctcacattattgcttgcattgtaaataattgctctaacaaagcctcccttaatagaatcttctcaatcatgtggcaaatctggaaagcaagaaatgatcttaaatttcaggggaaggtgctcgagccaacacaagtctgttttgcagcagaagctatgatcaacacttactcttgcttgattgagcaacctcatttgcaggataacatcgaccagagcccttcggagagaagaatggaacagctgcctgaaggtaacagatgctatgttgatgcctcctgggaacataataaagcatgcattgggatcttttttcatcttcctgctactcacaatgctcttttcattaaagctttttgtcacttgactgaatcccctttacaagctgaactgcttgctttgcaattagctatggagattgctttggttttgaatttcacagacacaatcttcctcatggattgctcaacggtggtggacacagcgaagaaaggaaacttccatgaagatccaagccattggagtcttttacctatttggagtcaaatcttaaccttcttaccaggacatttgctcaaggtccactggattccaagacatctcaacaagttggcagataagctagccaaggatgctagagggaacccttcatcccctccaatctttagttgccaaaacattgctcatattgcttacccatccaatcaatgttttgcttctaccctaagatctagcctgagggctcgaaattgtactgtcaaccatgtactttgtttctgagcttaataaaacgcatggttttcaaaaaaaaaaagaacacatagaacaaagctggagatggcttcctcctctgccgagtgagacacgttgttcccctcaagactatcgctccaatttccttttctctggtctgaaagtggttgaaaattacaaatccatgggaccaattgatgtgttactagttttgcattacatgtacatcataacatactattcatttggctacataacttggcacacggaagaaattaattaaagacaacttcaattccggcagcatagtgagttagtgactggacagagtaaacgtttgaacatacatcgattccagttttggctatatggagtagattactagattaattacttatatcttttacagtgatcagttcttgtatttctgtgagcactgaccattccacaaagctgacgaattcaccattgttgtcacgatgatccataaagagatcgagccatatatatatatttttgagagaacagtcaaggagttcttacacttcactgtagaaaaagagagttgatccaatttataagaaaaattgaacctaaaactctggcattgacacactgaacctaagaacaatagttgaacaagggaaaaaccctaaaacgaagccttcgagaaggacacgccgacagaacggtgacatcgcctgatccaaatgaatctaaggtttttatccggagaaatcccttaatgtgaaatagagcatatctctcagcatggaattcgagaggaaatcctagacggccgttttccacccgttgcccataggattaacgcgattcaattgcaattatttccataattacgtgattacgcgtattgatcggtagcgccaaatccttccatgtttggattgcccccgatctccctcagcgccatactaataggggaggccggtatcgtggatagatgacgatctctccacgatcatcttctccccgaaaatcccaaaaacctatccgatcaactgagcgctggagggagaacgtgtgggggttctgggacaatgtaggtggctaccggagggccatcgttaccccacaagtgatgaccggcaaccccttgggaatcaagccggtgctaacactgcaactgttaccactactacttttacaccaacaagaacaaggagaaccgcatcaatgacttcaaataatggtcagttaaaccccaattccgcattagggtgatctataggcttagcaaattatatcttagtagatcgcaaagtctacaaatattgcccacacaccaaaactacctacaccactgcacaccgccaactacacaccgcaacaacgtgcacaccaccaatcgagccatatatatacacttggtcgatacatatgcataatggagcagaaatccaaagggtccagcccacagccaatatagtagaattatttacggtacaccatactagtatatatatgtatatgttgcagatgcacaatccaaacaccacaaaggcacaaactgggaagcaatggatcagtcataaccgggaataccagggcgtttccacggacagaagtcatggccagagatccaatccaagtcggccgaacgaaaatttgaccggtggtcggtggcaatccagctgggctgtgttcgtgcgtacgtgtggcttctggattggatatgacacagctgtgcgtccaatcgagggttttattcactcttcttctcgtgattaactaactccctatggacaaaggccacacacacatccaatgtataccaaaaatcgtatgtgtgtgccgagcgtatac

SEQ ID NO: 21478 - DNA, 5347 bp, Oryza sativa
aatcggggtagacagctagacaggagtaaaggacacgagatgagagcggatgcatttggggaaagtgaaggagaaagtgaaaatggggacttatgacttatctgttctcgtgctccgctttctttctttattttttttccctaccagacctctcttccttttatttttctcatttctctatcaatttgttgaggtaaaaaaatactactatttgacctcaaatgtaattaatttataaactggaaacaatactcccttaaaaatgaaaatgactaattaataatagatttaccaataccaatgacgtatctcgaacttttatatgggtgatccaacttatatataacaaagctaaaagtataaatggatcaaatatgcatcataatatattaaaaacgagccttttttcttcgttttttcaaaagtttcttttcacatacgtatatttatgtgttaggctaagaattttttgggtgatccgcccatgacaatatgtttattggaactgacgaatcgatattaaaatttatgacggtctcacttaaaaacacatataaacatgtcccgatttacatacgcaattgtatctttttccattgcaaacatgccggcatttctactatcacatattacaaatggtttaggagagaatttttagaagatgccattcgatttgctgcaccaccttcaggatgtgccactcaattcgcaacactttcaaaacatgccaccaaggacgtgaattgtttcattccgtgccgctctgtccctcccaagccgtgtgtcgtcatcttgctgccgccagcaagcttttccttgccatgccggcaagagctcctgtagtcggccgcactaagcttcgtcggcgatgtgccatcaaccaccaaggtgtctggacactacttccaccagctccgccatgattactccttcgttgacattgcggactctgccatagaacgacgcccgcttccacggtcttttcctcccgtatcaacacacgggtatttttctagtctttaattatatataagtagtggtgttggcaaataatagaaggagatgcgcctcaacatttgtagaaatgagttgacaattaaggggagcaaagatagataagagagagagagagagagagacgcgatgcatactagcatatgctctccgcgcaaaatctaaaactcatggtaactctgtccatgcattgacatggagggattaggattaggatgcattaggaaacacgcaagaatagtgaaagtgatgacaacccaagctcgtgtatcagtattatctcacagatacataccatgctgtaaaccactccactacataccatggtgagggatcatactatcagataacactcgttactttggcatgctagatcaggatgttcagtagctcccagaagtcagcagcaaaagaggcattatcatgtgtttctatcttctctgcttttctgcttttggaacctctcgaaccaccgtcatggtgtggtttccagaaatgaaccactatcattacatcgccttttggtgaagtgtataaggatgctactctgggctgaacgacttcgagaatagacttgtaatttcagcttggaaggatctcctcttttcctcctttcgttctctaaatctgtaacgatcttgtaatgatcttgtacttctaggcacccttttatcaatgaaatacaggtggggaaactctcccctcctaatgacatattctaaaaaaaatgttagatcaggatactaagtcttccttttaggattatcatagcaaaactaaactatattagctgagttgatatgtatcgtgaggtacggaccattctggatagctatcaaaatgtgccttactaattgatcctctactcaataatgtttggctaaattttggattgaagccaattcttttatcaaatcaatattgatgtcctacgaaattattgataataccaataaatataattggatagtaaagaaccaaaatgaccattttattgaactgaataaactttaaagtcattgaaagtttctccatacctcattgttctagaaatattgcataacataacacctccccgttaacactaataatgcatttacctttcaagacggtagaaacctccaattaattttagaatgaatgggcacattatgggtggttgaatcctaacgccaacgtcattggcccccaacaagtgtaataaatgatatttctattaagctacatcatcacctccattattatttttaacctagcatgattaatctacaactaaatcattttccttctcatttcacattatcacactgtcacgggcttgggccctaagtgggctggccatgaagacccaccaggctggaaggttaacctgctactccctccatccctaaatgtttgacgccgttgaccattttaaatatatttgaccgttcgttgtcagggttatgtatactacatacctaatagtagttgactaaatctcggcaggacgcaccacataccatgtcctatatagaaacaatctgcggatataggaggagttccggataaggaaagacaaccagagttctacatgaaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatggctattcccctacggtgtctccggataccgtcaggagagacgaaagcgctatctctgatctcgccgggcacagattcgaggaggaaggctaccctgttgtcgattacgagtcagatcttcagaccgacatgtcgataacagttagataggctaccccacatattgtattggtgtgattatggtgaataaaagcaactccggctccagccaacaggatgtagggttattacctgacagctcaggggcccgaacctgtataaaaatactcgtctccatctcttttacctcagtcttgtgtatatcctagcaccaacgttccccatactgtccaaataccatagtcgagacatcaaacgtcgacagtggcgcgccaggtagggggattttggtgctctaggatttcaacgagatgggttcaaaagacagattctccgacaacaagctactcgacgacttcgctgtggggagatctaacccgaccagagtatgtctctcgacgagatcggaaccatcgtcgtcaacaactcgatctctcgagatcgaccaaacttcaagacgtcaccgccacagagaacagtgacttgatattatcaactaggaggtctccgatctccatctcttcggaagcgacatcatcaactgatttttggtaacctcggtaatgctgctgcctgctcagaaacccggccatcgaggaaccaaaatcaacatctcgatctattcactggattcttttgggatttggatcgttctcacaccccgattaggatccaaattttggacccctgacgcatactgagaacatccatcccgacatcatgtgttccagggattattgatcacggatgtctaccaaggtatcgagaaaacaacaagacaaagatccaactaatatgcttgctcctgacgtgtacacatgcatatgcatggactcagtacgtgcttaggcatgcatgcattagttggccgacgtgtacctgcaaagaagaccaacatggctgtctaaattgcaacgtgttgattattcagataaatcaacggccgcccgtgatcaggtatttagtagattgattttttaaaaatggtctactaatttcgtagatacatccggcatgtatctacaaaggtacgcaatattttatatgcaatttatcgtacctattcagatgatacagcattgtcagatctataatttattacgtttacctagagcatgttttttatacaatatctattgcgcggatgtttccgacgttaaaccaactacggtctaacgctgggggctcactctgttttcttctgtataaatcatgcttgttcacggtttacataatgcttaatatttgcatctgcttgttgtatcctgataatactagaagatccatgcagttttttgagtacatactcgatattatctgctatatatcttgccttctaaaaaatatttttcaggaacaattgagcactcgagtaggttatggtcgagtacactccattatcgagaacattttcgacaaatgcggagttatcgcacccaacctaccaacaaagaccgacgccctatctcatagcatctgccatggctagactactcgagaaaaggttgttaacggataattcctcgcgaacgtcgtcggcctgatcacccgacatgattgcgaacggacatccggatatgctataagttgggtacgtgagtcatactagccacatgagatacacttgcaataaaccaactctagcacttccattggtgttcgagagataattctgctcgcacactagttctcgcaccagtacgtagcaatctctcgcaccgcagcatccattggtgttcgagagataattccgctcgctcactggttctcgcaccagtacgcagcaatctctcacaccgcaacttccattggtgttcgagagataattctgctcgctcactggttctcgcaccagtacgtagcaatctctcgcaccttaacttcagatggtcaaggtacgactacagcagcgtagcggtcctcgtaccacgactccatgtgatcaagggattcctactcaccggttctcaaccagttgatcgtagtgatctctcgtacatttgcttcaagtggtcgagttacgactactgactggttctcgaccagcggtatagcgtttctcctactatttccacttctagtggtcgagttacgactactgcctggttctcgaccagcggtgtagcgtttctcccactatttccacttctagtggtcgagttacgactattgcctggtcctcgaccagcgatgtagcgtttctcccactatttccactttaggtggtcgagttacgactactgcctggttctcgaccagcgatgtagcgtttctcccactatttccactttaggtggtcgagttacgactactgcctggttctcgaccagcgatgtagcgtttctcccactatttccactttaagtggtccagttacgactactgcctggttcttgaccagcggtgt

SEQ ID NO: 21479 - DNA, 1760 bp, Oryza sativa
tcctgcagccccgagttacgactactgcctggttctcgaccagcgatgtagcgtttctcccactatttccactttaagtggtcgagttacgactactgcctggttcttgaccagcggtgtagcatttctcccactatttccacttctagtggtcgagttacgactactgcctggtcctcgaccagcgatgtagcgtttctcccactatttccacttgaagttgtcaagttacgactactgctggtcctcgaccagtgatgtagcgtttctcccactacttccactttaagtggtcgagttacgactactgactggtcctcgaccagcgatgtagcgattctcccattacctctacttcaacaaagttggcagcaggtacacaatatcgccaagtgttttacccagagatcccttatcacacgacacctagcgttgaaacctatcgtactgtccctttacgccgtcttgacaaggcctccgaggaacctaagggatcttcggctggggacgcccagagccgataaggccttgtcggatcctgtagagacgaaagaccatgtaagatctggtcgtgtaacagttctcgccctgcgtattaaccaagccgtgtaatcggaaattgagttttccaacttcatggctgggggctaggatcagtgcttattcaaccaaggcaggtcaagggtccaagagccttatcctccgagaatgattctccgacgacaaggctgggggctagggacagtatatgactctacaaactgactgatcgaagtcggtaagagagaagacgctcatacacaaaacattggttggtaaatttaattcattttcaatttaccatacatattataacatgtcaccctttgagcattcgctcgggggctatttctatctaatattcttttctgagtattgatttcaggaaaattctattcgacattatcgaagatcgcatgtctctatggttctacaccaagatcgactaaggcgagtacgacaaatgtcgacaaagttccgtcgcggactctatgccttctcgatcgctcgagaacggttgctagatctcgacaaggaatacggaatgaagagatggtgtacccgccgagataaaatttcttgacttcaatccaaattctcgattacagcaagacgggagacttagtcgtacgctctgtactttctcggtcgacatcagagattgacttagacaaactctttcggtgcccgcacgaggctgacaaaggaagtccaacgttctctctaaactcaccgagaactgtcacatgagctcgataatagttactccaatgtctgcgcagttgagaatatgaattcattcatttgcatcgaagtcgggggctactgtcagggttatgtataccacatacctaatagtagttgactaaatctcggcaggacccaccacataccatgtcctatatggaaacaacctgcggatataggaggagttccggataaggaaagacaaccagagttctacatggaaacgacaaggactactcggattgtatccatattggtttccctagttctacttggacaaggggacacctatgggtataaatacaagcccccctaggaggacagggggacaaccatgatgagacgatcaacacgatcaacacccaccatgacgagacaatcaacacccaacacaatcgacatagaagccacaacatacaagccaacatactccaagacaagacgccggatatcgacttcagggataggcatgg

SEQ ID NO: 21480 - DNA, 1811 bp, Oryza sativa
caggatgtagggttatgtcacgcccggaatttctatccaaaattccaaacgcttacatgtgtgtgaaccctcgtccagaaatcagccgaggcacacaataacaaattgataatagagtacaattattactctaattaataagcgaataaaatgtcattacagaggtagatagttcatctcaatcaataaagatctaagcagcggaaaaaaaaagataaacggcgcagacgactccactccacaggtagcttgaccagggctacacctaatcctccacaccatcaacatcactgtagaactcttcctctgatgaatgattgcaaggtgagtatatgacatactcagcaagccacgcagcaaatatgcaagtgcacaggataacaaaggatggcacagtggggtttcatttgcataaacagcatttaataaacatttcagaatttaataaaacagttaagtaataattaaacaatattaatccaacactatacaacataccctgttgcataggcccaaccattctgaacaaccatcccggctgcacagttctatctccaaaccaagaatataccgttccaaaccaggagctaatcaaattattaccagttatagcatcttttattatgatgagaagtgtgagactaatcacgaaagacattgttagacccgcccataaccgcgggcacggcttttcgaatagttttactctggccagaggtgtaccactgtactcacaagacacagccccacaacatgtcactatgtgccttaataccaccacggtacctcggaaaggagctatgacagtacccctcgcacaacacgatccaccacagcgcacctttcctggatcataatcaatcaccccttataaacaaggcatggactccccagtgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaagtaatagtgaatcataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaattgttgaatagaaacaatagctttaaacgggatcaacatgctcaaagggttctttgggatctgtgtgacttgccttgctggccttggaactcttcaaaatcttctcctgcaaaaatggactctccggaaacgtcggaatctaaacagaaaggagcaaaatcaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaatcacttatatggattttaattgaattatgacgcaataatgaattattttttaaaaggaaaagggaattattgggtcagcggttagggctcgcggtgaaccgggtgcacggcggccgctcacgaaa

SEQ ID NO: 21481 - DNA, 1711 bp, Oryza sativa
cgggcttgggggtccttttataggagcaaggaggcggcggcgaaggcccacggcgaccggcgacatgaaggaaagtctagggttcggaggagagagatcgatccgaatcgaactcgaatccacgatttccaaacgattttagccgacgattccaaaagagaaaggtagaggagatcccgaagatcatttcccctctattgatttcaccggagaaggaaaggcgtgagcgaatttggaaggagacggcggcgcggctcagctagggttccggccgggcgacgacgcgaggaggacgacgagtccgacaggtgggccccacctgtcagcgggcggacgcgcgcgcgcgagcgggcggctcgactgcgggccggattgggccaggagagagagaaaaggttttgggccgactttcggcccaaagccaaaagaggatttttaaaaccttttacaatttaaattattcattaaatgtaattccatttattaaaaatacttccttagctcaaataaatctcagaaaaatctaggaattatagagttaagcaaagtatttaatgaaattttatctggccccattttatattggaatttattaattaaaattagatcttctcttctaggctttttaaaataaattccaattaaacaacaatttatatatttaggatttttagggtgtgacaggttattacctgacagctcaggggcccgaacctatataaaaatcctcgtctccatctcttttacttcagtctcgtgtatatcctagcaccaacgatccccatactgttcaaataccgtagttgagacatcaaacgtcgacattcgtcttattcaaaaaatttaagtaattattaattctttttctataatttgattcattgttaaatatacttttatgtatacatatagttttacatatttcataaaagtttttgaataagacgaatggtcaaacatgttttaaaaagtcaacggcgtcaaacatttggacaataagggagtataaacgaacagggagacatggcaaaaggcatcgatgaactgaaccaaggaacgagcctctccttctccctggatgcttcctcttcccaaaatccttttctctgaatcccaacctagctatttttccctgtctaattcttctcccagtctacgaacctgtatctcccttcaccacttggtatcttgtgcgatgaatgaaggattaaccctgagttatgctccaacatatcatagaaattaacccgctgattgagaggagcgaagatatcctgttctaataaatgaaattgacgctggttgatttgttaaaaaaacaaaaatacagaggagggaagagagctaattaaagatagggttaattggatccatgccactacaaatataccaaattagaaaaatgtcactacatttcacgatatcagctgagtgccactcgaatttggggaaattggaaccgtgccactccgttgggttttccatccactccctgttaatttcccaactccgacactcggcctcgatgcggcggcgaaggagctcggcgacggggccatttcccaactccaatggcgagaagagttttggcaatggcggagttcctgcccctctttctcctcatgaactcgtcgtacttcctctttgcttcctcttcttggttccgtccacgtaggtgctgtggaagctgtgcccgcatgccgggagcacg

SEQ ID NO: 21482 - DNA, 5361 bp, Oryza sativa
aggacgacatattgttaacgaccaaatttggtaatatcagcatcggaagaggagactagatcgaggtggagtcgaaggcggagattgattcgagaacagagcaagaatcgactgaagtccatatcggctacgattaggatcggatgggtctaagtcggactaggtaagccgatgcagccgattccgacagtataatttggtgtatgacatcgggttgaattgaggtgcttcaagatgattgccgcacatggatagagtcctgagaaggcaattgtatctattaattaggatgttttatgtaacttccttagagatatgtttgggcaaaagtctaccgcaaagacttatggtatcttagagtgtgttagagatagtggtcgtgtccggtatggacatatcttgtaattcttgggtataaatagaccccgagccctatgtaatttttaacacacacgttcaatacaatttcggcgcatcgccacctttttgctttagttttgttttcgacgagttcttactttcgggttgagctgcatcggttttgatcttcaacaagaggtaaaacttgttatgacgacttgtgttctcgagattagtgcttccatctttatgacactctaatcttgcctatataattcgtcgagttattatatatcttacattagctttggcaatatcgtcatctaacctacaatcggctgacatctgttaatagaaggcagccgattaggttaaatagcgatgttgtcctagattatataaaatatctaccactttatgaaacatccagcgtcttgattgtctagatattgttcttcttttcatacttaatgttgcatcagttgagtttgatctattaagtcgtgcttagaatatcaatctctagcatgtcctctggttgccgattagggtagtatcggagtttcagccgatcttatctgatttaaccatattcgatctatgtgcctaagtgacatgttaaatccgccctttatgtcaagatcttactgcatttaagtatattaagcttttgtttggtatattatacttgttttgatatctttatgtagagtagtatcggagtattagccgatacatgctagatctatctgatcggctatgctataaacatatataatcatgttattaatatatatttcgatctaagtgatttatactgtctcggcatggtgaccgatctatcccaatcacttgatttaagtatatattaatataagaactatatatcgttaatatctacagccgatcgaatagatttagttccttactgtctatttataaccgccgatcgattcatatatgacatcggctcaaagataaatgatatgtcatcggcacctagccgatcggctattatttatagatttaaccacgaattctttgtctctatttcttgttgattacaggatcaaatcaactggcacgctcatacattcgaaggtgagctttggacctgcactggagttaagcagatctcccaggcctcgtgttttctgtcaacacatatggaggtcttgacgacacgggagacgacgaccgcgcccctatggtagaaatctacggcagagacgagctccccaggtagcaacacccttccctgccgctgatcatctccgtcgagtggagcagcggtggcggcagcagcggcgacgtccatgcacgggaaagagaaggcgtcgacgaagttggcactgtggacagggagtggatggaaaacgcgaaggagtggcatggatctaatttcccaaaattccagtggcacccagccgatatcgcgaatagtggtggcatttttctaatttggtatatttgtagtggcatgaatccaattagggatacatatacacacatgtgtgcacaacttcacctcagattttacaagcctcataaaacccaaaccttatggcaactttggccatgtaaattggtggattgggatgcactaggaaaatacaacaatgctgaggtgatctcctacctcgtcgtctcatagtcagggttagaaattttggaccaaaatttcggaaattttggtcatttcggtgacccccgatatgatattaattcggctgaaatttttgaatttttcaattttttcatgaatttggataatatttgttcaaattcaactaaattttgtttaaaattttagaaattttgaaccgaaatttctgaaatttcaggatttcggtgaccccaatagaaacccctaaaccgatagagtgaaccctgctcgtagttaggctagcaccttgttttcggccggtgacaaacaagaaagtatcatccacggacaattggcgtgagactacagctgtgttccgacttccggcacgtgggaattacaatcgaaaagctctccacacaatcaacaattgcactcttttttttttagaactcatgattttatttaaggctaatagcacgttatatgatgagttgatacaacttccatagagtaagaggagagcaagcccaaaaaagagaagctgacaagtatgcccacaagcatacgggctggtaaacatacagcacatattgcaaaagaactcctaaaagatagaaaaatgcaaaagggcctagaaaaaagcaaaggacttctaaagataaggaaaaaaaaaagcgatctggtccttgcgctgcttcttcctctaatctggtgaccaggacaacgaaaccgacatcaacaacgacggcgaaagcaagggagactgtaaaatagagctccaagccgtaaaaccatacggggctttcaccacacaaggcggaagttgacgcacgacaaaaagaataggaagaatacagtcgcacattgaagaacgtcgacagcaatgaaatggctcaccacattagtagcaactttgccggagttggttagaatggctggcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgtatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtggtatcaaggtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagagc

SEQ ID NO: 21483 - DNA, 5972 bp, Oryza sativa
  unsure (1)..(5972): unsure at all n locations
ggtacttattatggcggagcctagtagcctagctacgtgtttaagatgagttgcatctatttgttgtgtcctataccatgcacggattagaccagacaaataatggcctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggacctaaagaggtgtagaagtagtgctgtattagagtatttcatagctattttgtactgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggggtgcccatccgactccgacgacgttttttcgcctcgccgccgatgatccccgccgggcagccatgtgttctaccctacccacccaccagcagccgattgcacctgccactgcggttcttccctcaactgtagagtggtcagcggagatggccggcagacggcaggggggcaaccttgcctggggaccgcgcctggcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatcttaaaaagcccccccaaaccccccacctcttttacacccccctcttaaatatttggggggggcccccttttttttttttaaatatctagggctgttangtcccacttttttcttcaaactttcaactttttccatcacaattcaaactttttctacccacaccaaactttcaacttttttcgtcccattcatttcagatgggattgaggcctncaatntgacggtaactaaacacantccttaatatgtggtagagatgctacagtcaatanggtattaaagatttgattggaatgaaaggttttttgaaaaggtaaatgttagtcttctgtttttgcgtgcaagggtactgaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagtt

SEQ ID NO: 21484 - DNA, 5528 bp, Oryza sativa
gacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcgggctgcgcgacgccaacccctgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaccacatgtagacactgtagagaccgatcagtggtccccacgagaccacgaagaccatgtccatgggaagcgtagacgaaaagcggaaagagtttgaccgatgcatcggaacacggcccgccacgctggcacaaaacggttttgatgggccggaccagtctcggcggttgggccaaccaccccccatccatccatccatccattgcggcgcatcgaacggtccagagctaccccagcggcgggtccaaacccgcgtgcggcgcggcgcgtctccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggaaaagaaaaaaaaccagaacccgccaccgccgccgttaggtttttatttattttttttctcgatctgatccgaggaggagcgaagcgaagaagggcaagatgcattcgacgaatctgctgctgaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagataatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctttgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgtctttgggttaggtatactttatttattttgctctttgacctttgctgctcatactgtaggtgtttttatttcaaaagtctgctctgcacaagtgcaacatggctggaaagcctgctgttgttactcgtgttgtagacagtatgactgacaacctcaggcctactcgtgcagaggctacggatgtggcaaatgcagtgcttgacggtgagttgtttgagctattggtaatgttaaattttcaattgccttctgatagtttaacatacttctattgtttagggagtgatgccattctccttggtgctgagactctgcgtggtttatacccagtcgagactattt

SEQ ID NO: 21485 - DNA, 5546 bp, Oryza sativa
atgtttcagacttcatttaatgctgttcacacggaacacattttctcatattccattgatttaagtctatgaggcaagcattttctttttagtctgaactggttccttcactattttctaggtgcgagctgctattaaagtgaaggcgtctgtcataatttgcttcacatcatctggacgtgctgcaaggtagaaagactgaatataagataagtttgtatcttaatggaaaactaatatcatctctaatctggcatctgtactatctgcaggctaattgccaagtataggccaaccatgcctgttctatctgttgtcattcctcgtctaaaaacaaatcaactgaggtggagtttcactggcgcatttgaagtacgtgatcagcctttctttttctactatgtccatgatctgtttctaactttctatacagatgtttagcttgtcttgtttggttaacgcttagctgttgtagctcatatttcttgtatccttgttctgcaggcaagacaatcgctcatagttagaggcctctttccgatgcttgctgatccgaggcatccagtaagtttggcttctttgttgactacagaaattgcaaaaatattcatgcaaaacatacttggtggatttattttcttgcaattgaaaggcttggccttgtcatgggggctttttcagatttctaatacattacaatataacaaagcttagtagatagaagcgtcaaattttaacatgatagctttcttgcttgcatcatgttccacaattattaacacttcatatatgataaacgtaaaaacaactggtatgcttcctgcattgttaactgaaatattcttgaacttgataagctgatttgtagagaccatttaggcgcaataagccagcttattaagtgctattattctcgggtgcaaattttgtaatcatctttcacttcgtctttcaggctgaatcaaccaacgctacaaatgaatccgttttgaaggttgctcttgaccacggtaaagtttctggtgtgataaagtcgcatgatcgcgttgttgtctgccagaaggtgggagattcctcggttgtgaagatcattgagctggacgattagacaagcagcttgtgctcgtcgtcgatgatactatggcatgttttgccagattttgactaggccaaaaacgttgcttcttggctatgtataatcctatagcttcaaatgagcagtttttcctatggtggattcataggatttgccttacagcttgaaaccattatgatttagttaaggaaattaaatttgcgcagtatttctgtatcgtatcacttagatgggcaaagggaataatgaattttggtactgaaaccttttaaaggtcgatgcgacctatttttcatggatttttcgtaatgctacttgacgtccatcaaagtgttcatctgagtctgacaagggacaatcgatggttgatcccacggtcacccaccatgtacgaaactcgagcatttcaaggaatatgcagtagtattgtctcaaaagcacatgatcacttgcttgatcctttacacatttcataccaataaaaaaattgccttgtaatgccaactctcgagtacaatcctgccatggttccgcagatcaaattggaaagagcaggcagctagtcaatacaagtaaatttcatgctccacagccattacagaaaaaaatcacggaaaacagctgacatgattgtaattagctcctacaacttcatctctctcctataccaacttttgaagtttccaatctacaagtcgcgggttttacacttgaatgtgctgtcctgtactgcagtttaaacagtatttacacggtgaaagttaaatgaaaattattttggctcactatactcgtgccgttgccgtttgccaaagcactacggaaaaaaaatggttaaaagtattacttgtacaaaagaatgatcatcgacaaatactactaattacaatggattgaccatccagaaacaattgtgcaggagaacctgatgatacccagtattttttgaagcttctatcagaagaggtcacaactttcctctttaggacatccttagatattgacagggaacttaaaaaggaagacaattgttgattgaatcacttatttaagtgacacgaatggctgaactggggagggtcagaagatatccggttagtccacagattagcaactttaacaaaatagtgatcaccatcccaaatgatcacttccattcctacatgaagcgaacagagtaaattaattggttgatagaaacatctgatagctaaaaagttcctatccttgaagacgtcactgtaggacaagtattacctggtaaaacactagtcggcaggagggtatgcctacatgtcatcttgctgttgggaagggaacattggagagtggccacttcaatttcgtcaattttaatgatagattcgagaagaactttagcaacaggtgcatctaagttattgctgtcaacaaccattctaagagccgttcctagaccattattagtccatgcattcaggcagccgtcccaacaaaccaacattttactcaccattccaggatcagcaagaacccagggcttgaaggactgcaaggataaatttagaatctgtgcaactctgtaaatctccccaagagcaataaagaattggccacctgtgaaaccagcagaaagcatgttatagtcaatcttcttttaaatgatcagtgagaaaggaaatgataagctctgctcattgttccaagtttttgcaccttgggaaattactacgctgcagacatttgattgacaggattcttgccaaagcaccacaccatgctgcaattcttgagcacagaacagaagcattctgtaccaggcacggacgtaatcacgttgctcctccttggatgcttgctccaaggtatgtaatgttgacacgctgtgcttgtagagttcaactgccaaactcatgtcttccagtgcttatatttgagtatcagataagaattataaaaatttaataacccaagaaagatcgcattatgacccacgaaaacaagaagcagaaggtagaatggtaaactgcaagattaactgcacatattgtatactgaaacaaagaaaaattagttgtgtgccatctacagattttcgttgttttgtataatctacagatcagttaggaggcaattctaatgcggaatatggaaaagcactaatccattcatttccacataattatgtttatcacttatagaaaattgtgcatgtgattattacatgctatccacctaacaaaacaagtgtattgatctcgagtaacttgagaataaattgcaagatttgaccatctaatgaaatagtttattttgggtctagctcaaggaggtaattcctaacaagtactagtaataagataggcagtgtgccgaaacattatattccccataggagaatgcataccatcggtatcttttctattaaatgatattcttcctcaaaatccttcaaatgaacctctctggcactgtcaagcagttcagaaatgaatacatcctttgcagtatgttcctctatacaaaaaccttcaggtagtttctcacagatttcctggagattatggaaaatgtttaaatgacggactatattaaattcatttttttttgtgccaaacaatagtttcaagtgcttgagtgcggagcacacctgaatctcccttgcaattgctgaacttccctgttttcattagaaagcatagaactcttctggactccatgttatcaaatgaaaaggcactatcttgtgttgttttccgttcaaaaaaaatgttatcaaatgaattgcaaaattacaaacagaaaaataccagtgatttatcaactgaatgtaatcagtggttactgaccttaaaatccttcccattccgaaatattactgtcagtgtttcttccctcagcttatggtagaaatcaatcaaagtcctatcgcttgaagatttaattgaatgattttcatctgtttcaaatgaagagttctgatcactgatcattagtgtacatcacatgaaattaaaaagaggggggtgatagcaaactcaaaatagcaaaaatactcaccatttcattatttgagaacatatcagaagggctctgcacactttctgaagaactttgtgtcatgtgtacagcatcaaccagctcagtttctttgtacaggtcaagtatggctgcatcattaggacctgtggacttacaagtttcaatgtggtttgtagttcgaacatggttcaaattttcatccacactagtaaatagtgaccagtcttctgtcaggaatgatggtgatgatgctctgccgcaagacaatggcgccaagactctgtttgatggtgatgagaacgaaggaggaaggaaggacttatcaccacagaggaagcgggccaggtttcctaacaaacttttgagtgggcctgaatgggctaagtagctggcaagagaggagaggtggcgtgagtgagtggtgctgtattaatactcgaactcttgtaacgaattacttgactaatagaatctggaggcaattggcggcggaggatgcaatccggttggattggcgtgagagaaatctcatctgtgaaaattgttcttgcttgcaagttaggtagctaacatcttcctggtcacttcccaatgattttggtacatcctgtaatgacgaaattattcagaccaatcaatggaggaagccatagccatatcaagacttaatacaaagagaaaaggtttagaaagaagtaatgataggatttgcaatgctagaatatactatcaaagaagtatattcacttgtttttttgcgggaactacaaaaaaagggttatttgtgaattaaaaaaatgaattcctgcctaattctacaacacctataacaatttccaagtagaattaataagttgctaaggcagagcttcacacttgatacagatacagaatgtaagaggaaaaaagttatcacatccctttaggaagcttgatcattcaatttgaacattataatcatgatttattgattcagttttgtgagactggtcgcgacgtccgtttcagcaaaggttatcttcatctctgcaattttctaagtgggctagactatctgagcctacctttcctttatcaccagtttgcctttggtaaaatgccttaagtaaacagtttccacataatactatctcacgcgggcggctcggggagcgaaaaaccctagccgcccgcgcctccatcccttccccccccccccccacctcgccgccgccggagcttgccggcggcaaagccggcagcgagcagggaaggcggcggcgaggccttctttgtggcgttctccctcctcggcgcgacgtggacgagatgatgacgaagctccccaccggcgtggtcaaaggcggcaacggcggggatgtgtggggaggcggcggatccggcgcccccaaggccggatccggccatcccccgcctggagctggcgcgg

SEQ ID NO: 21486 - DNA, 3871 bp, Oryza sativa
cccttcctagagctcctccccttctctgtggggagtttctaagctggattgaggcggcagcttgttagcgggagaagctcaggctgctgaagcaatgccatccaatcccgggttctccttcggccagatctggcgaggaggccggcgggtggtggaacggaaaggtcctgggccagttctcagggatggtggttcgatgaagccggccgacagaggggcgtcggtcgggtatggcggaagccatgtgctgccgatgttcagatggtggattcggattgggtgacgtaccatggtggtagggggttccgagcgaaagcttagcccaattctttgggccaacagtgactttgccttcgggcatagtaaccctcttgagggcactgttgaggtatccctcctccctcggcaaggagctctgggtgaaaaccttgtccagtctttggatggatgacgtcggcgtcttttggcgtcgtgaccctcgtgagggcgttgttttggagtcttcgtgtcgtagtggtgtcgttagctcggtggcgatcggtctcgcatagtgatggccggttcggtgcttggctttcctctctgtagtgtgtgtttggacggttgacacatggtttggggcgtgtgctctggtgcacatcctttctcgacagccagctgtcgatgtaaaacgtacatcctttctgccagctgtcgatgtaaaacttttcttgtaactttttctttccatcttaattacattgaatgacctttgaatgacctcctttggtcattccggcaatataaataggcacagcattatgtttttttttcttgttaaattgaactgtttcgtatgattttacatttgagtattgatcatgtacgtttggtgggaatgaattttgcatactaccccgggtttaaatatacggcatccttaacttcttttaatttattttcgtttttttaaaaaatatttatataaattagacaaatataaaaaagcatgctaaaagtacttttgatgggtcatctattatcactcttttcatttttacttacctaagtaattaaataaacattgtcgatcaaagtttaagaaaaaaaataaatagtgctgcatttagaaagggagtgagtgtgctgttcctccgatgaaagcaaatggatccttgacgttgagtgaaggaatcccttgcattcataggcaaacaatgcttatttcaaacttcattcgaaggtaatttgcaaaagataaaaaccttcccttcaaggtattcctaatggactaaaagttctaaacatcaacgcaaataaataaatgaaatcaagggacgccttgtcgttgtcgcctactcgccttgagtagaaactatagcatcaagccacatattgttcaaaaaaagtgtacccacaagcaaaaggttaaaagctctatacgaaccatagctccaatgctcacgaagcacaaaaatgtcaggagtttctaacaacaatatttgacaccgattgcgtgctgcacaactcgaatttccaacctacagtacaagatggtcaatactgcataatttttccagtaaaacatgtcctatccctactcatccttgcgtttgaacagtttaacaagatagccaattaaggagaccagccatcgccagaagagaactaggaaatttgacgccttcggtttgggttcaggccttggcccgaacagacctttgtatagctccttttgtttctggtacagagctttatcctgctccgcgagcgaccgaagctcgcgctggatctccttgtcttctggagaatacttcttggccttcaggaagtcctcccttgctgattctgtttgaccaagttcagctctagcttttcctcgtctgaacaacgctttcacgttgttttcatcctctgacaacacctgaagaatgagattatgcagttgatcatgatcagcaattctttgattcttattcaaatggtcaatcaacaggtccgtgaatcaatacaaaaccaaaatcatggttgttttacacaaatgagttggaaaagattacacaagtacactaagatcagaagagtgtctttcatgaagaatcatggacaaatatttctccctgctttagccatatgcctgttttccatatttattttgcaaatttttagtgtctgaatgacaaatcaaattcagttttttcttgtgttatacatgtaatgttaaagcatgagtgtaagagtaaattttatgcaatgtagaagaataacatacaattgtacactgtgcgatagcttcatcaaatctcttcagtttgatcaggcatgcggccatgttgagatggcagggatttttcacagctaaggccatgtctctgtacttcccaaacaattgaaacatgaaatcatcccccatgtatgcaattgcctgtaaagaagaacagctagggggattatgattgagcatcttacaatagctgaagaatgacatcagtaggcaactaaccatttcatatggctgcatagcctcctcgaacttcttttctttgaaatattcattgccttcaatcttcctcctgtctggtgcttcaatcctttcttccactgtcatatcacttcgggcttttccctgtagttttacattatctgtaagcttcctaggaacctttggttcacaaatatttttttaaaaaaaatcaaaatcaagggtgataagagggatatttatcctacctctttgacatcatcaaacccaataagttcaacttcatatacaaggtctgccattggagggacatttgggaatgaaaagcttccttctttcccatagccaagctcccagttaacatgtaacaatgcacgctccccacttctcatgttactgacaccaatgcctaaaccagtcatttcctttttctctgttgatgagaagaaaaaaaaaagcttcaaagatttatactaaaggcaagtgtaattgatgctcacgtctgttcgtacaatactactcggttagttatctagttaccctgtccagcagatttattgaggcatgaaaaagaggaggtaaaattactagcaatagaaatatcatactttgtctttagcctttgcaaggtgaggcaagtgggaaagttactggtgggaaaagttttttccccctcaaaaacctcattttgatgggcattatggaactatgtgatgcaaagtaagctgtttgagttcatggaatttacggatgatatgcatatgtgcacagaaaagctgaggataaaataaaggaattaactttagtgttaccttttccaagtactagttcaattgaatgctgttcttgccaagtatcctcgaatttgtgcgaagaaccttgaacccatgctctatagtgaactgcaagacaaagattgggaaaaaaataatttgcaaaatcaggtataatatattatcctcattctaatcacaatcctaagcaaatggaacaaactgactacttatggcatacttaccaaagcatgtggcaaaccttgagggtttcttgccatggccttccttgatgacttgctttttgactttatcattaaggacttccatatcagaggtaaccacaggtggagcagtgccatcttgaggaggctcagtatgcacaaaggaagtttcttccactgttatctcatcatcgctagcacctaaacaaccaagacacatgttcagacatagtactgaatttcttgaataacacaattcactgttctgtagtgtggccattttataaaggaaattcaaagtactgggaactacatccaacatcaaacatttgatgcgccccagttttttggggaatacacaaagagaatgggcatcattacatgtgggactaacccaacacggaagatatact

SEQ ID NO: 21487 - DNA, 6493 bp, Oryza sativa
  unsure (1)..(6493): unsure at all n locations
cccgcctaactgcttacaaactactccagtagtattgaagtgcacactcgatagcacttgattcgagcattcggggttcattcggcaaggtgcaaactgcaaaatgatttgaatttgagatgaatttggcgtcctcaagagactgaatctagtttaaacccaaaccggacattttacaaccaaaggcgcctaattttccgaatcccataaaaaagcacatatatgctacgattccgcacggggattcaaaacaacagcctgccgaaccaaccgatccaactcaccacaccaaacacaagacagacacgcccccagggtgtagggagtgcgagagaaagcgggagactcactcaccggaggtagaatcggcggcgggtaccggggccggatcttcttccagcacggccatcggtgcgggacggcgggcaggcggctggtccgcggatttggaggcggatggctcgaggagacgagagcttagctcggcacttcaccgggggatcgtgcagcgcgacgacgtggtgttccctcttcactttcacttgggtggtccatccagtccaaggacggcagcgaaaacagagaggtggatgagagagatgacgagccgcattcgtaccttcgtgggcttcattcaacttctaactcgttgccaagcccaactactcagtatggtccatgtgctactatggatctgtttggtgaatttttggtatatttttttgaccttttttatttttaattttaaaaataaacccttccaaaaacttattttcaaaatctgaacatttaggccacgctctggagtggcaaaccaacactgacacaccacctgcagggccgtgacaatcttgtaatatcatgacggcgagaccactgtgatcagatatacgttgttacgctagcaagaccggcatggccaaataacactgtcatgatagtgagaccggtgtggtagtattattttgccacgctagttcgactggcatggccaaaaagattatatcttgaaaataagtttggaagggtttatttttaaaattatagattaaaaatgtttcaaaaataaaaaaaattatttggaagcttaagatcatgagaaaatagctggtttatagggatctgtagaaactcccaaaacaatggtcacaagaaaattagaattgaaaaaaaatgatacaagaaaaatagaaaacagaactattcacgtgaaatttcgattggaaaccaataatatgaccacatgggttaatgcttacaactatgcaaattgtgaacgctatgggacaaacagaaacataaccaaatgaggtagttagtgttaagtatgcgatagtcaagaatatagggataagaaatactaggatacaaattaatccattccagtaagaaatatagtaactaccggattacggtttgagaagacagtaaaccaagaaaacggtcgataaaatagcaagactatatcttttttttccccatttctgcttctcatgatttctcatggttaccctgcaacacttttagtttttcacccctaattatcaccgtcaacgcccgctagacggggcagggacaaccggacaagacaaccaagcgtaataatactaccaaacaacgaacatgcagagataaaccaaaattaagcggagtctgctacatgtgcgctcacaaatgagaagtcagaaccatatgcgtcagcaaacaaattcttcaaattacatagtagtacacaactgaaacaagctgcccatttngnagttgctatatatttacaccaatcattctgtatgaaacacacaaatcaccgtcataatacaggctaagctattgttaccatgaccggatatacacttggatgtagaggttgcaatgattttcactatcggaaaaaaaaaaagagctactgttacctttgcccagctcttttcgctaacctccgcaattgaaaatcacagcacagtggtgcagcttaacttcttgccaaccaaactgtactaatgtactaccaaaaatgtgtcctccccagctcagctacctagcttatgagttatgaaagctttgcttcagtaagagaggacatggccatccagcagtactcctttggcttttatcacccagtgttgagtcttttagctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccccgtgttaaagatcaaaagatcagcatccttccacttaccccggccagacatccaatccatggcatctactctaattgtatattttacgactgcaggggctccagctggtgcacgaccttgaaggactatgaaaggagacctgtaatactccacagtgcaattgtactctctaaacttgaaaattaagaaacccatgtgttttgtaataggatttccattaactttaaagatggaggttcttgtcaggaacagcatctgcgaacatacaaagcagatactgccattggaacattgcaaactagtccctaacatatacaactcttctgtgactgagtctatataacctatatctggcattgcatctaagatacagatgaggacaccaattctgagtgagacacctacatcgctaatatgggcatcagaattgattgataatggaacatctcacatcacacgtatcatgggagtaccatacaaagtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgagcagcggagcgaggcggcgcacacgagcaggagcagcgcggcggcggcggccagcatggcgaccagccccgccgccccggccttctccagcggcctcctcatcaccccccgcgccagccgcttcgccgccgacgttgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 21488 - DNA, 666 bp, Oryza sativa
  unsure (1)..(666): unsure at all n locations
nnnnnnnnnnnnnnnnnnnnnnnnnnnnnnnnnnnnnnnntaaccgagcttggtgtttagtttagacagtaggagtatctatgatcagtttgactactcaaggctcgagatctttctcagctagctaccaccacagatacacatacgatatgacatatctctgtcagaaaataaaagcttaattaccctagctaatgcatggttatgattattttgatttgatacttaattacagtttgcaatgggatagtaagagtactatatacttactgttggtatggtgtgtgaatcattggcagggcatgtgagggagcatctttcggtgtctctcttttcatggtcagggtcagatttatcaaagccgctgtagcctctgcacggtgttgactttttatcatctctatgtggatcatcatggtatcgaatcttagggaacagatttgttgccacttaaaaaaaaataaagcccataatcttagctagcactgtagacagggtgacagatcgaacgcattggttgtcttggagaaatttaaagaaaaacaaatactacagtactagtagtagtagctgttcttcagtgagtgagctactaggaaggttgtatggtcatggagtaatataaaatttgttcagaggcagacaaaggtcacaggcaggcaggaa

SEQ ID NO: 21489 - DNA, 2884 bp, Oryza sativa
taaatagatctttagtcccggttagtgttaccaaccgggagtaaaacatatggcgatcttttttcccggttgatgttatcaacggggactataaatagatctttagtctcggttggtaacaacaaccggtcctaaagattgaaaagtatcctgtagcttttaaaccgggactaaagatatttttagtcccggtttttaatacaatcgggggctattgtaaaatctggttgaccgactaaagatggtttctccaccagtgtaattagcgcatcttttgatgaatatacacattttgtttctcaatgacacagtgtcacaacgagtagcagccggtgccctgtgacgccgatctatgtacatgaaggtcatgctggatccgatatcgctaattagcgatcgatcacctggggtgattgttcttttttcatcactttattttttttcaccatatagtttttcttttcggataagtttacatatctaaagtttatttataggtcaaaagtttatatatatatacctgatttaaatttaaatttagattttgatgtttttatatagaatatttatataaaaaagtttatacatacatatgaagtttactgtatatatttataagtgtaaagtctaaagacatggatatatttttaagggacatggatatatttttaagggtattattttgttttttaaatttatttttttatttatggtgcagtaggaagggaaaaagaggaagaaacgtacgtgttagggggagagacgggggtgcccgatcgctgtgggcgatcaccagcccattagcccttccccggctggatcgatcgatcgacgaaaatattgactgacgcacgtgcgaaattaagaagcacgacccaatgcaaatgtcgtcgtcatccatcgtcgtgcatgtcacgtagccatctagccgacatgcatagtactaatatactttgattaattagcaaatggattaatttctctttcactaatccatgggcaacagtatacagtacgatgatcgaagatcaaactaccacgaattaatgtagtgtcttttgttcgcaaaaaattaaatacacgcgcacgatcacgtacgtcatcacgtacgtgtgctagctagctgtgacttgatggatcgatcgggattgggccggggagttggtcaagattcgccatccatgcaggcatgcgcgtcgatccatcgtgccgtcgtcggcgtgcgtacgtgcatggtggccgccgctcgtttccattccgcgtcgcatgcatgcgacctactcctccgtcaaaaaaaaaaaataatcatatccataaatctacatacacacgtgtcatattcatagtaagtagttagaatttatctttttccatagcagagtagtagttagcactgtgctactctctctcttcctccccctctctctctccagctcaacatatatcatgcatatttcccccgtgtcactgtcctggccggccggggccttcaccgccggcggctaagctccctgcgcgtactactgcccttgatctccagggctgtcccaagctaagatctgggaccctgtgctaaatataaattaaataagacctcatacgtagtgttgataagtactgtgtactgggacaaatctatagtataaaggccagagtgtcagacaacaccgatgactttcgataaaacttatagcgaaattgtttgtccatatactataacaccatgatctaagtataattagcacactatgacactaatagacacgttataacactaacgcatcaatttttttggatccgccaacttagtaatggtgatctatatgtgtagagctatgccaaataagattaccacctaattaagtagtggcaagctggctagttaagtagaaaaagaatcgccgcatcaattcagtttttctaactagtgtaaaagtgaaatccttattacctgaaacgcatgtttacattatcgtcatgaagtaaagttccttaatgtacctatcattatcatctaacacttgctagagccaagaagaataaatctccttctagcctaattcaatgaaaccaaaagagaaaaagaataggttgaaaagatcctaaacattatcgctcatctcgcacgtgcccatggacggtcctgttgatctcctagggattcaccaatcaaccactatacctatgtttttttcctcctcaccccctctctcccctcccaacttcaattacactcgctgccatccctcactctccgtctccagctagctctcccacttggcaatcgctgtctctccccttccctcttcagcggtggcggcgacaatgagctcagttatccctctctagcactttctctccactcttcaaagatggcggcaacaagcttcccaaatccattcttccctagtggtggcgaaggcatggatctaggcaagccagcaacaaggaggcggagtgtcaggggctcggagttggagatgagatctaagcgagtgaggtgtcaaccttagtggtagcgaggatggtgcgatgaactgcatagatcgaggtggcgggtagtgtagattgagcattgtggttgtcgttgctctaggcatccttcagcatagatcggagctgccctctgacaacgagctcgccggagtaggccgctttgtcctccaccattgcttagattgacaccatcgtttctccttctttctcctctgtcgtgccaccttcttccaggagggaccacacgcgagggtaagtggaggcagggacgtggccgcgtgacctcccaacatggatgcgtgcaagctatttcctcacttgtagatggacatcagtgatttcgccaagaaacaagtgtcctcatgagggggtagtccaatcggccgga

SEQ ID NO: 21490 - DNA, 3509 bp, Oryza sativa
atatcactccactgtgaatggcttaggtgattctgagtttgtcgcaagtaaaacaccatcgtatctcctaagttttacgtactatatatttatagaaaacgagataattaatgtctaccacatctgaaaagtaaactatgaaaaatatttgataatgtatgtaatggtgtttatttgatatatcacaaatattatgttttctctataaattcaattaaatatagaatagtttgactagctatgcatgctgactagtcaccagtgaagcagtgacaagctgaaagctacagagcatcgcacagcaacaagagggacatcgagctactatagctctagctgcaggagccgttgactggtacgatcggttgaacaggcacatcgactagtcgtacacccaattcagtccattcgatcacgtacccacccacgatcgagatgaacgggcccgttcagtttatcgccaaaataaatctgattaaattttaacaatatcagaattttgataatttaataatattatcaagttttgggacgatttttttatgtatttactagagtttggtaaaacactaaaagaatacacatatttaacacctttataaaaaacgatatggtttgaaatgacgacaatctgaacaaccgagctcgacaaccacgcccacatatgaccccagcggaacgaagaagctcacatgctgcaatcgtccgtcgttgcaatcatgcacgcaacatactactctctagtagtacatcccatttttctcctcgtcgtctcagctaaacacacacactattttacacatgcatatgagcaaaattatttgcaaagaggaagaccagcactacatacgagtctacgagcctgtttaggggagcttaaaattttaagaagcagctgctgaaaagctagctggtgagaatctagagaagctgcttctggcttctaatttattttccaaattctacaactatagtttctcagaatctggacaaaaaactagactgtttaggagagcttatagcaattaaagattctagaagaagctacagctgctacaagcttggaagctctccaaacagaccctacgactacgaggaaggaggtaagctagccgagatagtggcgccaatgatgcaggggatttgagtggaggaatcaggcaggcagcactgcactgcatcagaagacgaagctctcgtgcacaacagagaagcatgaagtagtagtggacttggccaagatttcccaatgcaccaccactaacgcatgcagttgtaacgcagaggataggagacctggcagcttctgatacacgtgtcacctgcttgttctttgcatgtggggtgtgtgggccccacttggtggtgctgtgtgggccccagagacttctcgcactagcttgtatgctcggcttcgatgtcctctccgcggatgcagagcaccacagctgcaatgcctgcatgctctgaatactctgatctgaatctgctgccaacttcgtgaaattcagatcgcaatgcactgtttctcaacgcaacggggacctctgctaaattgtaacttgcttctgctcatttctgaataatactgatcgttttatctgatgaccaatgttggaaactggtcgagaaatgcatcaagcagtgcatgaacttcaaatctttaatcatgtttggtataggccaggagtaagcatacaagggggcccaagaaagctattttctcctccatttcaggatgctagttgctgcaaaattccaaccatatccagcgcatcctcctctggctagcaagctagctcagatgttacatccgtgaaacggctctttgtggaaacgtttttagactttctagtgaaagaggactagaggagtgttctgttttcagggatcagacaaatccaagattagtaaggattgacaataagcgtaccgtttgccattctgttctttgttttatctttcctttttcttgcgttggacaacgcatccctctatcactgaatattctttccttgcacacagatacacagtagtaggtttttggtagggtcggaaagtctcataatagaaaattatcaatgaattaactatgtttaatagtcctacaatttgatataataggatgttttttattttctaagtcaaactttttaacttgatttaatctattaagaaaatatagcaacatatataatatcaaattatttcaactaaatatgccattggttatatttgtatagttttttcttgaatactataaaactatatccaacaacgaattttattaaactaatatggcattgttgatgttgttacgattttttagaaatgggacaattttttaaaaataacttataacaaacaaaaaaaacacttgtagtataaaaattggatgaagtaaggtcattgtctacggctgattataagatataacggcatattagcgataaaaaataatttatagaactttttttactatatcctttgtgacttaaaaactaattacaatgcttgaaaaaaaaactatgttgaaaaaattatcaaaatttaaaatttaaaatttagcattgctttatatgtcacagatcaaaggaagcttttaaatcaaaagtatgctaccaccctaatctgtatttactactatggcctggtttagttcccaactttttctttaaacttttaacttttctatcacatcaaaacttttctacacacattaacttttaatttttttcttccaacttctaattttagtccatggaaggcatatgttcaagacgaaattggcagtttgtttgcctgtgttggcacctacacaagtgtgaaccaacaaatctactcgtgttttgtaaccacgcggccgactaacaaccttagctagtgcatgggtgtgggcctgcctgcttacttccatcttgaattaccaatattaatcaccttctgtggtctgctgttaattaactaacctcagacgacgtctcgttaatctgagttgctatagctttacgaaaggccacacctcggattataaatactacccagctcatggcaccaccacactcttcagtctcacacaaacccaaaaacccaaagcttagccaagctactagctagctcctcacttcttccagcttcttacactaatacagctcgagccacttcgtcttctcctctcttgcagcatagtttaagtttgagataggattggcgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgaggtgagaattaatcgaacaccacacagtagctccttatacaagaattgatcgaagaagcacctagtggtagcttgctaagcttgatgtgtgttttgtctggggctgcagga

SEQ ID NO: 21491 - DNA, 1847 bp, Oryza sativa
  unsure (1)..(1847): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgtgccatacctcatctcaatgatcttttgtttggctctccaggcctttgcatagcttatggtgtacttgaatttgttctcgatgtgcctaataattgattttggttcaaagccagtgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatccttcttcatgcacctcacttcatacacataatttgttgacttgaccaccctaaactctctctgcaatgaaactgcccaatgcttcaccgcctcctttatctcatccttatgagcataccttgcaccctcaatgacctcgtactccttatactcccagggtacatgatcacactctgatataacaagaccagagaagtcctcatttgcccaatcagtggccattacatcaccttcctcatcggatgatgcgtcgtcctccgcttgctcattatccgaatcttccctctccatttcatcaacaattataccgactgtctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaaca

SEQ ID NO: 21492 - DNA, 18365 bp, Oryza sativa
aggagatagaagaaaagaaggaagagtacaggagacactgacatgtcaataccacatgacccactgtatttttttcaatttttttctaatataaattcaactgacaggtgggtcccgttggtgtttttacttttctattttccttctactgccacgtaagttgaaaaccaggtcaacagttccacataaacatcacgtcagtacaaaccaccctcaaaactactaaaggagtcatttttgaatggttttaattattgaaggggtcgatttacctagttttacggttgagggatgcgaatgagatttgacatatatttaagggagtcaaaatggacttttttcgaaaacaaattgcggcagccatggcgtcgacggaggagccagcgcatgccggagggggccgccgtatagacatgggaaggttcaacatgaaggaatgacagtagcagtgacacggccaatcatatgattttaaaaataaataaatgttaaaattacccctaactataaattagcaaaatactagtgtgccctaacaaatcaacagcccaaatcatttttactggtagaagaatactaccagtagagtaccatagcggcactcatgtgatttatagttgcagatcaagcagagttgatattcaatttaagaaaaaaaattgaaaatatatctttttcttcgttattttgcgtttatataccaatgcgatgaaattgtgaacaaatatacctttaccgtagacgggaaccgccttggtcctgcaccaccatttcgtggaaccggcggtcgcgcagaacagcattgcgggaccgatcgatcccgcagcctggaaacgcggaaccgccgcgccgtgcgctgcttccagtgaatgcatgcaacgtcaatgcatccgctgcatgtgctgcttgctttgccgcgccggtcacgcgtcgttagcgcgtgggaccgcgctggtcgcgcttatgtgtcacgcgggagcgaggcattgcgtgcgggagtgacggtgccgcgcggacgctgcacgagcgagcggcactgcctcggtcccgcatctctattctgcggtagatatatatttttacaattctttcccatgcatgtatataaaaacaaaacattaaaaataaaagtatatatttaaattttattcttcaatttaatccttgattttatttttgtgaatatataaatgctttgaaaatttagtctcgacacaggtatatatatatatatgcatgcatagggacaccccaacaaaatttattttcttgggtgaaatgagtgagaccaaaagcataattaaacattctcatgccatgaaattcggtgcgttttgaaaaaaaaaaactgagggagtacagtactctagcacacttgtatagatttgtgagttactgaaaattgagggagtgcatacctcaggatgtgctgattatatttgcatacactggtggaaaaaccatctttggtcggtcggccaaaatccataatagtcccggttgcaataaaaactgggactaaaaataatctttagtcccagttaaaaacaccacagctagtttatgatctttagtcccggttggtaacaccaaccgggactaaaaatcatctttactcctggttcatcccgtgttagtagcctgtcagagggccaaggatctttagtcccggttggtgacaccaaccggactaaagatcatctttatagtcccggttgataatactaaccgggactaaaaattattttgatctttagtctattttgatctttagtcccggttagtattaccaaccgagactaaaatttaatacgtagtatataatccctatcccttatcctctcctacacttcacagatccgtccccttcctcttcacagatctaactcctcctccccttctcccattcctcctcccctcctcacttcccatccgccccttctcctcccctcctcacttcccatccgatccggtggccgcggcggtggcccggcggccggcggggccgcggcggcggcgcttccggcgggcggccggaggtgccgcacgcggcggcggccgtgccctctcaactgccggccggtctcttttcttttcttttttttttacaatttgtgtttgattgagatgtgaaattttgtgattcattgcatggatatgagatgtataatctgtgatgtatttgatttgtatgtattttttaggatttgtgatgtatttgatttgagtgttttttttaggatttgtgatgtatttgatttatgtttataagtaacttaatattttggatgttactttgaattggggatttagggattgatttagggatatacatggcactaaattcgggagaaaatatagaaattaaatctggcaaaagaaaaaaaaaagcgctactctctttagtcctggttggtgttatcaaccgggactaaaaatagcgatatttagttctggattcgtactcccggttggaaaaccgtgactatatgggggttaccaaccgggagtaaaaaagctttctgcaccagtgatacatatacataacttggatcgggtggtatcagaaatgaaaattgtgcagggtcggcgtaagtttcagaactggacggaaggcatcagcaagtcatatactcgtatagtggatctcccgttggttatttattcaccagctttaatttgatctagcatgattgcagtatcaatgtcatcttgatcgtttgatgtgactgatgagtcgattaattatatgtacacgttttgccacttcgattttgatgtaaagatttttaaaaagtatatgctggccgttctgcacgttggtatggtcattcaattattgattatattatttgatttgtatcttctctcggtttccatgttcagatatatatttcagtgaagatgactagcagcaagacagcttctgggtggttgggaagaatgtgtatgagtcttctgcatgtcataaaaggagaaactaattatatgaagtgtatatacaccatggcatggattgcagtaaaatttgttgcataaaaggagacctgagagacgactgagagccaatatttcagaactacaaattgcgttcagagttcagacaaagagagacgcatgcagcagtgcttagtatgggattggaaggtatcggtaatcaaactagtgctttcgccttcctaacagaaccctcactaaagaaagatcttagtactagctacattattggatggcattttgtaccgatttctgctaaatagatcttgtactgatttccgctgaaacataatgtcatgtggtcagaagagatcagggggttaataaaagagatgtccaagagtttattcgactagacggggatcatatgtactatgcagtgtggcatcaaaactgctccatccgttttttaacacatgacgctgttaacttgagatacgtttgatcattcgtttcattcaaaaacatcatgtaattattatttattttattatgatttgatttgtcatcaaatattctttaagaatgatttaaatatttttatatttgttaaaaaactgtcagggttatggatatcacatacccaatagtaatcgactaagcttagcggggcccaccatataccaagtcttatacagacatacctcgtatatagaagaaattctggataaggaaagacgagtagagttctatatggaaacaacagggactactctgattgtatccatattggtcttcctggttctacttggacaaggggacatctattgtgtatctatctgttgttgtgtcctctctccctactcaagctaacacacgccgccagacatcaacatcaggcataagcctagacagacctcgtatggtgcctgcggaggccgacaagagagatctagcgccatctctgatctcgatgagctcatacttcaggaggaagactaccatatcgttgactatgtgttggttatccataccgacaagtcgatgacatttagataggttatcccaattattgtatttgtgtgattcagatgaataaagaccaacaccggcttcggtcaacaggagtagggctattacctgtcagataagggtccgaacctatataaagatccttgttccatctcttttacctcagtctcgcatataccctgataccaacgatcctcataccatgcaaataccatagtcatgacctcaaacatcgacaaaaatattttaaataagaccaatagtcaaacgttgataaaaaaaatcaacggcgtcatacattaaaaaatggaggtagtattagatatatagacttcaaattagattttctgccctttcacatccgatgggtcattaatatttatattttcctaatgtgcactgcaaggaaaaccattttcctagacaatggcaaaatatttttcaaggcaggtagaactctcagaaccaaacgtccgcctacgaaaacagaagggaggcgggcgggtagggggggatatcgaaaatgtaccttcgcagacgtacgtggtcaccaaaaataatggtagtactatatttttttttctctattgctaatagatttcataaatcggagtctcggatcacttctagcgagtggtctagaatactataccaatgcaggtcaccacaaatatatactcgctagtaaaatgaaaattctcgtttggtgaatatgatgcacactggtactgcgagtacattttaattatttgttgctacttatttggtcttataaaatgagagctgaaacgaaggagaggaaaaaggagaatagaaagggcatgagtacagagaattggtgcctttatttattaccgtgcatatagtgaacttacaagtaagattgggaggcatgggtaataaaagaagcgctcgtctgtgggatcgaacagtttttagttaagggatgaactgtgaagccgactttgtctccaagaatttactagttttcagatttgttagtgacagagttgcctcttgtactctgtcaaagagaagcctcagtccaccaagctgaactgtacggcgcctgcgagcatcaggtgaagctgcaaaccaacgtcgctttggcaaggacagcagtagattaattagctttgcgacatggggttcttcgagtgaattaggtgttcctcctcaccaaggatgatgtcaatcgatgaataaattaattaagcatctataatgctcgttatgtcatatgtggatgtgtaactgatgtgtaaacttaatctccgtgaagtttttgggtgactacgacaaagcgagcgcaaatcggagggataagttgagtcggatgaattccgcatgaaaattaattaatctgaatgaaattaatagaatgacgcatcagcataaacaaattcagcatgaacattctctattgaaatttttggacagaattatcctgagttttcaaaaacattgcccacttgtagacatgttcactactaaaaaatggccaaaggtgccggttcctaaaaggccataggtgtcggttttccaactggcacctattggtcagcattgatactagcaaccggcacctataagaaaaatagaatcggcacctttagcattgctcgagccaaaaaaaaaaagagctggctcgaatccaagccgaactcactaagtgctatcagtgtgcatgcgcccatcccaaaatcaaattcccaaaccccaaaatcatccacaaatcgtcaccaaaataaattgacatcacagaatgaacatattcaacaacaaattcacaaaaacatgttctacaaatgacatcacagaataaacatatactagcaaccgctagccgcctcccctcttgagccgccgcctgccgcctctccacctagcggaatcggcagaggggagggcgccgccacaacccgtcgcccgccgcctgccgccttccctcccgccagatccggtggaggggagggtgctgccgccgcccgtcgcccgccacctcccctcttgcaccgccacctgccgcctcccctcctgctggaatcggcggacgggagggtgccgccgcaacccgttgcccaccgcctaccgcctcccctctcgccagattcagcagaggggagggggccgccgccgtccatcgaccggcacctcccacttgcgccaccgcctgtcgctacccctcccgccggattcggcggatgagagggtgccgccaccacccgttgcccggctgccagtctcccctccagccaccgccgtgcgtgagagagaagtgagaagccgagagagagaggcaagagagagacagacgagagagacgagagaggtggagtattagataaggttgagtgcatggttgactcatatactccgtagggtataaggccaatgcgttggcctagatcagctcggaggctcggctcggtttggatagatgatttattataaattataggtgccggtttttaattaaccgacacctatgattttacccttagtagttaagtacctgtaccaatacttcaatatttttttacatcgtgcccatcactcaagagcgttggatttttacctttttagaatgcaaacaccgtagaacttctcgatcttttttcaacttttaggccccaatctgcatttccctggggaccctaaattactagagacagccctatgcttcagctggcctagaaacatgggaatgggatgctccactcgctcataatcactatgcacaaatgcatgcaagcgtccatctaaaaatggccaaagcccaccacttgccggtccgccatgaatctatcaaagcaagatttagctgcttcataaacttaataatacccaattacccatccattcgatcatctccggttaatttcatggacacaacgacgaccatggcgcctctccctctcctcaccacgacgtctctgctgctcttcttcttcctcgcgtcgtcgttcgccgccgacgtcgtcgtcgcgggcggcggcggcggcggcggcggctacgacggcggcggcgacggcgaaggcggcggcggcggcgacggcgaaggcggcggcggcggcggcggagccaagatgccgcacgtgaaccacggcaggtacaagtgcgggccgtgggtggacgggcacgcgacgttctacggcgggcgcgacgcgtcgggcacgacggagggcggcgcgtgcgggtacaaggacgccgacgggtacggcgcgatgacggcggcggtgagccccgccctgttcgacaacggcgccgggtgcggcgcgtgctacgagctcaagggggattccgggaagaccgtcgtggtgacggccaccaaccaggcgccgccgccagtgaacgggatgaagggcgagcacttcgacctcaccatgccggcgttcctctccatcgccgaggagaagctcggcgtcgtgcccgtctcctaccgaaagtaagtactcacgtgtctatatatatgtaacgtgatatcatggatgatttacgtgctgatcgatgtcatgctcacatcgtactaacatcgtcccaaaatattgctaccctagttctcgataggacatttcaaatccagtcttattataaagttataatccactaattctaatactcaacatgtaatcatgacacctcatcatccgctagcattaattaaaaataaaacttacgcaagcatgcaacattatctataattcattgaactctacaaatcaacatccaatcatcttcactcacattattcttcacaatatttttaacatatatatatatatatatatatccattatttttataatacttaacatatatttatccatataatcaatgtgcggaatatcatatttcatctacaaatctcatacagagtctactatgtattaatctcttaccatatagtttgacaaaccaattttatttgttgttaataactaatataaattttacttttagctcgattattaaaaaaaactttaaaagctctttattaattttcgcagcaaagtgcggggaaatgttccatcggaaactagcgcttagtacctagtattatatactacctccatattttaatgtatgacaccgttgattttttgtccaacgtttaaccattcgtcttattcaaaaaatttatgtaaatattatttattttattatgacttgattcatcataaaatgttctttaatcatgacatacatattttcatatttgcacaaataatttgaataaaatgaatggtcaaacgttggtcaaaaagtcaacggcatcatacattaaaatacagtgggagggagtattgaataggtctgctacctatatttcatgctcgcatactctctccggtttcattttaattaacgttttggacaatgatatggtctacaagatacatttttgaccttatttttctattataatatatataataaataaatgcatgtttacttttattatagcattttaaaagacaaatctatatatgttcttctaattcctttaaactaaatatttttaaagttattggtggccaaagttataaaaagtttgacctcaatcttgtctaaaacgtcaactaatatggaaccggagggagtaccattttctcaacgtcatcccatgcgctagcactcgtccttgcgtaataatccctttgtattactcgatgattaatttgcacatcggtgtgcgtgcatgcagggtggcgtgcgtgaggcagggcgggataaagtacacgataacggggaacccgtcgtacaacatggtgatggtgaagaacgtgggcggcgcgggggacgtggtgaagctgacggtgaaggggaccaagcgggtgaagtggacgccgctgcagcgcagctggggccagctctggaagacggaggccaacctcaccggcgagtcgctcaccttccgggtcatgaccggcgaccaccgcaaggccacctcctggcgcgtcgccccccgcgactggacctacgacaacacctaccaggccaagaagaacttctagctgatcgatttttttcaacttatttacttataatatttttacctctccctccgttctctccctacttaattgatgaatttttggaagtgaaaactaattaacactgaatttttttcttacgaattaatcctctgcgtatttactaatttgagtttgaaagaattcgttgatagtgatatttgatggatattcatgtaagctttggaatcttaaattttgatgtactggtcgaaaatgccattagcattgcatttattctgtttttattattattattttggcttcaaagaccaatttttctgacggttccaacactgtgatggttttccctaatgtgtccacgtcagaaattgaatttttacaaacccgttgtacttatttctgttgtgccgtcagtacttatttttctttgcagaaacccacaggaaaatgaattcttcgatggacctttttctgacggcagtttctgtcggttcaccacaggaatttttctgtaacggtaaaatttatttttctaatggtccagccaaacatgctagctcgagcatgtggtctatgtctcctactctctagaattaatatatgctactgtattatgttgggcgttccgacaactataaactccctatcttattaaatatgtctatagattattgtagtaataatgggcttaaatttgtaatgatgttaatcataacatctctttagacgggtgtgtagctgatagtcacattagtatatctcacacatacatatatttgctcatcactgatatatataactttgaatgttctgaaacttagtcagatcatatgaatctaaattaaaatgaggttcatttgtaaaccgtccttcattataatgtgatttgtaaaattatatgcacgacattattacattttccttattttgttcttttatttgttgttggatcttatcaaatagatgtcaatgatctatttgtaaatattttttcccaaaggaaagtcacgtagatagagtaagagggtctatttgtaaatattttgttctttaatattgaaggtatacatagtagaattatactccctccatactcataaaggaagtcgtttaggacaatgtttaagtcaaatattgggaatataaatcataaataactctcaaattgttgagtttgaaaatataaaaattatatgaatagatttgtcttgaaaaatacttttataaaagtatacatatatcacttttcaataaatatttttatagaaacaagaaatcaaagttgtgttttggagaccgtgccgctgtcctaaacgactccctttatgagtatagagggagtattcacaacttaactattttttttcttagtaggccgaggaaacttcacaaagtattactactccctctatccaatggctcacattttttctagctattttgtcttcgtgtgaacccaaaggctattattttgttgatcatgtggctcatcctagttgatttttggaattcggatgtggtgtttaatttgatccaattaggtgtgctatgaacagaagtcaccattgatgaggaagatgaaaccagaggaaaatatatattttgttgatcatgctcgtcttggatagacgttgaggcccataaggaccgttagaatttaaacggctcgtataaagttctgcctaaatcgtcgaaatataggttaatatttggcccaacaatatgggcctcttcagcctggttcacagatagaaaccaatcgatacgggaatatattatatagcaacggtatgaataatgtgcaaagttgtttttttaattagactatgatatgtacaaattataaatttgatcgatcaatcacccaaaaagatcttaagaaaattgagatgatgtgctatttaaaagcatagagataattccaaccataggttgatcatctggaagctgagaacaattgagctgacatggttttatgaaagaaaagaaataagataggtaataaatttggaccagagattaattattcgagggctagttaataaatagaaagggagttaaaccttcgtaagtaagagagaaaattaatttgtacttctctcaaagtctcaactacttccaagtgtatgcttctttcaatgcattcatatatccaagctcaacagtatacatgctactctctgctcagatcaaacaagatctgacacaggaagagagatggagtatgcaagccaaattggtgtgtgtgctagctagttttcacatttaattttcagatgtgaactcgagcttaatttagagaattcaaagagagaagtccaagtccaagcacatatagcaaagacaaatcaataaaacatgggattaggaggcaccgagaacaaaaggagtgccatggttttctaataactttctgaattcaaatcttcctcatcagtttttcctaaaggcaacgtcacaaataatgcccttctaatgtggagtcttttccccctatgccactaaaaaagttgatgcttacctgtgtaccataaaaaagtttagagtcacatgtatgctatgagaaaaactttcgttgaccagtgtgccattccgtccaccttctgttagaacttaacggttccatagctctgacatgtgggacccatgtatgaaaattactaatttgcccttaaggattttcagctctcttctcctctcctgctatctcccgtgagtgcctgctctctccccgttgcgctgcacgccgccgcaccctaaccctagccgcacactgccgccgccgcctcgcctcgccggagccgtcgccgccgccgtgcgcccagggcagcgcgcccctgcgctaggccgtcgcgcctcctcctctcctcctctagggcccgcgcgttcccgcgtcctccctcgtcgcacggcgcgtgggcggcacgcgcggcaggtggtggttggttcgggagggcggcgtcgtcgccggtcaccgggtggtgcggcgccagggcgcagattggggcggtcaacgtaagttaggctcatggcatacaagtaactccaaaattttttgtggcacacaagtaaccagtaaattttttaatggcatagggataaaagacttttagatgtgccttcttgggaagttcactgggactacggttatctgaactgttgaatcatcaacaaactaaagtttggtgaattatgctttaccatagttttcgtatcacccacgtaataaacaggttcagaaaagaaggctaaacttcagcagaagagccatttagtgccatttttacactataatggtaaatttcacatgcagaggccaatcctaatgggccaggggatctgtggataaggcccaggtgcatggctggggatggcccagtggctgaggccccctcatccgcaccgcgcagttccatctccccacttatgttttatttttgttttctccatcgcgcgcctcatttgctctgatcggccatcgcatgtatgctcttattttattgatgtgaatcaagtttgaattgatgaatttaaaccttgtttgcatttacgtgcataaatgctttggaactttactctcaagagatatatatacagacactgaggcaggtgaaatgagtgagaccaaaatcataaacatcctcacaccgatatattttcggggttctgtatgacggttttacagttcaccagcacacatgtataggattgggagctgatctggaaatgaaaatggtgcaaattatattgagatacgtatataggattggaaggtattagagcaggtacaataatcctatgtaagcaggctataacaacaaacaagttatatttatgttgagaaaaaagagtgtgtgcgtgaagagagaagctagtgtgggcacttattttgtcgccagagctaacaccggctcccatgcatgctgtggggtccactagtgctcagcttatgtgggtgaccagctaaccttcctcccgctagtgtgaaagttgctcattcaggtaaaatataattttgatagttgtgcaaagcaataataccaactgccagatactgtataactctattgctaacgtagattgttttggagccaacaatcagctacactattgaacttgttctttgagtaggtataatagtgttgattcagccggagataacaagtcaataaccaccacatcaacattgtcatacaaggaggagggagaaaacatgagagagagagagagcagaaccagcgcttctgctagcaccggacgatagcagcaaattatacaaaatgaaatattttatttgcttcatgggtttctggttcagtttacttgatcttttatgtatatgtatactgtgtggctgcatacacagcttatttttgcgctcaagcaggatagaccatagagatagagtttagtttcgatcacacgtgcgtgcaataattaaacccgttcatgcttccttaaagccaatcttttatataaacaatctgcaatgtaaactatagataatatgtactccctccgtcccaaaaaaaggcaaaccctaggtttccgtgtccaactttgattgtccatcttatataaaatttttttataattcgtattttcattgttgttagatgataaaacacgattaatattttatacgtgacttgtctttttaatttttttcataatttttttaaagaagacggacggtcaaacgttaggtacgaaaatcagggttttttttttttttttggactcggagggagtacgtacacaaccgccgactgtttgagattaaagcgatgcatacgttggtttcagaactcagtggaaggcaccatctatttatcaatcaattaattatcatggacaaccgatcgatggagcactttggcggacaccaggcctactgaccttcaatgctactgtacgaacagggtttgaaatttcggttcgaactttccggaatttcgcccccctaccggcatgccgaaatttcaaacctgactatactttggccgtacgtgccacaccaccgctttttcgtcagatatatgccgtcgtctctactgctttgctggatccggcaaacaagatctgacacaggaagagagatgcagtatgcaagccaaaggtgtgtgcgctagttttcacgtctccagatgtgagtacatcttaatttagataattcaaagagagaagaagagcattagctccagtccatgcacatagcaaagacaaatcaatcttaaacatgggattaggaggcaccgagaacaaaaggagtgccagagtttcctgctgattaattttctgaattcaaataggaggatgcattatcttggaatttacggtttgccggttctcgtcttgttttgttacacatctgcctcatcagttttcctgaaagaaacggcacacttcagaggacgtctcacgacatggttgcctttgtgaagctgctatgtgccttttttatggccgctacgctgtgatcgagaaattgcaatctagacgaactccgctgttgttcaattttgtccaaagagagatgctgagataaaaagaagtggtaaacaagatgagtgaaatagaatggtaaaaatcaacagtaacaaaagtacaaaaccaagatcgatctcctcctagccctgtctagcagtagacagagatccgtgatttggtattcagcttactaaagtatacacctcgcacaaattaaaggatatctgtttcccttgctgtttgcacacaagattacgttaatagtaaatttcaaccataataggttaatccgcaccgcaccgcagttcgatctccctcacttttgttttcctcttattttctccatcgcgcgcctgattcgtttcattgtgggtctgatcggccatcgcataaatgctcgtattttatggatgtgaaccaagtttgaattgatgaatttaaacccttgtttgcatgtgcgcgcataaacattactctcaagacatatatagatactgaggcagctgaaatgagcgagaccaaaatcataaacattctcacaccgacatatttgtagtgctctgtatgaccatagtacagacaccagcacccatacataggatgagctactggaaatgaaaatggtgcagatctcaggaaccatgcagattataattagatacatatttaggattgggaggtattagagattaaagcggtgcatacatatatttggttggtttcagaactcagtggaaggcagcatctattagacgatcatcatggtttcagaacactgctcgtctcctcactcgactccccatctcctctctccgttgccttgccgccgcccgagcaagccgccggtatgccgagcggctgcgaggacggcgaccggtggggatttcggtgcgacggaggggagcttcgggtcttgtggcgcgggagacggtgcacagggccatgggcggtggtggccgggcccgcgcctggccatgcgcggcagcggaggaggccgatagggctagtggtgtagtagtcggcggggccatgggctgcggggcgcctggccgtggctggcgagacgtggcggcagtcctatgagaggcgaaggtctagaaatccgacgaagtggaagcggatccttccggctcgcgtctagttagctatttcagactggatgacgatggatgatggtgggttaattggtggcgcacggcgtcagctcacttgaagtggatgaaaatgccttccactgagttctgaaaccaatcgcggagtatcgtagcgataacgcctatgggtggtggcgactagacgaattccactcgtcgaattcggtcgtttcaggagaggatgtcggaaagcagggatgtctcgaggtcgtagttttttcgtttattggtggtatgttcttctctttggtaagatatgagtttaagtgctcttgtattcttttggctattttcttatggatatagagatcagattaggtcctccgatggacgatgcactttggtccgattttttttcaaatgcagccccataattcatgtgagctcgcaaattcagaatttaaatatatagacatgatgctcacgtgtacactggcgtttccatccaacttctagtccaacaagctaatgggcccgtgaattgatgtacagcccaacagcccactgtcagtcaaactatgatagatggatgaaccgtaataagcaagcaaaatagggcaaatctgccgatcgctgtgctgccgttaccctcaaattttcttcgacatccatcgttcctctatttactaatccagcaaacaaatttccttgaattcagatattgttttttatgttggaaatttgatctgcataggcagtgaccggtgagtttccaaatctgaaaatcagaatatatgttggcaatcttgatttgttttgcatatagcagtggcgcatcttcacaatgggtgcatacatccccgttggtgtaaaaaccggattttataaattcccattatcttaaaaaaatcagctttacaattggtttaaaattgagctgtagaatatcgattcgattaatcccacctgggccacaacaattgctgtcaccgtcggcggtggcaccaatggcatacttctcttgccaccacagagacacaatagaatcccgatgcatatggatgcaataatgaaatgcaagattgacgattgggacatcatacacatcatcagtcatcgtaagatcggagtcaagccggtttgtagctgcagttttatcttatgataggttttttttttcattttatttggtattagaatatgttaatatttgtttaaacttgcagattggcggtcaggccaacctcattgatagaacgatccggctgttggatgtaagatagtccctagaataaaatagaaagcgggcaacaagactattcgagagcactattaatgtactgtgccttgtgtcatttctaagacctatgttatgaaggctcctatatataatggctgcaaattaataatggtcctagcttttttaggggcctgatcagattatagcttttttaggcaagatggctaaaattttagcaggatttcttatgtatttaccaaatttggcaacaaactaaacgtatatattttttagcaactttaaaaaattggtatggttgaaaatagcatcacggtgaacagacccttagtaatgaaaaatgaattggtctttctagtttctagttttgttactatgtaataataatgtgacatacttgtggtggtctctgttcagagcttgcctatttaaacacgcatggtttaaatggtgttattttgcttttgcaaataattgtaccatatttgcttcttagtgtaatatatatgtttataattaaaaaaactaaagaacttcgattggctgacgaaaaaaagagacttaatgctactgaggctgctgagtagtgtacgttatttcgttgggcattagctcacccggatttgacatgttccaacgtgcatgccgcttagaactagaaattcgaacattgttcacatcttgaattttggggctgcattaatattttagatgcaaaaatgtcggcactttggtggacgccagttctactgaccttcaattctatgtactttggccgtgccacagtctgcgagatatatatagcccgggctgacaccctgtgcctttttccttttgtttcttttgatagagtgttttttttttgttttgttatgtagcgccagacgtaaaactctgcttatctaataggcaaagcttgattgggatcctccaaagtaaattcagagtgacgtggtcactaatatgtaagcctcaccacccatgggtcaacatgtcatttgaccatatcaggtgaaaagttacgttagaggattcctctccgaaaagattatatctattttgaaagtggacctctcggttatttaccttgtgccagctacgagaaagcactactagaaaaagcattttcgctgatgttgagtatctttttttgcaggcgggtagatctctcggagccaaatggctgcctacgaaaatggcaatcagggtcaagaccttcatctgcctgcgaaaatatatttttataggcggaccacataagacgccgcctacgataatattttcatttttgcaggcggacctattaagaggcacctgcaaaaatctcattttcagaagcgcactgctaagagctccgcctgcaaaaacccgcatccaactataaaaaaattcagacttatcccactcccccaacagccactcaaatcttatcctctcctctctccctctccctctcctctcaccctccccctccctctccgagcctgcaaagaggagagctggcgatccgggcgaggaggaggtggtccggcagtggcggcggttcggcgggga

SEQ ID NO: 21493 - DNA, 2973 bp, Oryza sativa
gaatgattttcgtaggcaggtgcttggtccgcctagaaaaaattgatgatttttgtaggcgtttaggtacatgcggatggtttgggcgtctgaaaaatgctttttccagtgaagacatcaaatgtcatggggatcgttagatccactcaaacttcacataaagcttttaaataaatacataccatttcaattaaacaaattaggttaattggatccatgccactccaactttatgaaattaaataaaatatcactactattcgtcatatcggctacatgccactggaaatttctaaaattgaaaccatgtctctcccgtccctttttttcgtctcctcactcacgccgtctccgttgagcgttccacgcggcctcaccgcttccactgccttcctccagctccagggtggccgcgccaagcggtggcaccggcggaggcggaggtgggaactttctgtggctcgcgcaatcaagtcggcggcggacaaaagggcgacaagcaccaacgccgagccgtacgctctgctctccgcgatctcccgcgggccgcaggagctgctctccttgatctccctcatcgcggcagcgctggccaaaacacccaaggggagcagcggcgagcacaccacggtcggcgcacactgagttcgagcaggtgcagtacgagccataccggtgttttgatgattgggggaaaaatgctacttctaatcttgatgagtgattctatctatgcgtggctgggcaagccgccgtcgccgcagcggcgaggtggataggagagggagggagatggagatgaggcgccgccggggatggagacgacgatgacgagagccgcgcgattctccgcgacgtcgtccggggagcctgctgaggtgcattcgtcgtcgtcgtcgtcgaggaagcgcgcggacgccctggcgaggctgcgggcggcggcggctggggtcgagcctgacgggcaccatcttcgggcggcgccgcggccacgggcacgtcgcgctgcagatggacacccgctcgccgccggtgctgctagtggagatggccgcctactcctccggcgcgctcgtcagggagatgtcctccggcctcgtctgcctcgcgctcgagtgattaaggtgtggggggatgatacgatgtgagagagaggagacggaaaaacggacgggagtggcatggtttcaattttagaaattttcagtggcatgtagccgatttgatgaatagtagtcactttttttttatttcgtaaagttgtagtggcatggatccaattaacccaaacaaatttgttctaatacctagcacgtttgaagtatttgtttgttatgttgttagcccgtgtggtccagaggtgttgtgttggttgaaaatttaagagtgagggaccgcttataaacctttatatgctagctccaatcattctacacctgaactaatccttttatattaagcgagtacaaaaattgtaagcgggaactatacgtatgtgaatccattaaaaatgtgtgtagagctaggctaatatggatagcgtgttaattatttattttcagcagtcggagaatctgagtggttggaattaatgaatgtgtatgtaccgcactttatgaaacaacgtgaacaaacaaagtgtacgccttgcatacggtacattctgcgtcgataaaatggaaaagattcagggtgttatataaggactacttcaggtgctaaatgttgtttgcaaattaatttggtatacatacatgtgctatatataagaatgcaacataaaaggagagttgagagagtgtgtagagagagccattcagaacaacagtcgcgttgaaagctgagacatgagagacacagcaatcgatagctagcatgcacatgatgcattgatatatatgtatatatatgtatgtatatgtatatctgtatatcggtaatcagattagtcttgtgttcttttccagctacttcactgcaacaagaggcagccctgaactatctagattgtgttggattactatgttcttggttggtttctaacaccactgacctaccctttctgcttgagttggcaccaagtcgaaacacaagtggttgaccttgtatcgatttccactcaaacaagtgtgtcgtatgcttagaagatcaagatcagggggtcggtatataaagagatatacattgaagatcacatcaccattcagcacaacaactctcagaaattcagaattaattaagccggaatccaacaagatacttgacatggcttgtaaaattaagataatttcaagtgttgcattgtgaactgttggctttcatataaggtcggatcttaatgatctgttatctaaaaaaaatagggctgctttgggttaatatgatgaacacaaatatatactccaattggctcattcactactagaaaaaatattttttatggcgttgccctatgattttcgctagcagccaaatggaaagccgccagcaagtacgtaacgagggctgggggctaaggaccaccagcgaaaatggatcttcgctggtggcccggttaagtcaccgctagagaatgatacatcttcactggcggactgtcaaaagatccaccaacgaagaataatcgtgcgagacgtgtgatgcagcgatatttttttctcaccgcgctccaagtcctacctctttttttttactcacctctcccacctacctctctcccagattgttctcttcaccacctctccctcaacctctcaagctcgaggcacgactactaataggcggcaaacagtggcggagctaagtttggaggagaggggggcctcagccttcttcttcctcctccagcccactctctccccccattttcttcttcctctccctcttttccccctctcctccctcaaatttccatggagtccagctgggtagcgggggctcgagccctccccccttcccccgcccccatactgg

SEQ ID NO: 21494 - DNA, 2414 bp, Oryza sativa
ctgcagcccaaattgttaacaaagaaatactccctccgtcctctaatataagggattttgacattttgtatatactgttttatcattcgtcttattaaaaaaatttgaaattattatttattttatttgtgacttgctttattatccaaagtactttaagcacaacttttcgttttttatatttgctcaaatttttttgaataagacaagtggttaaacagcgcaagcaaaatatcaaaatcacttatattagaggacggaggtagtaaattaaatacgagtctagtactggtttaggtctcgcaacgagttgcaagtacatggttgttgataaataaatacatccaacctagtacagtttcatcagggagtacattttgacaagatctataaatatggtacttggtcagataaaatgagagctaaaagagaggagaagagaagggatgtgcattttaaagttcttttctacgcctcaaattgaaaacttcagctcgagctgagggctcaaaagagagaaaaaaaataagataaaacttaccagtgagttcatatcagcgagggaacagagagattttatagcttagctagcatgctgtaatgaacttacatatgggattgggaggtattggtaataaaagaatcactggtcgtagtcgttcatcgtcacactttttagaccctgtttgtcacaactctaaattctaactctcaactctaaactccaacttaaatggaagctagctcctataaaagccgagatgtgtatagaaagtgtttggctagattactcagctccacgccaccatgtctctcgtcaccattttatcgaacaccatgttagcgtcaccctaccgttgccgttgccggttagccgagccgctgccgcgggtcagcctacggggccttaattacaggaggaattgtccattgtgcttgtcttgatgagtttaattcctggtgtttaaatctccttgtaacagagttgccacttgtcttttcaaaaaaagaagttgccacttgtactccagcaaaccgaaggtaccattcaggctgtatggttgcctttgtttcagttgtgcatgtcacttcaacatttggaaggaaaacagtagacgaaccttctagaatgaaagtgactctgttgattctaatcatcaaggaggatgtcaatccattagtgtaaaacacacccatgatgctctaattaattacttaattggtaggagtatatatgtacatgcaactgatgtaagctgcgacgacgtcttgtaaaaacaaaccgcatgaactctgaaaccttatctttgctttgtattgtaacacatttttagcacctgctccctttacaaaaaaaaaaagttatgacaaataaagcaaatcaggtgacaagtttgaatctggtgatgcacagaatgaaaaggaattaaataagatgacttttactatacaatatactggtagtatatattgctagtataaataaggttatgttgggaatatgtcgcaaaatagaaaatgatcagtagttatttcgtgttatatcttcactccgatagtaattcttattgtccgtatgtcagatcggattactgaccggatatggctgaatacagggcacaaccaaatgtttttgattggatcgatagattcatcaaacacataaaaacattaacccgtgttagataactagtgaaacacataagaaaaataaaccattttacccctattatactatagtcgatttaagtgggtactaaaatcaatctacacccttagattgtttatactaccagtatattgtaacagttcttaaaataaatagtagaatgagagatgaacagaaacaaaagcatctcgttctgtcatcaaaagataacgtgtcaggttatttggcatatcaatgcgagggtatgcaaataattaaaaatctcacgagaagatgtatataaaaactactcacgacaatgcccttctttaaaacataaaaactactcagtgcagctcttttaacagcatatattggtttccattctttttgagcagaagatattacaactaatcagtcagtataaccatagctcttcaaatgtctatactttgtcttaagggttaattattggctaacgccagatgacacaaaacacctactccctttgtcccatataaaagccaatcctagcatcccaagaaaaaatagtgaaggacgaaaatgaccaaatgcccctcattatttttaaaagtagtaatggtgagtgatatgtaaagggtattgaaagaataaaacttcttgtttttttatatgctgagggtaggtatgatggtagaagctggttttttgggacaaaattcaaactctaaaagttgagtttaattttttggggacggagggattatatgtgacaagtccaaat

SEQ ID NO: 21495 - DNA, 1445 bp, Oryza sativa
tttcacagaagatcaagaaagagctgcaaagccaatttggaccataacatgttccatagtggtcttcaaatatgccttcagaagttcacgttgagcttctgctgtatgttcattatctgaagaaaagaagtccacctaaattatgctttacaatagttttcgtatgactccgatcacttggtaagttgatattggttctgaagagagaaggctaaacttcagcagaggagccattttggcttgacagcaaatttcagtcaatcatttggctgaccttgtcggatgctctgctctgtaacaaccaaaacacaaatttcgatgttataaccaggtggtgaaaacatatctatctatctatcttctattatatactaaaagtccattaaacctgctacaaacgctcctaagctgccaagtagcgctcctaaaaacactcttaggttgccacgtggcagtttataatctcacaatcgattttcatttaaattggtgggcccattagattagatctattgcttcgtcttaatattctctgtagatataggtgaaaccgtttacaccagaaaaacatacgtacgtactatggaaagaaacgatcaaacgaacccttcagcatacgtacgcacgtacgatgcatcgtaccataaatagctattaaaaatgataaaagaaagatactattcacttgaaaaaaaatacttatatatgcacgagtaaaaataataaaagctataagacctaaaaaatatataagactagaaaatatatgtacgtcggtataagaaaatagacgttttttaaaataagactttctatactataaaaaacaaaacttattactccacaaataaggtggtctagcgtttctacaattgccacatgcatggctctctacaattttgctatcaattttcatttaaaatgatggatcattattttagatcattagatttgctcatttcctcttaatttcctcggtatacaaccgaatgttctattgaaaaaaaatacaaagacaaatacatatagacgataataaacctttagatattgttcccttaaaaaagtacgtacggatacacgagtaaaaataaaagccataatactctaaaaatgtatatacgtcggtaggaaaaaatagacggtcttttaaaaatacgattatctatactataaaaataaaatttattactccacaaatattatcatgtggcgtttctgtaagcactcttagaataccacatggcactctatatttcgttgtcaattttcattcaaaatgatggatccattattttatatcattaaattagcctgcttcctattaatcgagagaaaccatttactggatgtttgattgaaaaacaaatataaagaaccatacgtacatacgataagaaagttataaagccaaaaaaatatttatcagagtacgtactacgata

SEQ ID NO: 21496 - DNA, 531 bp, Oryza sativa
tctttctcaccctctggctaatttgttctgttctttctttttcccaatataggttgaagcttacggaattgtgctaatgtaacaggaattggaacagaagctcaaggcatcttcgaaccagcgtgaccatgatgaactctaaattatggggtgagacaataatgaacttgctacaaggaaaacaactctcaccatacagccatactcacaagagaggtttaacaggtttattatatgaatagaatagcatatgaaactggaattcttggagttcagcactcggattgccaccgaagcagcattagtttggcaagaaaaatttttgaacaaaagctgtaggatatcgcgaaattcctcaccctgatttgtcggtagattttcttttaccactcttccctgtaaacgtatttgctcaatttttctatgccaccccaaagatgctagactgttgtttgtaacaatctgagtgtttctgagttatgaatagtatatttatgaactacatcctggatattcatcactctggatgta

SEQ ID NO: 21497 - DNA, 725 bp, Oryza sativa
attaggggcttctgtgaaaagtttagacaaagtcaacttttcacctcccaaatgttggggtgtgtaggatcgaatagcaagaactaagccaactagctgaggagaggtgaatggttggagtaccaaaaatcaaatttttttagcggaattaaaagttacccttgttatagatcgagatcagtctgactgaaatagaggctagctggtggtggtgctccaatctgaccacctgctgttgtttgtcgccgcctccgatctaaccgccatgagcctaccaatatgaccgggtagtagtcctcggcctgacagttgttcactcgccggtgtgaccgttgaaactcgagcaaacacaattcaaagatctctcaaagtagattgtttatttctttctactcatgtttacaagtgcaacaacagcatccgtcacataaatctcgactaaactcgaaaccctaactttactctaaactcaactctcacaaaatcgataccgagagttctcaaccccccctcccccttctatttacatccaaggtaggcagcctaaagtcacaaatccaacttgtccaagaaatcttaattcactaggaaaccttttcatacaagatacaaacttatcctaacacgattcaaactccaatcttcccaaatttaaactcctttcaaatttgactccttatctcatacacacacaatttccctatcgtgtgtgagatggaatcttc

SEQ ID NO: 21498 - DNA, 886 bp, Oryza sativa
ttttgctatttagaaaatcaggtttctccaaattacttgggttccgaagttagtaataagacttgatggtttggtgtttttgttgacctttatggttaggacatacaaactttaatttgggtaagaaaaacatctcaggttaaattcataggagattgtgtaggttctgtgtcatgttccagattatatacaccatcagaagctgaaaatgcttctagttgtgaccagatgagggtatattatttatttgagtaaatttcacatcatttattctaaatctgtggttgctacactctactcaattttttggtactttaataactgatgtttgttatggtgtatatgaagatggatgaggaggagcaaaatctcttgaatatcacggaacaggtcaaccatgtagttgtaaatggtgatggtgaagttaaacagttccaactagaggcacagacaaattttgatgtgcaacaaaaacagatccaggtattacttttgtgttccctattctttgtttgatcttttataacctggattcccatgaatattatttctaacagtttatactaccataggaattgaagggtgctctttcttttgtcaagtctggcatggaacaactgagattacagtactctgaagaatttgctaaacttggtaatatacagttctatttgcgttcatcttttttgtcatcacagaagtatttaatatatccatttttttaccatgttgtaaaagggaaacatttctacactctctccaatgcggcttccagctaccataaagttcttgaggaaaaccgcaaattatacaaccaaatacaggaccttaaaggtataattttgaatgttgaaggaacagatgcctgttatctatggtattttat

SEQ ID NO: 21499 - DNA, 521 bp, Oryza sativa
aaaatttcttcatggtacatatggactataatgtctagtcccggcgtcccagaaaggaggacgttctgctcctaaccatttgtcccataattcttgacgctggcagcctggcagcctggcaggcactagcaaactcctagacaagcacacataaaaaaaagggtaaataaaaaaaagaagtggggccatctaaaacagtactagcgaactctttcttctccaaacgatttttgctctgaagcgctaccttatcctctcctctcgtattctcttcttccccatcgctcgtctctcgttttcttctccttccacgccgcgtcttccacaccagcaccccgcttctccctcccatcagcacaccgtaccaatccccatccatgccccctcccccacccccagacgagcaagccatattcggtgtgcgacaacatgctcaacggccgcggacacactgagagcgccatctcagcaatggcggaaaccctaggggttgcagcggcggcgaacctaggggctatggc

SEQ ID NO: 21500 - DNA, 822 bp, Oryza sativa
cccttctccccgtctccaccacccactcctccacgccgtcgcgccgccatcgtagtgccgccgcgccgccatcgtagtgccgccgcaccgccgccgtcgtgctgccgcgccgaccgtttccgtgcccgcaccgctgttctcgcgccaccgtgagccgccgtcgctgccgccgtcatcgccgctgccgccgccggtgagtcgccctccgtttccctcgagtccgccgtcgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaaaaaattaagagggaaatttaaaatatttacaaatattagaatttaattgtaggattaatgaaaatatagttagataaactcttactaattaaatacctaaaatactagcatttaaatataggattaatgaaaatataattggataaattcctatagattatagataacttttagtactctccataagaaatcaattcgcggtattaatttagatgtaattaataattaaacaaatgtatgaattctcgtaaattattgtggattatttctgggaaatctctataaataatcgatcaacggtagcgattcggatttaattactagggtgttagccgtgtattatatttaatcatagactaaattgagtcgtataatattataagataattttaggattccgtccgacatttagctcgcgataa

SEQ ID NO: 21501 - DNA, 3301 bp, Oryza sativa
cattaatggttgtctcaactgcggtaagataatagcctttgatgatatagagctcacacctgactctcccttagtacatgccctaaacagtgaaatcagatagattttactctatcacgacttctctaaatctacatggatactagtttaggcttagatgagattctcaaactcacggtgtgttcctttgattcccaattcttcccattcctatgtttgtagctgaggtacatgcaggccaaattggcaagtagtaatccatgaatctcacggtatagtaactttatcttattgtgaagttctcagccagccaattctcgcctcttggttctctctttaatctttccaggaactaggacataccatgtataaataatggatgattacacacccttgtcaagtccataacttgaatgtcatttaatatgcgcatgctggcaaaacttgtggttgtaagtagtagttgcaaaaattagatgctacgggtacagctgaagtaaaaggaaccagtggttaactttccatactccattgtcttttgttactgggggaaagagatcgttaactttgattacaccattattttgccttaaacccagtggtttaagcagtccactccaatcctagggatccaattatcattctttacatcaatagttgtaccatcctcaaggattgttttacccggaaacatgagtggcgatctagtctcagaattgatggtccttaatactactgttgatgtctttcttttagtgtgttttagctgtgtgcatcttagctatgcagaggctgagagtgttcttaggataattgggtcactttgatgtaattgactgagaccaatagaacttccattatctaaaaatagttgtaccatccacagttctccaaataagtcccctttacaggagatcccttccatgcaaaaatatactctatgcatatgatgcatgcctgggacaaccaacatctaggaacccacaatttcgaaagttcaggttcagggtttgtagcagtctccatccctgtcttgctgcatcaatatgcaccacggtactgtctggctcttgcgtcaggcgtcaagccagtgccagtgtaataccatgttcaggtcataagaaaactgaatctaattatttggatgcatgtagtaagaagggtgttgtagattgatggacatcaaatagtcctatttactgtacctctcaaatactgtttctatggcaacgttttgttctcccactactaacaattcagtgagtgctataacagccatgcagcttccaacgtgcagagatctgagagcatcctttttttcaggtcgtcctctaacactgtttacattgttgatctccagggattcgttgaggcatttctgttacagttaacacttcgcaacgaaagcactggtacacgggagatcttggatgatggacacgctgccagtgcactcttgtggttcacgatgcatcccatttccatgtatgtaatgtaactacatggcctcgtcgagaagttgtcggcttcccacttcccacccttttttcagctatcctttttatttggtagaaccttttatatagtccttaagttatatgttattctttttatgaatcctgacaaagcagagtaaagtgcatggcaaaccccaaaatttgctcgtctatgttatctagacatatgtttggttcagtaacaaaatgagatttgttggactcacccctatttttggatgagatggtacgtttcatctatatccatttgctatgaggaataggatgatcctattttttaagggatagcccacatgctcatggatataagtcctacaacttgttacaatgtgtcattctagtcccaaattaattacttgtggctcgttaaaaaaaattccttccacaaatagtcaacatccaaccaattttgtcaatcaatgttaaacattataacattagaataaacccaatatgagtcataaataaattgtgtatgggttataaaattgcaagcatgttctttgcaaacgtttggaggaaatttttttcataaacgcgaaacgagaaagctcgttaagagatgattaatttaatattaactattataaacattaaaaatggattttttttgttttttaaataactttgctatagaaatttttttaaaagcgcactatttaaccaaaaaacgtgctaacggaaaactaaaatgttggagttgaagaaaagaaggcctaagtctttcctccgcactttgtgctcgcttgataagagcctgtgggaagagctgatgttaacgccaaaatttgactggagctaagcagatctcacagatcaatgtgtgtttttcgcatcaacagctagttgtgttacagtgaaaacagatagattttactctatcaggacttctctacctcgcagtggacactagtttgggattagatggttgtccaactcatagcgcactctgttgattcccaatacttccgaatcctatgtatgtagccacggtacatgcatgccaaataggcaagtagcaagccatgaatctcagagtagtattgttatttatcttactgtgaagttcccagctagcctattctcgcctattgcttctctatctctttttaatatttccgagaactagaagccactatgcataaataataggtgattacacatccttgtcaagaccggtttcacgcaccggaggagatactatgcataaataataggtgattacacacccttgtcaagtccgttttcacgcaccggattattcggaatatttccaaaacaaaacacatccgaatttcccacagcaaaacataactgcaaaagcaggctgcatctgcgtaagggtgaggaaccaattttaagtctgttttcacgcaccggatttttcggaatatttccaaaacaaaacaaatccgaattttctcggatttttcagaatatttccaaaataaaacaaatccgaatttcacacagcaaaacataactgcaaaagcaggctgcatctattcgatgcgtacgtcgcgcgccgcctgcccggcccggcaagcgagcaagcgcgtgtgttccccctcttctctccatctcacatacttcaagtggctaggagggcatcctccctaaggagatccctctctcctagaataagtaaggtggtactaaactcgctatgcatgccatcgcatgtggtggacttttctgatttttcaaagaattaaacttcgagtgggctaaggcccatctattaattccaacaatatgttccttacaacctacataatgtttga

SEQ ID NO: 21502 - DNA, 1874 bp, Oryza sativa
atattgggagcccgctaccaagaattcaatgagttctataacagccatacaacttccacctggtctgaaagcagccaatcagctttttatctaccccttccatttcatcgtttccggtcgtcctcaacactgtttacatggttgaccgagatcgatttgttcgggcatttctgttacagttaaaccaaagagggttatctgcatcaacactttgcaaccaaagcactggtagtcaggagatcttggatggacgacaagctgccgacgcactcttttggctcccaatgcatcccatttctatgtatgtaatgtaactacatggttcgcttgtgaagcactggtctagtcgagaagttgtcagctgcccacttcccactttttttccgctgtcctttttatttggtagaaccttttataaagtcctttaacataaatgttattctttttatggatcttgacaaagcatgtggtcacgaagtccctaaaattctctcgtctatgtcatctaggcatgtgtttggttcagaaacaagatatgggttggactcacccctgttttaagatgagatggttccacttccatctgtccatttgccatgaggattgtgatggtcctatgttttaaatgatggtccacatgctcgcagatatatataggtcctacaacttgttgcagttgtcattcgggtcccaaattgcttgtggctcgtaaaaaaattccttccacaaatagtcaatatccaactaattttgttctaaaatcatctgacccatccgccaattttaagtattataacattaggataaaccgaatgactcattaaacattgtgtatgggttataaaattgcaagtgtgttctttgcaaacgtttggaggaaaattttctcatacacgcgaaatgggaaagctcattaacacatactccctccgtttcaggttataagatgttttgactttggtcaaattcaaaatatttcaagtttgaccaagtttatagataaatataataatatttataatactaaattagtttcatcaaatcaataattgaatatattttcataataaatttatcttgggttaaaaatattactacttttttctacaaacttggtcaaacttaaagcagtttaactttggtcaaacttaaagcagtttaactttgaccaaagtcaaaacatcttataacctgaaacagaggaagtaattaattaatattaactattataaacataaataattgatttgtttgtttttaaacaacttttatatagatttttttaaaaagcgcactatttaacattttgaaaaacgtgctaacagaaaacgaaaaagttgaagtaaagaagaaggcctaagacatcaatgcagtcctgatctgatttggttgattggtcaagtcaacatatgctatttttcttcctttcgtctcccaatccaatgtgtgtaggctacactagacttacaccaatgaagtattgaacctatcgttggtatgtaaatcccacataggatgtctaaatttacaatgtttgggtattgcttcactttatactctagcttttatccactgaggaagcaacacatacaatgcagatataatgtatgatcatacacctcataaagtccataataacttggatgttattgaacttgggcacactgaagaaacattctgttgcaagtagctagcgaaaaagggcataggaacatctgaattacaaggaaccattccttgttttatcttgttggctatgtacaccctcatgtacctcaaatatttcaccccaaaagagagtttagctagctgtcaccattgtcaggtgggatggaatgcacttgtggctgatatgggcccataatatttggtcc

SEQ ID NO: 21503 - DNA, 805 bp, Oryza sativa
cagatggagagtgcggaaatgagataaaagggcaagtgaggttttgaggtctctcccacagaccacatgagagttttttcacttctacatatgtaagttactagagaacagagagttcaaaagaggacaagaaaatactctcccatgagtatttatcaataagagatccaatgctaacatatgtgtggttacattatgggactgggaggtttcagaaataaaattaaggagagatgaaatgaagttttgggcatcccaaaatcaaaaggtagtaaacatgaagcttatggttatgcatgatttactagcttctagctgtcagctctcggatcgacttagctattctctaatgcaacaaaccgaagaagtcaagtcgtttgtccaacattttcttgaagcttatctggtagatcgtgttcccataatataattgatattacaacacttactgataaattggctcttatcaaagggaacccttgtactttgattgtactctcgtgtaacaggaaacgttatttcaatcttttccagatgcattttcgattcggttatggaattcaaatgagataatcatttcagtaattcagaaactattaagggggcttatatgaaaagttctggcaaaatcaacttttcatctcccctacccctggtcctgatttcctgaatgtgtctcactgttgtctataaatggatgcaggtctctaacttgttgtacccgataacaaattttatttgggaaattatagatgcaaaatgttcctgtgacacaggaggaagagagattagaagcaagcaacgt

SEQ ID NO: 21504 - DNA, 32019 bp, Oryza sativa
  unsure (1)..(32019): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcattccatctttccctctgaatgttgttttctctgtttagagtcctagatggactcttgggtaaagttcagaggatatttggacttctccttcctgcagagattacatttttttcgcggtaagaaatctaaataataagagaacagaaacaacatcattttccatgtagcattaagaggcttaacatcaacaccgtgaatgcagggcatgtaacactcagcttgccagagagaggaacccaaaaaaaaaagatgttctacaaatgcacgagtaaacataagaacgtagagccagctctaccttatagccatttcattgatagaaatgataagttacattgttacatgattgggaaagagtagaaaaaaagaagagaagaacagcaaaatggaatgtacaaaagtgtaagaaaaaaaatactatacattggcctcagatgattaaaggccgattttcactttgattttattactgaccggcacgagtaatttttaatttcggttttcagatcgattatcagatttccccggcacacagttttccaatgagggtatggattaaaataatacagattatgtacgatttaattaatctgatttcgattgacacagctaggatgctcaattatcacttccatttcggatgcccttgctctaggcaggagttcctcagcttctttcacgagggaaccaagagtctttaggctgctgctacagccagagataaccatgatgtcctcgatttccgacatgttcctcgcagccttcgacagtgatttaatcaagttctctgcttcttctacggtgtaacggcttccatgtctaacgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttctcacaagcacctgcaacattatgtttatcttcagtatgacaagcgtaacgatccaacacaaagactaattatcaccctatatatgatgctgataaaaataaagcaagtgtttcttttcttgcctcaaacagactatacctctggactcttaacctttaaggcttccttgaggctctggatatattcatcatcatcagtgtgatgaacacacagctgctcgaggatttgcgcggcgcttattctgtattccttgggatatctgtcttgtacaagtatttttgtgagatcaccaacgacatcatctttcacttgtaagattaacttggcatttgctttgccatgggaacatagcgtcgcaagcttttcacctaccactgccaacccaaaaatgatgttggcctccttataaactttgtgagtgaagatgagtaacaatttctcaatgaaatattccctcgtcactatgttagaaagcgtgtgctcgtgcattcgtgtgtaaatgtccaatgcttgcataaacagggaactatcatggaacgatccgagcccacatccttggcaacctagaatcctctccatactagccatggcttccacgtctcctgagattttgcggcggagttccttgccagtctggccaggagcatccacaagccggagaatcacaaccatcgaagcatgcactgttctgaaccacgcactattagggtcatcgttgtggttgagcaggccagaccgcagaggcgccatgatcttggctagcaggccctccgtcttgttgatggatcgctgacagtcctcgtgtgcagcgagcttcatgaggatactcaggccctgcagcatcagttctcggtaatttacagggatgttgccatcacaatccttagggggaccttcgagcagagaagctatgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgataggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctggagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatatgacaactactactaggttgttcaggtagtaggagcgtgaccgtgatcggccatagaaccagctaatggcacccctttccgtttccaatgtatccgtagctgagaaaaagcctaaaaacgacctccaagtatatcgtagcttttcgttcagaaagatgtcggagactctgtgggtaaatttcattgttccagttagatggtgagataagtaatcaagagctatataggctggtggtaaatctgtgcatttcacacttatcaggatatattacatagattttgaacctatctagcactaatatttttttttggaaaatacatatcaacagccatcggatacttacatttttcatatgtattcatatacaaaataaactttcaaatctctatccttgcaggggaaaaaaaccgatccattataattttgaagtttgaaatggattaatgtaagttttctattcattctggcctttgtgtgtcttcgacacaacagccctgatccattatactaaaaagttcaataataattcaaagttcaaaaaataattattaaaaatatgtatttggcttcaaaattacatgggcaatccatcctaaagtgttctcaccaatgtattaggataatgtcgaccccacgatggagtttggcacttggtgttgcacaaacgaccttgtcagcggtggaggaatttggagcttggcactgaggcactagtggagtttgaagatcagtgcactgcatggacgcactgagtaatggtggaatttcatgctcaggtaggacgatatatagaggtatgttttcctaattgaggaaatgaagctcttctcacaattgagagagattacaagataaagaatacaatcgtgtttggaataggccagattgtgcatatgctcatcgcggtattagtgtggccgtttttgtattggtcatagcctgaagtttgtaccaaaactaataaagttgacaaaaggtcaaaaagcacttacaccaaaagtgagacctttctaactcgcaatgaattcaattgttgaggtttgctagctctagaattcgactcaaaaaggagaattgtccaatactcgaatagttgttaagctattgagatttgctagctctagattttagctcctgatgtcctacatgccagtgactgaatggatatgcccacatgaactttcatcaggggatgtaaactacttgccagtgactgaatatttagaaagtggaactgtcttagcagaaaatatagctccaaaataaatgttttatgcgagcttaaaatataaaattaagatattgagcagtgcaaagagactaacccagcggtctggacaagggtaattattgtgagacaccaaaaatccttcttccccagtatggagacgaagccaccaagaaggataacagtggtccataaaacaagaagataacctagccccttgacggccatagacatgtgtcccatgaacagcgcgtagttgttgatggagctaacttcctcccactctgagtcatcaacgggctccattccactagtcattcttcccttgcagatgtgcagagtggaggtcaactgcaagtctgcaacgcaacaaagccaatatgtaagcccgcatgctcagaactctattcgttgtatactcgtacataataaagcctggagatgcacgccaagaatggaaaaaaaaactgatctacaagaagcatggtcattcttaacataaatatgtccatcctattaaatttaatcagttttgattagcatcaagcaaggtaggctgactttggttttgtcaaaatctgttcagttgattgtttgagaaagtcaaaggaaaaaaaatcatatggtgaggaagcaaaggcctcggctagctggctggagttagtgtaactaaagaagaacagcccagatcagtggatcacagatgttaccgtaattcgtaaacatataatctggttgtcagcataaataattgttggtgccttttcgggccaatacagattcacctaaatatttgttgcaaatttggcctagtgccaaattgtggtggtcaacaataatattccgttttctcaaatcgaatcccaatagatcaagttgacattatatatgtgtacgatgggaaagcaaataccatggcgtctgagctgaacagcagaatagtcaagctaactgttggggactttggaacagtcagtcacctgtttaaaacaagaaaaataaaattgattcgatagcatcaaaatttcacgatttcagttccatatagcacataaagtcagtgatttcagttcccttttccgaattggttgacttgcgttgaccggctcacaaatccaaacagcccatttcgctgcccaataaagcaaaaaaagattatccatctagggagcaacatgcgagagaactgcaataccttctcgtcggcgatgggcgaggagggacaaggcagccgggacgagggacggcggggtgaggctgatgctgccggagagccgcgagcccgcgacggacgaagctgatgcggggcgaggagcacgccggcggacggagatgaacgccggggacgatggccgccggcggtggggatcgactgataaaaggttgtgcagccaagggcagtatagtaaaaaccgagtcactcggctaggtcaacacaagtcaaccaaaacgggtaagcaagcagaatgactgatagggatatataccactaataaagtgaaatgcggagtttgtatgcaataaaactgaaattactacgaaatttcgacgatattataataccaatttcacctatgaaagcgattttgggtggaatttgccgtacgtgtatggcaactttggttaagtatgcgctccctctgtgatcaatctatctatacctctatactcgtattaattaggtactttctacgagcttttacgttaacatgaaagatccgaccattagattagattgatggtatactagggccgtagatttaaactgtaaacatggacttttttaagggaaactacggtgggtgtttaaggcaccagcctgaagttttattgaaatgaagaaacatttacaggagaggggttacaggggatgagagggggagaattaaattaagaattaattacaaagaggtataaggcccacttgcggagctattgtttgctcttaacatttttacatcgatgggaccaaatgtcaatgtcgctagcacaacgccggagaactaacttagcaggttcatcaagagaattgaagaccttgttgttgtgtcgtttccaaatattccacatgacggcaaggaggatagagcgccagactcgtggagtggcgggttgtctgggtggagggatgtcccagacaccttcaagctgcggcagggaggcgatctgttgttcgtccaggccaaaggtgtgccatattgttgccactccggtgcagcgtaggaagaggtgctccacatctttaacagaggagcaaaaaggacaacgtgcggatgctactaatccacatcgagcttgtctctcattggtgaagatgcgcctcttgtgtgtagtacaaaggaagatcttgcatttgacttgagcgtggttgtcccaaatgggcttagcgaaaaggtcatcctataaccctaagaagcttaagtcgtaggctgtttttgctgtgagggggcgatttgtggacaaggtgcgtctgttttttatctctgggtctagctttaggtggcataccagggcttggatattggccaattcgtgtatggccactgtcgacacagtcggggccggagatgaaggagcaattcaggagcggtctgttagaataattgggctaggcccaacttataatattaaatctcaaaggcccataatacatgttgaggataataataccacctctggatttaagcgagaaatatctcaacctaaatagggagttattagaggctccctgttgaccagttgaggtgggggtcggaatgccacacgcgcgcgcgcgcgccgggccgggccgtgggcgaggcgaggcgaggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgatatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgtttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacattccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgcgttctgggaaggacatgtgggatgcacttgaggccaagttcggagtttctgacgccggcagtgagctgtatgtcatggagcagttctatgactacaagatggttgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcagttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgagacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacagcctcgtaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatatttatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaatggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagtgatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgatatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgtggcgtggcgtggctggctggcggcgggcgtgcgtgcgtgcgtcacgtcgctatccttttgcagccactaacccacgttcccacgattccctccgcaacagcgcgtccacgttctttctcctgatagataaggaggccgcgagtctgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaaggaagtggaccgaccatctccaatgatggatttcgaaacactacggaagtgtgtaaggcccgcgacgatgtccttccagatgatcgtgtcaaggcgcaaaagatcgcctagatcacacgaggcagaccatccgtagtgatcgcgaaagcaatcgatccacggtgcagaatcaccctcgtgcattttgaggagaaatttttggagaagacatatgttctgtgtcttgagattttttatccagcaccacctttcgctttcggagagcaaactatgttacacgcaattttgcaattgccgctgtgacagttttcttcccccgtccagaagaaggcccttcagcgcttgtcaatagtggtaatcacttctttaggaggaaggatagcccccatcatgtatgatgggagggccgagagcaccgaattgatgagggcaagccgaccatcggaagacagaaggtgaccgcgccaaccggcaagtcgcttgtcaatcctagcgatgagaggttgacagtttgcaagacaaagcttggtaacaaacagagagagggaggcataaataaggttgggggaaggaagctatggagcaaccaagaatccccgccaactgaaacgccacgtcatgctgaacgttaatggggaggaaggtgcttttacccatgtcaattccttctttttaccatgcatcccccgttcgttttcccatgattttagatactttttttttgtccccgatcgaatcacagatcatttttcattactgcagttgcaaggatgtggcaaaaaatatcatctagaccagttggttgatttgtcacctacatttattcagatctaataagaatataagtcaacaagttggtttttaaattcgatgtgtatatatctttaagccgacgatatgtatttcagtaatgacctttacccggtgaagcttttttttcttaattggtatatacaggataatagtatgttttaaactctctatcaagaaagagcagctaagctggatgggctctccaatttatgttaatttaataattccctcgataacaagataaatgatctccagtcatttcttgaccattgttctactttacctatgactttataaaatcctgtagcaacgtgctgagtatcacccaataaacataagaaaacacaccatgcatgttctagtgagcatcttgatgctggtaggataactagcgagctaaataaagctaagggtcggatgcgacatgggtgctagcgaatagagcttttctgccttgttagggtgcgtttggaatcagctgttgcatgtccgagcagtatatgagcgcgtgattaattaagtattttcttttttttcaaaaatagataatataattttttaagcaactttcgtatataaactttttttaaaaaacacgccgtttagtagtttaaaaaacgtgcgcgcgaaatacaacggagagggattggaaacacaggattccaaacacagcctgaatcgtcattgatacaaggaaagatgggaggaggaacaagagggagaggagcaatagtttgggggatgatcccctccattaatttctcattctggatctgtgctacttcctccgtttcataatataagtcattctagcatttatctatctagattcattaatatcaatatgaatgtggaaaataccagaatgacttacattgtgaaacgggggagagtagctaggaatggataaataaataatgttatcccaaacagaaaaagttacgtacggccgggtatgtgcttcacgtgaaatgggaaatatatacaatcaatgacgactaatttggcagcaaacatgcatgcatgggccagttaattaattatgctaaatggatagtttgattcgatgagcagccggacgactgaggctttcttttgttgggaaaaaaattaggtttgattgtcacatcagatatacggatatacatttgaagtattaaacgtagtttaaaaacaaaataaattatagattctactaaaaaactgcgagataaatttattaagcctaattaattcgttattagcaaatgcttactgtagcaccacattgtcaaatcatggtgcaatttggtttaaaaattttgtctcgtaatttacacgtaatatgtgtaattggttttttcctacattaaatacttcatgcgtatgtctaaacatttgatgtgacagtgtgaaattttttttttaaatagggcctgagagcaaaacacatgctgcatgaatagtagtcgctcgctcgtgtatcatacttaaagaaagtttaactaggaaaaaaaaacctacttcatatataaaatcacaagaccttttatccaaaaattgaaactttcaactaaaagttcaaaaaaattatactcttggctcaaactttcaatataaaaacccaaaacttctaatccaaaaactgaaacttcccaaaaaaatcaaaaactttgtgctcatggctctcaatctttcgatacgaagttacagaatcatggtagggtagctagctaaataaagggacggatgcgatatgggtgctagcgaatagagcctttctaccttgctgaatcgtcattgataattaggggaggaggaacaagagggaaaggagcaatagtttggggatgatcccctccattgaataatttctcattctggatccgtgctagggatggatcaataatgttatcccaaacagaaacagctagtgttaggtacgggtatgtgcttcacgtgaaatgggaaatatatacaatcaacgatgactaatttggtagtaagcatacatgcatgggccaattaattaattatgctaaatggatatagtttgattcgatcagcagctgaacgactgatcgagagcaaaacacatgcataatgcataatgcattaatttatatatatgaatagtagtcgctcgctcgtgtatcacgcataaattatatatcaatgatcgatcacatgcaacaccggcaaattaaattgacccatcatcgatccatctagctagctatgcctatatatatacgccatatgcatgataaatacgcaagctaattaagctagctacatatatactctctcaaaagtttacattaattgctgatagctcatcatcagtttgatcgtgtccggaggtgtgaggtcgtcggcgagatgagctccggcggcgaggaggggaagacgtcgtggccggaggtggtggggctgcgggcggaggaggcgaagaaggtgatcctcaaggacatgcccgacgccgacatcgtcgtggttccggtggggacgccggtgaccatggacttccgccccaaccgcgtccgcatcttcgtcgacaccgtcgccggcacccccaccatcggctagagctagctactagcctcatctgcctgccttcagcatcctgcttatcttaattaaataatcacatgcacgcaagtgatatgtactgtgcatgtttcgatcgatccatcccccatctgaataatgttggttttaccctacgcacgtgttaatgtttttctcctacgaataaataaagagaccttcatttaatgcatggtagccaactactccctccgtttcacaatgtaagtcattctaacatttcccacattcatattcatattaatgaatctagacatatatatctatctagatttattaacatcaatacaaatgtgggaaatattagaatgacttacattgtgaaacagaggaagtacctagctaatctttaggaaacaactacaaatagaacgtcccattttattatttttctttaaaaaaatttggcggtgtttcgcctctcataaactaatgttgtagcatttagtgaaaaaatgttttagttcttaaaaagaagtagaacacaattggatagtcatatgaaacaatttgtttcaacatataaaacaaattttttaaaaccattcaaacatcaacaagatccaagtgaaaatcgaagagaatgaaacactataaaaatacccactaaaacacttcgatctaactaataaaacatctaaaccatttttgttcgctggcatcgtgtttcgcaagcaggcatgctaagacagccgctagcaaaaataccatttttgtaggcagcaaactaaagaggacaatagatgaaaacattttttgggataaaacagttgaaaatcgagatgtcgtcgtatagcggcagggcagggtcgacgatagcggtcggcctgcgagggtcaacggccgtggtccggaggaccaccgctgccggatctacctccttcaccgcccctcatcttcgccgctgatggaccctaagttcctctcgacactcaaggctgttgttggcccgatctttcggtgagttgtgataactacgatttgggagaaacgttaacgatccgactacaaccgtacgagacgttgtgttgcgccttagcgatcgatacacctctccgtgggttgttgatcttgctggtgcagatcaaccctaatcctgcagcaaatcgaagaaacaagcaagaccaagataaaagcaatctgatattgccaataggaatttaatacaaatgataagttggggttccgaatacaagcagacggacggtttagccgacacgcgcgctacaaggaagtagcaatagctaaactttcatctaaacaaaacctgactaaccctggaggggttactagctatttaagggatggaggaggtcagaagggcgtcctccctctgtttggggcacagccccccttgggccccacttgggccggggtcccagacgaagttacaggcccataggcccattacagacaatgcagccccttgtttcttcaattgcggctcactgagatggaatatcacaatgaggctggatccgttggaaagaggactctgagagctttccatcaagtactcacgggacgaaaacggagctcgaatggagatttggcggccgtttgaagtcagcaatgttgcaggtggccgaattggattccagcacttggaagacttgatcttgatatcttcttgttcatccatgatgtgaacaatgattgtatccatagtagccatgatcacatcagccgcagtcgaatctatcccctacactatcgccacccgtctccattgccactatggaggaggatatatgccaaggggaagccatagccgggaggaagtcgttgctgccagatccccaccatcgtcacctgccgccatcggattcgcgccaccgtgacccgctgtcgccggatccatgcccccgtgactcgtcgccgtcggatccatgcccccgtgactcgctgctgccagatctgcaccgtcacgacctgccgtcgccagatccggaccgagccaccccctcccctccaaccaaatctaggagggggaggggagagccaggccaccgcaactgctctgatccctacagtgcgaccgtctcgtcgtcgtggtcgcgtcctggacggaagcacaccgccgcctcccctccgctgctgccgacctccactacgtggctctccttgcctccgccaagcatggccaagtcgtgctgccgctgccgccgagcgccgccatcattgaccgccgccgctgcaccccttcgctgctactagctagagagagagagataaagaaagaaagaaagaaagaaagaaagagagaagggttggatctgaggggtcgaggaaaaaaagagggagcacgtgatgtttattccctcccacgatttttgcaagcgaggctcccaacaccccgccagtaaaaaatagtttttttttactggctgcatcttaagagcaccacttgcaaaaatacctctatttttgctggcggccctcttaacctggccaccaaggacgatccattttcgctgctggccattagcccccaacccttgttataattccactggtggttttcacgtatggccgccagagaaaaaaataagttgacgccatgaaaaatcaattttgtagtagtgagcgtgaggagcgggtggagagaaacggttgagagagaggaggggaatgcataatatggaaggtgggggtgcgagggctgggcagcgggtggagcgaggcgtggggcgcgggcgcccaatattcttgttcccatcgggcgcccgagtcaaagggttttcgtaatctttaccacatcgggagcagagaagttgtttttatcgaagtaaattgtttactccgataatggtggaagcaggatggcaggacgtgcggtggggtggggagcagggaagttgtttttatcaaagtaaatcgtttactctgataatggtgggagcaagatgatgggacgtggggtgaggtgggcttgggctgatgcatgcttggcgctcggaatactaggagcatgctgcgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggcggcaagcaggacggtgcggcggcggcgggcgaggaggagcggaagacgtcgtggccggaggtggtggggctgccggtggaggaggcgaagaaggtgatcctcaaggacatgcccgacgccgacatcgtcgtgcttccggcggggtcgccggccggtgaccaaggacttccgccccaaccgcgtccgcatcttcgtcgacaccgtcgccggcacccccaccatcggctagcctgcctcatctgcctgccttcagcatcctgcttatcttaattaaataatgatcacatgcactcaagtgatatgtactgtgcatgttccgatcgatccatcctcatctgaatcatgttttacctacgtgttaatgttttttttcctacgaataaataaagagaccttcatttaatgcatggtagccaactacctagctaaaaacaactacaaatcgcacatcccattttattatttttctcttaaaaaaaatcggacggtgtttcgcctctcataaactaatgttgcagcatttagtgaaaaaaatatttcagttcttaaaaagaagtggaatacaatcggatagtcatatgaaacaatttgcttcaacatataaacaaatgatttaaaaagaagtggttataagaggctcagtagcaccataggtcgtggattcgactcctcatgggagcgaatttttcagaatttaatggctttgtgcagccctggattcaactccccatgggagcgaatttttcaagatttaacggctttgtgctttcagtggtaggtaacgtatccgtcgacagcgaggcgcctgtgatgactttgtccactccaggatgaatttgccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcacccgccgccatcggattcgcgccgccgcaacccactgtcgccggatccacgcccccgtgactcgtcgccgccggatccgtgcccccgtgacctgctgctgccgaatctgcaccctcacgacccacgatcgctagatccggaccgagccacccctgccctccagccaaatctaggagggaggggagagccgggccaccgtagcttctccctgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagcggagctcccaacaccccgccagtaaaaattgttttttttactggcagcatcttaagagcaccgcctgcaaaaatacctctatttttgtcggcggccctcttaacccggccgccaacgaagatccattttcgctgccgacccttgttaaaatttcgctggttgttttcacgtatggccgccagagaaaacaaataagttgatgccatgaaaaatcgattttgtagtagtgagcgtgaggaacgggtggagagaaatggttgagagagaggaggggaatggataagatggagggggtgcgagggtgtgggcggtgggtggagcgaggcgtggggcgcgggtgcccgatattctcgttcccatcgggcgcccgagtccaagggttttcgtaatctttacctattattaaaatttaagatgattatgtaggcacccaccttttcgtccgttgtgacattagtttactgatttttcgtaacctttacctattattaaaataatcttcctaggtggccatacgtgaaaatgatcttcacctggaaaaataaatgcaccccgtctaagaaaattgtattcataatagtgggtcctcccactgcagccaccaccgctgcccaatgcagttgcgtgccgcggcctgacagagccgacacctgctgcagtccacgtcaggagcagagaagttgtttttatcaaagtaaattgtttactccgataattgttggagcgggatggcaggacgtggggtggggtggggagcagggaagttgtttttatcaaagtaaatcgtttactctgataatggtgggagcgggatgacagaacatggattgaggtggacttgatgcatcaagagcgggatgacgggacatggattgaggtggacttgggctgatgcatgcttggcgctcggaatactaggagcacactgcgctcctagtagtatctctatataattcatagatttttcttttgttttgtaatgagtactccctccatttcatattataaattgttttgacttttttttgtttaaccaagtttatagaaatattagcaacatctataataccaaattagttttataaaatgtagcattggatatattttgatactatgtttttgtgttaaaaatattgctatattttactacaaacttggtcatacttaaagaaagtttaactaggaaaaaaataaacctacttcatatataaaatcacataccttttatccaaaaattgaaactttcaactaaaagatcaaaaaaaatattcttggctcaaactttcaatataatatcccaaaacttttaatccaaaaactgaaacttcccaaaaaaaaaaatcaaaaactttgtgctcatggctctcaatcttttgatacgaagttacaaaatttgggaaaacttccaaactcctcacgtgtcaagttgggatgaaaacggtcggaaacgatcataaaacaggctcaaccattaccataaccatatttttctcagaaacaaaaacgatatcggaaatatcgaaaaaccagaaagggcagctacgttggatgggctctccaatttatcttaatttaataattccctcaataacaagaaaaatgatctccagtcaatttcttgaccattgttctataattttacttataacaaaattttacttatgactttataaaatcccgcagctaggggtgaaaacggtcacggaaattcccaatcgaccgggcgctgtttctgtttaaggggtaccgtttccgaccataacgtttttggctattttaaaattttgttttttctaatttctttctgtgtcgtattaatgtcgatattgagtagtttaaatgataaatatgttcaattaccgaccgatcgagcatcgtttctgaagagatgctactgattccgactgttttcacccctacccgcagcaacttgctggataccacccaacaaacatataaaaaaaacacaccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagcatgcatacgcgcatgggccagtttgattcgatcagcaaccggaccactgagagcaaaacacatgctgcatgcataatgcgtttatatactcgctcgtgtatcacgcatatcaatgatcgatcacatgcaacaccgacatattaaattgacccatgcatcgatcaatccatctctctagctatgcctataaatatacgccatattaagcaagctaattaagctagctacatatatatatatatatatatatatatatactctctccaaagtttacattgctgatatatagctcatcatcatcaatcgatcatggccggagttgtgaggtcggcggcgtgcagcggcggcgagggggagcggaagacgtcgtggccggaggtggtggggctgtcggcggaggaggcgaagaaggtgatcctcaaggacatgcccgacgccgacatcgtcgtgcttccggcggggtcgccggtgaccctcgacttccgctccaaccgcgtccgcatcttcgttgacaccgtcgccggcacccccaccatcggctagcctccctcatctgccttccttcagcgcccgggcccccggccatctttatcttaattaaataatgatcacatgcacgcaagtgatatgtactgtgtgcatgtttcgatcgatccatccccatctgaataatgttttaccgtcaatgtttttttcctatgaataaatatggaagaatcttctcccatcgaacgtccgacgtcccaaaaaaaaatcagacggtattccggtgaccaacgagtgaaacatcaaattatatatgactagtaatatacccgtgctaacgcaacggtgatatttagtagagtaaaatggacgggcggctcttaaacttgtagaggtgtatcatctaggtccctaaactcttaaaatgcatatccaagtatcagaacttgtcatagtatgttctctaggtcccaaatcgctacaaccttctggatcctacatgatactgatgtggcatgccatacgtgcatgacatggcataattttgactgacaaatgagacccatttaaaaaaaattctttttctttttttcttctttcttctcttttatttttcctttcttctcctttctctatgacccaagcagaagaaagaaaaaaaaaagaagaatgagaagaaaaccaaaaaaaagaaaaagaaaaagaaaagaagaaaaaaaagacccatcatgtccatgtggcatgccacattagtgccacataggatcttagaggggctgtgtcgatttgggacctagatgatacactttgataagttccgagacgtggatccattttaagagtttggggatctagataacataaccctacaagtgtaaggaccgtctatgtactttactctgtaatctccaaaagttaatattgtttttagtcaaaaagaagttaatattgttttaattataaagcatagaataaggctgctggatttattgaagaaatagcacctatagaacctttcaactgatatttgtaactattggttctatagaaatagcacctatagaacctttcaactatttgtataataataactttgggatttgaaggatcaaataacagtgacttcacagtcgaagtatgtgctgaaaaaggaaaaatagaaacgttgttgctaaatgaatagaaatgcccaatccccagctctcaaaaacaaatagaatgaaaaaaaaattgagaaaccgaggttaacttcaactgcttctctgtgtcagacttggcgagcgaaaccttcagccggtggcgagcgcacattactcttcactatgtgtaggtatcagctaaataccagaagcgtccgtattctattctaacaaaatacatatattatctaccctgcttatcccttgaaatgacaaattgaactgcagtctgaaaatgagacataattttatcaaaatactaatagtaattagagaagagtggcacttacattgtactcggaacaattctgcaagcctctctacatataaaagcatccggtcaaatatcaatggttgatatacatgcatgcatggttgctttttgcaaaacattcgatcaataaaggaaagggctctttatattttcttcggtacaacatctaacaaaaaataaaacacaacactaaatgctgtagcaattaccagtgtacatattctgtaaacatatacttatagtaatatgcctgtgctaatgcttcaaagccaatcagtaatgtaaattaaaagcataggatgagatggatttaagttagtatattgttgattccatagccgcatgcataaaataaaatcacaatttttatacatttctaactatctacaacacatataaattcgaccagctattaatttatcgtgttcaatacagtgtattacaaaaatatttttcctcacttttattcccagtgcagcctctcttctccactctacatatccatgatatgtacattttcttcagagaacaagtactacagtgttaatcagaaaaaaaaaggaccgtggaattgatatgcataacatcatttggaaaatgcttagtaataggacaaatctgcccgaaaaaaagattaccaatatttgactctggcatgccaacaacgagaagaaatgtttacataatcaattgatactttatttattacagttctaatccaaagcccaaaggtcaataatattagctcgtaggcagctacatatatcactacattcgtcatctgccctcttagccttgaagcctagtcattcattgatggaacatattaccaatctcacgaaccacatagtaaatattcagaaggtaccaagtagccaagcactgattattatcagtttgctgctctatgcaaaaagtaaaatataataaataataaataagaagaagaaagaaagaaaaaggagaatggaagttcaagaaatattaaataccaaggtgcatctttattttttacacatatgtacatgtaatggccaatcacattccagcattttttactgctgttacagcagaaggtgcattttgaaaaatcaagaaattatctggtttcgaattgcactgaacaacacgcaatgcacctgcatcaggtaaaattataacaccgtgtttagtccaaagaacattttaaaggaaatagcacttacatggcaatacctcagattgagggcaaattaccctgttgcaacaaccattagtaatccatcaatttcgtcccaaatcaatttccggagaggaagatatctgatgcattcagatccaattgataagccaaaaccataatgtcttgcttgcaattcctatcaggcaggatcagagaaatggacctgctcacgcgcatgagcttggaagtagatcagccagtggcctggttggtgtcgactcgggatcagcggcgtccgcgccgacggctgcaacgtcaggcggatggatgcctccacacttgcaggcttgcgtttccccaatcttcggaaggggaggagatcgcgttcgcgtgggggagggggaggaaatcacgcgcttgcgttgcggcgaggcgatctgcagccggccggctcagggagcaatagccaggcttggggagggggaggcgctactgcggccagggcgacgattgtgagggacatcggcgctgggagaggggcggattggcggattgcgggatggcgaccgtattctcgggcgtttgacgcgcgtgggaggtggagacgatcctgagcattggatttcacagaggtgatctgaaccgttgagtgatgaatgtaagagtgtaggagagaaagatgagtaaaatgagttggtgaattataaggtagatgaaataaaaaaaatcagcaactgacacatttaaaaattttaccattttcattttcgttccaatcgattaccattttcatatggcttggccggtagaaagtcggaaacgaacatcggtcagctaagaatttccgttaccgttttcatcccagtatcaagatttgacgaagaagttgtcgggtctccttaacgtcgctgaggagtgactagtgaggaagggctcgtaacgcctcgccgagtagagtagcgaggaagaagggaacccgggctcgcccaaatatcactgcgtgccattgggccgtgcttgggccggcacgaagcacgatgggccatgccgtgctagaccggcacggcccaagtccccacaattacctgagtgtgcccaacgctccagatttaatttcgcatgttgagccaatatgctttatggctaatctcaaacacaagcacttagctggtttttcacctatagtcttgattttgagattttatttattttcggctatgaagtaagaaaattatcaatgccttcagtgtccagactttcaggtgttgagaggctgaggtacaaatgagagcttctgggatgaaatatcaagcagtaaaacattatctcaagaaatgcaagcaccaaaaaagatcaaacgagtatcccttagcctcctcatttgtgggttgaacaccaatacggtgacaatttcataactgctgatcaagatatggctcatcagccaaatgaactctgcaactctgcacgagttcacctctgctgggagctatagtacaacagtgacaatcagtcatcggtcaactgcctgagataattttgaacgcattcatctgcataatgacttggaagttggagctttgctggtattgttctgaaccaattacagacatgccaggagatttgacaacagagagtaatcggtcaaacgcaaaaaagggaatgttgggtattacaaaaaaggggaatgtcagggtgtacagtcatgagaaggccgagctttggtataagctactttactctgctgatctgaactcatacataacccctcaaatcaagaacaagcactgcatccagttcttgcactgatctgggagcattactctacaagccatggtgtcagaacagattcccattcgcagagttcgccttctttgaaccatagagctacagacagaaaatgtgtaatgagtttatcatctgtttgtaaagaacaaaatagcaggtcacaataaagttaagtccaagctaacaaacatgcacgtctctaagcacatagtgctgctgaattattatttttaaaaaaaaaaaacatgatcctaatcactgtgtcaactacttcattcttcgtagtacttaaaactcatgattctatgcaccttatattgttataccatgactactgggaaaaggagtagaacttaccgatttcacgcttgccgttatcaggactgtcacttccatggacaacattcctggaaagcagagtccataagaaatttaatttctttgacagagatatatatgcagagatatccgctaaaatgtgaaagatgtggtagatataataatgttaaaacatgaaaggttgtttgattccaaccttcctgtttgaactgcaagatcgccccgtatggtccctggttcagcttgaaggggattagtagctcctattaacttgcgagctgatgcaacaacaccattcccctcccaagccttacagaacagaacaacaataaatttaattgaaaacagtttactgatcaaagtgcagagttacaaatatgtttggttctttacaaatatatataccatgcaaacaacagggccagaagttatgtactcgatcagaccgggaaagaaaggtttttccttcaaatccttgtagtgctcctgtgcacataagagagaattagcagctcgttgattaaacataatatactcctggtgattcccttcctatgtgaaaacaaagataatactgtatgctctgacggtgagcagaaaccaggtttaaccacaaatttcgatggcatttctacaaaattttctccagctgcttggatatttaatggatcacttttcgttggctgaatacaagaaaaagtgactcgaaagaactatctcagcagtcagcaaagaatgagtactttggatgatcaaggctgtcctgaaataacataccagacagacatgctatttatcatttattcgattgtgaaatttccattcacaacaataaaactgtgatctcctcaaataagtccattcaagtcttggcaaattgcccactaccaagaaaataaactgggcatgatattttgtcatgccacgcaaccatggtatattttgaaatggcaccattgctctccaacgatgattaaatggtgagtccccagatggtggaagaaaacactttacttttgaagaaaacggtggatattaagaggcaaacctgtgccaagtccttggggcactgaaaaagctttaagcccttcaacacaaagcctttcttctcgaaacgggaaataatctcgccaacctatatgaacgaatcgacaggagtgtttatctgagctgaaagaaactataatggaactacagtattcagtaatggaatatattacgtcaaaaaaaagtaatggaatctaaagttagaaaagtaagtaaaatgatataccaggcctcgctgaacaccatcaggcttgatcataatataggattgctcaacctacagaaaaaatagatttaatcttatggttgatcaggaagagatcacctaagtggagagttctcaacttctaactgaaataacagaatattgaggtaatcagaaatgtctgacatctattatataataaagtccattaaacttccta

SEQ ID NO: 21505 - DNA, 2952 bp, Oryza sativa
tcttcatctgggctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcctcatttcgagtcgctatatacctcgttcgtttatgaaaattatattaggagtagtctttttaaggttagctgaacataaaattaataatttctatgcaatgtcgaagagtcctcgtttagtgggattgttcatattgttacaacctctagcatatggtcaatgatttgttgtcataagtttgctcgattgaatttagtactaagatgtttgaattttttcaataaaagtactttttcgagataaatctatttatattgttttatgttttcaaactaaaagttatcccgattattgataggccaagcaataaaaaataaccagatttatcatagagcacaaatatttgtgatcacagggtgtacgcacccttgtttcaaacagaaatgaatgtatacgtgcttcatacaccactatcgactccttgattgatctcgcctctaccatgtacaacatgttattagtcgttttagattgtttttcctagtcccgtttctctctggttgaaatcaataaggttaatatggtatgagtttttgatatagccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttc

SEQ ID NO: 21506 - DNA, 10671 bp, Oryza sativa
cccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgccatggacgacttccagggcctcctggcccgcgactttgggctgcgcccgcaggggaaggcggcgcccatgtcggccgcccgcgccgccgcgtcctccggatccgcctggtccaactccagatccgcatcggcgtcctccgccgccgccgccaccgccccgcccgcgcccttgtacgatgacctcttcggggccgcggcgccctccgccccgccgcccaaggccgcgccctcgccctccctcgacgccatctttgactccttcaaggagccctccgccccggatgccccacccaagccgaagcactcgtccatgccggtgtttgacaagccggtctacgatgacgacatcttcgatggggttcccggggtgaagagcagctcctcggcgcggtttgacgatgtattcggtggcagccacgcgccgccgccacctgcgtacgatgatctgcttgggggatttgggagcaagccggaggtgaaggaggtgctgccggaggagaagaggaagcctgagccggccgcttcatcggctgggtttgatgatttgatcccagggtttggcgggaggatcccgatgcgtgccaggtgagcacacctttttgcatgggaatttcgggcattatgttgtctacatgtgcaatctaggagtaaatttagtagtagtttggatcaagcggaagctttgtcggtatgagccaactcggcaacgagagaaccatgtgataattcagttgagttggacaaattatggactcccatatctaatttatgttgcatttgcttagattttagcttgttaatgtgcacgtgcgattgtttgaattggtaacttataccagttgaggtaggaaattcattgatggcttatatcttcaaatctatttggtaattgaatttataggctattttccattaggtatgatctgtgttgaccattgaatatcaatggcatcttgtggataaacttatgggcatcttgtgaattttatgggctctacttcgattttactattagaaacgcctaggaacatatgctatgctttttataagcattccctactttcctaaagataccagtgcactttctcaggcaaacttgctttggcctctatattgcgttatgtggataatacagtgtatgctaggtttattatggtttatttaaattgcacatagttcatagagaatgttcagcatgcattaatgaccggatgtggtaggttcataggctgcacaactttgattgcaaattaccttaggttcaaatataacgctttatagtgatggaatatgtagtgagttatgcaagaagaatatctacgaggttctgaaattgctttgtttaaagaatgatttggatctttttaatctaaaatatgtcaatcatatacagatttgttaccataaattccctcatcctttttttttttgaatcatagggagactgttggaactaaagataagaatgtgtccatgtcaacgtctaagccagctagcatggcaagtgacccatttgatgttcttggtacaacttcaacctcaaagcatacatcttcagggatattcacggatcccttggatgaactgggcaggcctgcaaaatctcaagggaaaaaacatgataatactgctgttgacagtggcctattcgaggactcaagcacttttaatcaggtcccaaaatcagaacctctgtttacctcagagttgaatgatgacttgaaagataggaatggctccaccaaagatcgagattcaagtcctgtgcaaaatttttccagaaaaaatacaacccaaaaaccttctgtggagaacttcgaaaatatctttcctaagtcacagtctgctcgatattctgatgttcatgttgacattggtgcctctggttcagagaaatacagtgggaatggtatggatgaccagtctccaagatctgatgagtccgaagatgagatctggcttacagtttctgagattcccctcttcacacagccaactagtgccccaccaccttcaagaacaccaccacctcttgctgttaagcaaaaaccacatggatcacaagcaaaaagaaaagatgacaattatccacgccggtctaaccaaaaccacaatcatcacagaagctcgtcaaatcaagctggttcttcttcaatagatgaactggaagattttgccatgggcaagtctcaaagttctgcctatgacaatgcaaatccttttaatgaggaagaatttgagcatagttcatcagcagcagcatctgcagctgctatgaaggaagcaatggataaagctgaggcaaagttcaagcatgcgaaggttgtacgggaaagggaacgcgatgcaaaacatagaaatagagaacagcaggaacaagatgatgaagcaaggttcaacacccaggatcatgaagagagagataggcaggaaagactagaacgggagagagagatgagacaaagggaggaaaaggagagagagcaaagaagacttgaagaggagagggaacttgagaaacagagagaaagagagagggctgctaggcaagctgtggaaagggctacaaaggaagcacgggaaagagcagctgcagaagcacgtgcaaaagcagagagggaggcacgccagcgtgcagagcgggctgctgttcaaagagctcaaaaggaagcacgtgagagggctgctgtagacgctagggaacgagctgagagggcagctgctgaagcgaaggagagggctgctgctgaagccaaggagaaggttgcaactcaagccagggatagggctgcagcagaaagagctgcagtggagagagctcaacaagaagcaaggaggagagctgaaagagcagcagtagagagggctgcttctgaggctcgggaacgtcaagctgctgaggctcgagaaaggcaggctgctgctgctgctgctgcagcagctgcagcaaaagaaaaacagagtaaaccggacgatcttgagtccttctttggtatgggagctcgagccaatagtgcgccgaagcaaagggctccaacagcggtgattactctaccaaaacatgcatgctaaaattttgttcatggcaatttttgggttattgttttaccaactgtggacgtttcaggattcgatgttcaattctcaaactcaaaatagaggggcagcatcttctgcttcagcatctatgcggaaggcatcatcaacaacaaatattgcagatgacctatctgcaatatttggaggaggtacggatcaacccaaatgcagcagttctgaacatacaaggttttgcaatattattggctatcgctataactcatttggttgatttcttttcttttagctcccacatcatctgaagaatttcaagaaattgaaggagagagtgaagaaagaagacgtgctaggttcgaacggcatcaaaggacccgtgaacgagcggtaatgttgctaatgattttagtaactaaaatagatatttgtttgtaacttgctgttataatttggtactgtggacattcattttatgttcctgaattttatcatttacatgttatttttttctatttattaagagttgtgatgcatgaatttgagttgcagtgccatttattaacttcaccgtgtatgcaggcaaaagccctggctgaaaagaatgaacgggatatgcaggttcaaagggagcaggctgaaagacatgtaagtactttttatctttcaattgcccaattttacttcttttaaatacttgtcatactggttagtctccatttattttcatatacaagtttactgatgatgttgtggtgcattttatttgttgagtaaattacactcacggtacatggaacttgtgtggtgggtgcaaatagatacaaccacttgcaaattgctcactttgatacaataacttggctagttggtgtttaccgggccaaaatgatccacacaagtaaaattgctctaaattagcacacactaatgatatgacagcatacacgtatgactgtgatttggagatcttatttcgaatccaaataaaaagaggaattagatgtgcaaaagtttatttttcatgtccaggatagagtatttatttcatttattgggaaaatttgatcctctatataactcgtctaatgtttatttatctgttcaagaccaagacaatttttatctgtacatttaactcctaaaagaacactttaattttcatgttcatgttcagatactctttcatcgaaagtgtatttaatgattgggcatttttaattattttacttttttgttggtctaaatcttgaaaatatacgttgtcagtataaaattttgatgtgtaacaataattacacaccagtatgtaatgtatcatatttgatcaattttacttgtggatcggtttggcccaggtttgcacaaactggccaagttattgtactggaataagcaatttgcaagttattgtacctatttgcacccaccatacaagttagtgtaccatgaatgcactctctatcaatattttgctaatggctagttcctttgtttcgttatctgttaatccagagaatttcagaaacaatggactttgagattaagcgatgggctgctggaaaagaaggcaatttgcgtgcattgctatcaactttgcaatatgtaagtccttattcctgatgctgctaaaaattgaatcaattatccttgtcttctcaatttttctattcattctctcggtgttattcttgcaaagaaagttgcttgactcttttgcttgtcttctggaagccatacttttccctgatcagtttggtagtgcaatttttaacgtagagtgtgttcctttatcatggtcacatttcaacacatgatattttctatccaagggtagttccgaggtaattttgttaagcatgcaggttccagtaattgtattccctgctacagctttttgtaagctttgttttcacctgtggtgaccaaaaccatggtattgaggtgaataggtgatatcagatagttttggtttcttgctgatgtttgaatgtaacatagctgagtggctcaaagaccagattgctggatgggctgaatatcttttgtttttctaagtcttccagtaaaaacgtttatctggtgttattctcttggtttgccattacctgcatacagtagctccttcctcgcaagctataatacatactctgtatgtaagtaaatagaaaattgtgaaggactaataattactcctattcaacaaacattgcattttagggctagtttgaagagaattattattaattctgttctttctgacaggtactttggccagaatgtggatggcaacctgtatccctgactgacttgattactgctgctgcggttaaaaaggtatatagaaaggcaacattgtgcatacatcctgacaaggtgcagcaaaagggggcaaatctacagcagaaatatgttgccgagaaggtgtttgatctccttaaggtgtgtatgctgccaaaatatattcacaaaccataatagcagcatgctgcttcacactaacaattggtcaaccgtatgtttttatttcccttttagtttattgtggagaaattagggactgcctagctacagagcctaacaggacttattaatgtgtttttccaattttaggacattggcctctacatggaaactgactatttgtcaattatgaatatttaggatctttcactgtacattttgagatattattattcatgtgtggtccattgagccaaataaggcttcctctatgatttcacatggaaagtgccaaggtttgacagttttcatatgattgatggtacactagaataacccatattaatgcaaactttggtttgtgtccacctggaccaccacctggtgccaacgcaagtatatctggcatgccctgcctactatgcccacaaccaaattaatgcaaaccttagtaatggcctgatagtctgcctagaggaacccaaaagcaaatgcttgacatatacacgatacgataatttaatacatcagattgatcttgttgatatttagtactttggctagtatatcttacattagcttacttctttatacaatgttgcatatttaggatcttattatttatttttagcaagaaaaaagagcttgtactcaattgttttccctaaaattgtttaccaagtgccgggacttttaaagagttctattttctagtgtttcccattacatccttttggtataaactttaattaaacctcctctatgtttgcacaaaacaggaggcatggaacaaattcaactcagaggaactcttctaaacggcctgcgcaaatgaaacatattgctcaccaatcttcacctgcatgaggcaatcggggtgggacagcacctcatagaacaaccgagctggagcagtcggtcggcggacccatgaaacgatgaagtgaaagttccaccataattacaattgtattgttattaccaatattgtttgttttattatacaccctcatcttctcccttctgtatgtgttgattcaaatgacatttcacagccacatgtggtggccctgcggcagaccctcatccagtaggtgtatattagcgttctttttgctcggttgatccagggttgtgtagcagcggatttggggtggccagtgttgtggtttttggattaggcacagggtttatttaccatggagggcccaaattgcatggatcatgaatgttgccagtttgatgccatgggcttttcgtaagttcaattatcttgtttatagtgaacttctggaacacacattggggatgttcctctgattcctgtgtgattttgtataaagttgatctggaattttgatttcctcttgttctctgttaccgcttcgttatttgctcgttccttgaacgtataacgctagtatcacaaaatcctgtagagtttcctttaaagagtaaattttacggaacttcatgtattaaccaattgtgcataagtcatttgttttggcatgttgcttataatggtattatgctcctataacttcagaaaacagcagcagtaaccaaaatttcatctgagttctttaattcgatcatataaaagttatagtaatctaagttaatttttttctatttcgctatagtgttaattcagattgattactagtagtgtggttttgtgaaatctaataccgatggtcactgtgcaatatgccaaaacccatatatcttgttccatttaaaaccataataaatagggttatgtgatatttaataaaacagatctgttaactcaaataaagattgaattgggaagtgttttaatagtttattaaaggttggattgggaagtgttttatagtgtagtggcttgatgaaatcatgggtctgccaccgtgttgcatcgatctcccaaattcttttctcgtttcactcgcatcctcatcatcttcatgttacttctacctacaagtatattgttttctcactattttatatcttttgctcgttaaaggacaatgatttgggtgtattcccaatttcccatcggatccagtaactcgtgtaatcaagcttaacctcatcccattttgcttcttttaactattttcttttttctaatgggtgtgttcagctgtcatttttcagcagcggctgcggctgcaactgttcaaaattgctgcagcttgcagcgactttgaactgcggccgcagcgactgtggcagccctagctgccgaacagggccaataatggaatagaataccatctcaacctttgctcaacgagttatagcccagtccagattcatagctagagatgattatattttaggacagagagagtaggcgagtagctattatgtttccaccattgtttatcaacttaaagtccggtcactggatggatttgaactatttccattgtttatcaacttaactatttccatacgtcagggtgtcctcctcgatcatatcttaaccacgtcttggtagcatgcttttctcgatcatctccatacatccgttaaggccatgatatcctccacattcatagcaacattacgagtgtgtttggttggtagcctagatgccacacctgtaacaagtctgaacaacatacaaatttgtttggttacttatctggagagttgcctgactcaggccacaaaaaatgaacaccacaaatgaatgccacacctccattcttttttcatcaacgtgactataatactaacatttgtcaccatccgactcaaataagtgtactttttatctatactattttaaaatatagtagtgatggactggtggtagcagtgagtctgctactatcacctctatcgctaacatattaggcctccttatcggtgaaactcacgtgctcactggattcaaacgtaaaaaaaaaagtatgtctaagcaaaataatgtcaatatttttttaaggtccggtaagtacgtactcccttcagtttcattttaattgacgttttggacaatgatacggtctacaaaatatatctttgaccttatttttctattataatatatataataaataattgcatatttacttttattgtagtgctttgaaagacaaatctatatatgttgttctagttcttttaaattaaatatttttaaagttattaattgtcaaagttataaaagttcgatctcaacctcatctaaaatgccaattaatatgaaaccggagggagtagggaattaatccatatagttaaaaggattagaaagagccagtttgcagaatcttcaaaaagataagtgtgcacaacgtgactttgttttttgccattgcaacatacaggcagtcttgtcccaaaatgaaactatttttttcactcttcacccaaaatgaagctattttttcactcttcccctcctctcaacaaatcataaccattctccatttaattatctcgtctactgtctgttctcagctaatcacaaccttactttaattatttctaccgattttttaaatacccatgctcactaaaaaaacctacattttgaatagaggtaatacaaagtactctctctgtttcgtattacatgtcgttttgacatttttagttaaactttttaaagtttgtccaagtttatagaaaaacatagtagcatttttaacacaaaacaaacatatatctactattataaaaatcaaagatgttttttgtcgaaattttgatacgtcatccgtttttgagttgttatatatcgtccgtatccaatttgatgtgagtatagaataactattatacatcctatcctagcccaacccctcccctccaagcccaacctaactggcccacactatcccgccgtcctatcgtgcgtttaataaaatatattcaatgctagatttaataaaaactaattcggtgttttagatattactaaatttttctttaaatttggtcaaatttaacaaagtttaactaggaaaaaaatgtcaaagtgacctataatataaaactgagagagtagaaatatagcattgcacacgtcttccgtacaaagatatactaaagtggtgtttggatccagggacttaactttagtctctgtatttagagtattaaatatagactacttacaaatctaattacataaacgaaagctaatttgcgagacaaattttttaagcctaatcaatccataattaaagaatgtttactgtagcattacataggctaattatggattaattaggctcaatagattcgtctcgtgaattagtctaagattatggatgagttttattaatagtctacgtttaatatttataattagtgcccaaacatccgatgtgatagggacttaaaagttttaatcccatctaaatagggtctaaggccctgtttaattccagggatgaaaagttttgggatgtcacgttggatataaagacacacatttgaagtattaaacgtagactaataacaaaacaaattacagattccgcctgcaaattatgagacaaatttattaaggctaattaatccgtcattaacaaatatttactgtagcactacattatcaaatcatggagcaattaggcttaaaagattcgtctcgcaatttacacgcaatctgtataattagttttgttctttgtctatatttaatactctatatctatgttcaaacattcgatgtgatagggtaaaaaaattttgcgtgggacctaaacatggcctaaggaaaaagccattatccagttcctcttagaccctctagacttctggacccacattccagtttccaacgttaaacccacccaggacccagcacaccgcaccaacctctctcctccccccccccccaactaccaaaatttcaaattcccgcactccctcctcccccctcgccgccggccatggacgccgccgacgagatggacatcgacgccgccgccgacgagacgggatccccgccctccgcctcgggatccctctccaccttcctctccgag

SEQ ID NO: 21507 - DNA, 19827 bp, Oryza sativa
tccctcgcctccctcaccttcctctcctcggcggcgtccccctcctcctccatcttcccccgcctcgccgccgcgggcctcccggcctcctccctctccgccccgctcgccgcctccctctcctccgcgcaccacccgctccccgccgccgtcgcctacctccgcctcctcctcgccccggcctcccctctcctctccctcttctcgccgctccccttcctctccctcctcctcgccctccgcaagtcggcgtcgtcgtccgccgcgtcgcacgatgcggcggcggcggccaaccctagctccggctccggctccggctccggctccggcaaggggaaccaccggaaccggaagcggaagagccaccagcagcgtcagtcgccggcggcggccccgtcgctcctccccagggcgctcgcgctcctcgccgacgccgcggggaggctgccgctcggggagcacccggacgcgcggaggtcgctcgtcgacaccgccgcggagctcgccgccttcgatgtcctcgtcgccgtcctcggatctggctactacgccgaggcgatgcccgatttggtgcgcgcgctggcccccgtggcgctctcagggtccagatcggcggcgcgggcgtccgcggtggaattcttggcgaggaaggttgtgccgttgggtgtggagggaggggaggatggggtgaggaaggcggtgggttacctaccgaggtatctggcggcgaaggcgccggagaagtcggaggctagggcgatggcggtggaggccatagtcgaggtggtgcgagcaatggggcaattggagatggagggatttgctgggtatgtggtggctatggcgaaggggaaggcgaaagggcggctgcttgctgtggatttgatcttggcgatgctgccattgctgctgccatcggaaggggatgattgtggtctacaggagggttcttgggggctgaagtttgtccgggtgcttgtggagaggtgctcggatacggtgggaggggtcagggctcgggccttgacgaacgcagcccaggcgctcgacgttttgtctgaaagaggcatggaggttgaccggttgcaggaggtgatgaggatagggaacataggccttggcgagttgctgaggctgcggtgcgctgatgataaggctgctgtgaggaaggctgcgcttgtgctcattactaagtcaatcagattgatcgggaggcctgttgacgagtcgctactcagtgctatgggggctgcgtgctctgatccgctagtcagcatacgcaaggcagctcttgcagccatctcagaggtgttcaggaacttcccggatgagagggtaacaaaagagtggcttcaggctgtgccaccactggttattgatagtgagacaagtatccaagaggaatgtgagaatttgtttcttgaattggtcctgaacagggtctgtcaagctgccaatttgaatctaaatgatgattccaatgatatggaggaagtgtttcctaaagggacactggatttgctgaaaagtatctgtgatggagaggttgcaccatgcataaaaaagatatgtgcaagccttgggaagaagaaaaagctgaaaccactgcttgcaagttcattgcagaatatcataacaatatcagagtccttgtggttgagaggttgtaaaccaattgagatgtggactgcaccagccggggcatggtggcttctttctgaggtctcatcatttgcacctaaatcagttaactggaaattcctctcacaccactggaaactccttgataatgttggccaagataaaggcaaagttcgtcctaaaggggaaccaaattctgcattatgggctgtggatcgtgtttcactcttgcaaactatttcaaatgtttccatggagctgcctgtggaacctgcagcagaacttgcacacagcttgctcacacggattgaaaattttgacatgaaccttagtgaggtaatcatttaatgtatcaattgcaaaatttagtctagtacaatagatttattacatagcaacaaatcatgtactctgtttgtggtcaggactaggctgcaatttagttgtaaaaaccactaaatcattaatcatcttgatttgtaaatccactatggcactacgctgaaatctaccatgccacattgcattccaccctagtcatgttactctattggaaatgggactagggagtatttatttttatgaagaatttgatctagccagtgcttttaatggtgtctttaatttgaatgaaggtgaacatgtcagtgatctataaggtaaagactgggtatatatacccataactataataatccacaatattttgaattagttttctgaatgaggtatccttctagcttatctgaaggttcacatcatagtcccaactcccaaaattgctctgtggaaacctacttgttatgacaagattatcccgtatctgtatgctcagattatttgttacctaccttgtttttacctgccctttttttttttctctccatagttctgcaatggtgttacttatccacttgtattatttttattcatggcattgctacctttaccttctttgttagatgaataccatttttgtgtaccacatcgctcttgatataagtaattcattgtgatatgttcaccataatgtcttattttcatacacatacaggttgatgctcatgtaaaatccctgaaaacgttatgcaaacgaaaagcaaaaacagctaaggagggcgaaacactgatcctgaagtgggtgcagcaacttatatgtaaagctgttaacattcttgatgaatacataaaggagacatcagaagctgctaagggtcctaaattttttacacctttgagtggaaaactcaagggaagaaaagatgcatctgcacaaaagtcaatgtcacatgcagttattgctgtattcaccattggatcgctgatcctagcttgccccactgctaatgtgcaaggcgtcattccttcgctgcacacaatcataacatctggaaactctcagccaagaccaaaaaatcttgctggtgggactgtttctttcaaagagctagctccatctttatatatacagtcctgggatacaatggctaaaatatgccttgtggatgacaaacttgcgaaaagatatattccactttttgttcaggtgcgtagccttgcatggttgcacttccatgtctactcttaatagaaacactcaatgctacttctttgactcaggaacttgagaggagtgatttggctaccctccggaataacatcatgattgcactggcagacttttatgtccgttataccgcaatggttgactggtgagcttacatctccattggttgacttttatatctgttatgtccttccaaaatcctgttactgtgtttctttcaagtggatttgcatttgcttgcttacacagtcacataatataaagcatagatatcactagtgtgtgcatactttgtaaaattagcacatactgtcaatattcacaaaatttgggtttatctttgttacagcttcagttgcaaaagatgtaaaactgctttactgtttgattaagatcttatcagttaaactgcacgtgggaaacagggaaaacattaaaatagttcaacttctaactgacctcccctttttattcactctgcagttatatgtcaaaaataacaaaatcgttgcgtgatccctgtgaggtagtgaggaggcaaacatttatcctactctcaaagttgctgcaggtgctaataattttcttaatatcacttccacatgtttggatcatggtttattgaaacttttcttttatttagagggactatgtaaagtggagaggtgtgctcttccttcggttcctgccatctttagttgatgagtcagagaagataaggcatttggcagacttcctttttgggaacatcttgaaaggtttaccctgcgttctgttttatcttttacttgattttttttatttgaaatttgaaaaaaattgtggccacacgttttcttttttcttgggaaagtcaagcactcaagttctttttctgaaggatttaccccctttctgtgttatctgtctaatgttgacataaattttgcagctaaagcgccactccttgcatataatagtttcatagaagctatctatgtcctaaacaattgcttgggtaatggtgcgcaaaccgaatctcagggaaggttggacggaggaccaaccctttttgcaatacggtaaaatatgtagaaattcctcatgcgtttttgagaaaaaaaaagatatccactttgcaaaaagctgtgcttcatcctctcctgagttctatcatggttatttttttctttttgctgcagaggcactgacgaaaggtcgaggtcgaaaagaatgcacatatatgtatctctgctgaagcaaatggcaccagagcaccttttagctacgtctgccaagttatgtgccgagatcttggcagctgcttgtgatggcttgctcaatgtcgatgatgccgctggaagggctgtacttcaggtacataccataccaatattgatattttggacaagtttcacgctaatgtgaagtaaattgttcatgcacatgcagccaaggaactgagattaactttcatgcttacagtttacacgtttaggtcccctttgattcaaaggaaattcataggaattttaaaggattccattcctaaaggaatttttcctatatagccctttgaatcaaaggaatgaatcctatgaaatcctatgaaattcctatggaatgtctaaagacatggaagttttggaggaaatctagcatgaggttctacctcatgaaaattttcttacgagtcttcatctctcctctaattcctacgtttttcctgcggtccaatcaaacggtcattcctgtgtttttcctgtgttttgcaatcctttgttttacacttgtactcgtatcaaaatcctacgttttttctgtttctacgttttctcaatcgtatcaaaatgtttgctcagcaatttcctccatttagcctttgcttctttcctttgtgaccatttagctacattttcacaggatgctctacaaatactggcatgcaaggagatgcgcatccaccccaacatttgcacggacaattccgagatggatgaggaatgcggcgatggcgggtcgtccaatgccactctccaggcggcgaaagggagagccgtcacccaggtggcgaagaagaacctgatccagatcgccatcccgatcttcatcgagctgaagcgccttctcgagagcaagaacagcccgctcaccggctgcctgatggagtgcctgcggaccctgctcaaggactacaagaacgagttcgacgagatactggtggcggacaagcagctgcagaaggagctcctctacgacatgcagaagctcgacgtcgccggcaagggcaaggccaaggccgcagctgctgcggaggctgggccaagcggagcctcgccggcggtgaacggtggcggcaagagggcggcggacggctcggcgagggccacggcgaggtcggtgctcaaggaggtgaaccggaacacgccgacgccgccgctgaactcgatgagcgtgcccaaggtgaggtccatgctgggcgtcggctcgcgccggcccgctgtgctggagtcggtccggcggcttgagccgtttgggtccgacgatgagaattagcgtgccatatggcagaagctttaggttggcctgatggtcagtattaggctgtgtttatgatgctaactttgaccggtttaggagaaaattacaagctcagtttctcgctgacggttttgtacatggagtatatatttaacgcattttagtgatgttcagagagatgaaacaattttactgtcgcattttctccttagtttggatgtgacatgaaagtatatatgctttacaccgaagattgcgatgtctcttgactgaatactctaacttcttatagtggaattcaggttcgcaagcaggaaatgtataaaaatcatggctacagatgggcgaacttgttaaaaaaaaaaaacaaactcaaaccacaccaggatacatacaaattgatatgtgagcaattttgacatttcatctgatggtgtgctaatgagcgaattagattatcaatatgactttctcaaaaaaaaaatcaatatggcattttagcaaagccaaccaacttcatggtatttataggatgccatcaaactatgtggcaaaggagcgataatagcgaagggttccaagtatttttctatatttgtttcgaaaaatagtggaaaatggtttagtggaagctgttgattatttgaaacgggaaatgtgcagtaaaaagggaacttctaaaataatcaaatcctagaaacttctcttatgcttttttagctagagagtagtaaaacattctcattctttacttgtaggcttatcagttggagccagaatttaaatttagaaatacaattttagagttaatttagaattattttattgtagtttatttgtagcgttggcttttaaaccacaaatagtaaagatataaaagttttaaccctaaattattttttgtttgcttggttcatatttatacggcttatagccatagcttaactaatcacagcaaattaccattaacttaagagatcgaggcagaatcccaacctaaccaacttacggcatcagggaccgaagttgcccaaaacctgacacagcttggctctaatttcacacatatctaagccaaacaattcagcaaccctatttgaattgagctatgtctacgcctaaatagagattttgtacgctagatatgattaggactgtgaaatataacgggttgtcaaaattttgtaccgacgtataggaatcgacttctacttttacttaaaccagaaccaattctcttcttgagaaacaagaaccgattctgatgagtccatataattgacgaccccccctcccccaattcgatctcttccatataaatcaaatcaatttgatttatataattcgattgatttgatttgaaagagagagaaattaagcggctactagcgcatcacacatggcgaagaagaagaaggtgttcatattcaggaaggcggcggacgtcgccatggccgtgtccgccgcctacgcgccgttcgccgccgcggtgtcctaccatgccgccgccgccgcgccggcggcgctggccttcgcgctcggccacggcgcgctcctcttcatgctccccttctccgtctacgcgctcgcgttcctccgcgcgccgcgcggcctccaccagacgccctacccgatgctcgcgtgcgccgtcgccgcccccgccgcgctcctcgccgccgtcctggccgtgcccgtgctcgccgccgacgacgtcgcgctcgcctgggccgcgaacgcctccgccgccgcggcgctgtggtggtgcctcacgaacggcggctacacggcggtggcgttctcgagggtggaccagtacgccagcttcatggacgcggtggagcggacgccggagatcgcgttccccctcgtgttcgacgtccccgccaccgccaaggccgccaggcgcgacgccgtccgcttcgccgccgccctgtccgccacatgcgcggtcgccggcggcgcggcggtcggcgtcctcggcggcctctcctcggccgccgccgccattgccgccgccctgtgcatcttcgcgctgccgatgtgcctcctgtacgtgccggagaatcacatggacccctaccccaccatcgacggcgtgctccagcgcaacccggcggcagcgtggtgcacgcttctggcgccggtggcgctcgtgctgtgcggcctcgtcagggcctcggccgccacgaacgccggagacgttggcacgttcgccacggtcatcgccggcgcgttctgggccatggacgccggcgccgccgtgctgctggggcgggtgatcgcgggggagatcaccatggcgagggagacaggcaagcattcgatctaccggtcgagctcgtcggagatcatgtcggcgttgctcatggtttgggtgcggtatttcgtgtacctccatgttttccacctgattggctgcggtggacacctcacatggttcaactcatctcactagcttagcctactaaagttcgaagtcccaaatatggacttcgtctcaaaaatatactccatccgtttcataatgtaagtcattttagtatttttcacatttatattgatattaatgaatctagatatatatatctatttagattcattaccatcgatataaatatgagaaatgttagagcaatcatatctgggagtaccgtcttacagtacagtattagactcagtttattgttgatatagcagaggatccacatcccctattcttttttttagataatgacatcccctattcttctgaagcagaggatcaaatccttcaatctaaacagttactatttttatttttatttttatagagactagaaaaaatacctgtacgttgtaacgggtgaaggctatgttaatcttattattgctatactgtttagttaatgtgaaatttactgtggaaattcgcttagagatatattttttaagaaactagcaaaaatgtccgtgcgttgcaacgggtgaaaaaattctaacgataatttatttttttcatacataaccatgtcaatgataatgtttgtatagattgtttatagctaagacaatcaaaaagttggaacatcttcaatgtaatggcccaacctcaacgatgacaaccttaccgatgcctgctttacctaaaataattggattatccacgtgacagcatatatataatctaaaatactctttcaatcttattcttgcaaccaataataggattaatcagatactacattacctcgcatggtcaagtctacacaaaatagagtcactatgcactcttctctaaataacaattaaaaatatgtttatttttcagtattatttctatatcatatgttatcagaaatattagctatacttaacaaaaatagtctaataattgcatatagagacgaaacaaaagcatggtaggagatgaaaaaaaattgatgatcctatccgacctaagagtccatcaatttagtgttttttttgagcgtccatcaatttagtgttttttctgatatttttttcagagcagcttgtttttttatatacagtgtttttttcatgcgaggtttttccaaaccattttttttagaaatggcatgttttttctaacagttttttcttcgcatgttttttttattttttagggatgacggaaacattttttagcgcttttttctgacatttttttctcacgcttttttaaccatttttattttctcgtgtatttttttatttttagttgtacgttgaaaacttttatttataattgtacgatgaaaacttctctttttagttgtactatgaaaacttctcttttcaaatagttagattagattagattagagatagagaagagatatatgcggactactaaaacgaatagaaatcgaactttttttaccgcgctttttcccgctccttttactttttttctcattcttttttattttttacgaactattttttcgccactttcttagggaatcagatggagcttttttagatgtgaattttttaagtaggggcggacgaatgaaatgttttgaattttttaagtagcagtgatagagaagcatacaaagcttatatacatgcgtataaaaaaatatacagtttacaaagtttgtatacgtgtatataaagtttgtatacatatatagtattaggaaataaaaaaccaaaaaaagaaagaaaaaaaagaaacgaaaaaaagaaggaaaacagaaaaaccatacgtgggaataggattatataggaataggattttcccccctttttaaggggaattagatctactgtttttttccggcttgcaaatcggacatgttttttttttcgccacttttttccgccttgcataggaatcggacatttttttttgttgtttttccctttttaaggggaactgaatctacgatttttttattttattcgctattttttctcaaacttttgggaattggacttctttttttttttgctattttttatttagatggacgaaggaaatgttttgtattttttaagtagtagagaataatgagatgctattaggagtccaatgtttttttaaaagaaatttcttatacaactccttttttattttaaaaaatgaacgaacttagaaaccgactcaaatacaaatatgtatttctaaaagcgaacaaacttaaaaattgactcatacacgaatggcgtaccaataaaaacatctttaatttttataatagtagggaatagatagaaagaaaatacttgtgcgatgctacggaacaaaaaataaaatagcaattaacattaaatagagaatttagttttgattatggaagcccttttgaaacctacatctattttctatacaccacctccaaacatgagctaaggctagtgtgggtggtatgcattatgcaatatctaaaacatatttttgttttcgcatgtgagaaatgagaatcactattagtattatgttctctctccgccaatctaataaaaaatatccatgcatgttttgattggtgagggcatggaatatttaaatcatcgctagagattgcagaggtttggttttgtttgcagtttgtaagaaactactctctccgtcccataatataagggattttgagtttttgattacaacgtttgaccactcgtcttattcaaatttttttttaaatgtaaaaaacgaaaagttgtgtttaaagtactgtagataataaagtaagtcacaaataaaataaacaataattttaaatttttttaaataagacgagtggtcaaacgttaaagcaaaaacttaaaatccggacggagggagtatcgagatgcagtttagctgctcaggttgaagccttggcttgcctggagggtgtccaattggctgccaattgggtacagatgccaataattttagaatccgacaacgccaaagtcgtagcaggactgaattcaacacaagactcaagagcagactggggagttataattgctgaagcaaaagcggtgatgcgatgtttggtgcaggtgcaagtgcacaagatagataaagagagattcaaataacatggctcatatgttagctcaaatggttatgagatcaggagttgaagcggagtggaggttatgcgctccgccagaaattcttgcatcgcttaaccaggaatgtaaatcctatgttctgccattaataaaatctctctttacgctaaaaaaaaaaataaaggctgagtttagttctaaactttttctttaaacttctaattttttcatcacctcaaaactttcctacacacaaactttcaacttttccatcacatcgttctaatttcaaccaaacttctaattttagcgtgaactaaacacacctaaagataggttgtcagggttacgggttaggcataccctttacccttcgataaatgttacatatcgatatgacatacccacgcgcatgcggatatttcctgtatattctaagggaacctttcatggaatctacagacgggaagaatcctactcgggcagaattgggtcgttgacgtatcgtatagggtctgatatctccgagttctacgtggagacctccagatctgcgatataaaagggaccccccggggagggtttaagggattgaatctcagagccaacacaacctacacagcctacgaggagccaagtcatcgagagctagtcgaaacaactcgactacaatcttgccggatccgacaagttcccttgttccctttgtaacctgtgttttctaccatataatcccacatcaactggattagggttattacctatcaagggacctgaaccagtataattcttgtcttttgtttgcttgatgtcgtactacgtagatccttgtaccaacgtactccaataccctctatatccggtctacgggtatcacccgtcgacagtggcgcgccaggtagggagccttggtactcaaggttctactactacgtcatccagcttcgtcgacaacaacgtcagcaccagcctcagccaagtactccctgcttcaacaatgctggtatggactcaagtcggcgaaatcgtcttcccggtttacaccacgacgctgatctcaaccggtcctccaaggactggagacgagaacgcagtggctacaaaccaaggcgattccatgtcgaaaaatcctcccgttgagacggagaacggaacatcgacgacatccaagctcgggaaggattttgatacggccaaaccttgtccttccgacatgaaccatgagccgacaaagatgacttccgaagccacaaggtcttggtgtcctatccacaaaaccaagaaacacactctgcaagattgctgggttttcctcaacgtccgtgctgaaattcgcgcctacaaagaacgtggaattcggcgtacttctccaactcgggaggtctattgtcctattcacaagacaaagaatcacgacctctcgagctgcaaagtctttctcggcgccatgaaagctccgtctcctaagttatatgtccccatcagggataacggcaaggaacaaggagcgactccaacttcagatcgattcgttggggtaatcgatcctcacgaaccatcggtcttacatctcctcgaggactatgggtcatcgacaacgagcgcgccgcgggaggtattggctatcgatgacgttggcacgtcagtgcacgccaacgcagaagcggggaatcaatcgactactccagcccagcacatcagggccgttcaagcgatactgagggaaactccttacgatcccgttctgaacgatgacctcgatcgttggacagaacgactacgggaatcggtgactaacctcagcaatacgtttgaagaagccgctaccgcagcacacaaggagcagccaccaactggcgatgccaatggtgaagatccggaacggagggaatcacctcaacgagctacccctccacctcgcggcactagcgatcttcgagatcaaatcaacggccgccgagaagcacgacgcacacgagacaacgtgaatcgctctcggcgtcatgtctcttcacagcgccatgataacggaaatcgaggagaccgctcaaacgaggaccgggaccacgacaaccaccacgatcacaatgatcgcgaacgatgggtgccagacaatactggtcatggctgccgccgtaacgacgacgacgatggagatcggtgccgagacaacagcggaagacgacgacaggattcccgagatccaggccgtcatcctcgtaatcgtacgccggaaccaagcgacccatcgtcatcgtcatcatccgcgtcctcctcatcgtcagacagacatccacgaaggacacacgaccgccgacaacccaccgcccccaacgctgggtgtagggctttcggtcgttccctacgtgatgtccgatggcctgagagattccgacccggagcaatagaaaagtatgatgggagcaccgacccagaggagttccttcaagtctactccacagtactctatgctgccggagcagacgacaacgcgttagcgaactatttaccaaccgcgttgaagggttctgcacgttcatggctgatgcatcttcctccctactcaatctcttcgtgggcagacctgtggcaacaattcatcgccaatttccaaggaacatacaagcgccacgcgatcgaagacgacctacacgtgttgacacagaactcgggtgaatcattgagggaatatgttcgacgcttcaacgagtgcagaaacacaattcctgaaatcaccgacgcttctgtaattcacgccttcaaatccggtgtcagagatcgctacactacccaagagttggcgataagacgcatcacaaccactcggagatgattcgagatcattgagcgatgcgcccacgctgatgatgcgctaagacgcaagaacgataagccgaagaccgggggagagaagaaaccagccacggacacatctgagtcaagcaagaagaaaaatcgcaaaaatgggaaaaggaaagctcaagcggaagtcctcgcagcagaatacgcgaaccctcccaaaagcccagacccacaaagcagcgacacaaagaaatcatggtgccccatacacaagacggacaaacattctctggaagattgccttgttttcaaaaagtcgctcgagaagcacatggcatttgaaaaaggcaagcgagtacgcattgtcgagaagaacgaagagacggctcctcacgaatcggattcagcatattcagactctgacctgcacgtctcacacatcttcggcggttccacaacgtactcctccaagcgagaatacaagaaagtggaacgtgaagtctgctcgacatggcagggggctgcacccaagatgaagtggtctaagcagaagatagagttctcggaagaagaccaccccaagaccgccgttatcccaggacgatatccgatcgtgatcgaacccactattcggaacatcaaggtagcgcgagttctcattgacggtggcagctcaatcaatcttcttttcgccagcactttggacgcgatgggaattccgcaaagcgagttgacaccaactgatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcatcgggagaactgcacttgcgaagttcatggccgcatctcactacgcatattaagtgcttaagatgccgagaccgaagggaacattcactattcaggggaacgcaaagctggcggtgcaatgcgacaagcggagcctcgacatggtcgagcaaacgcctagcccacccgccacgactgagccacccaggaaaatgaccaagacaaacaagacgccgaaaccagacggcgccatcaagatcgttccactctccagtgccaaccccgacaagaccgtcaagatcggggcgacactaaacgagaaataggaactcgcgctcatcaccttcctccgcgacaatgccgacgtgttcgcttggcagccgtccgacatgccgggggtccccagggaggtgattgagcacaaactcatggtgcaacccgatgccaagccagtaaagcaaagactgcggagatttgcaccagaccgaaaacaagccatacgagaagagctcgacaaacttctcaaagctggtttcatcagagaagtacttcatccagagtggctagccaatccagtcatggtgcggaaggccaacggaaaatggagaatgtgcgttgacttcaccgacctcaacaaggcgtgccccaaggatcactttccactccctcgaatagaccaactggtggattcaacagtcggttgcgagctattgagcttcctcgacgcttactctggctaccaccaaatcagcatggcaaaagaggacgaagagaagacagcattcatcacgccgttcggggtattttgctttgttaagatgccgttcggactgataaccgctgggaatactttccagcgcacggtccaaggcgcacttagcaaccagcttggcaataatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcagacctcgagaagatcaaggcaatcgagaacatgaagtcgcctacaagactcaaggaggtacaaaagctaaccggatgcatggcaacactaagcagattcgttgctaggatgggaaaacgaggacaacctttcttcgctctgttgaagaaacaagacaaatttgtatggacacaggaagccgaagaggcattcattgcactcaagcgctacctatcaaacccccctgtacttgttgctccccaacctaatgaagaattattcctctatattgccgccacgccatattccgttagcactgtcattgttgtcgagagagagagagaaagtacatcgaccagtttattacgtcagcgaagctctccacgacgcaaagacaagatacccatagatccaaaagctgctttacgcagtcatcatgacatcaaggaagctacgccactactttcaagcccacagagtcacagttgtctcctctttccctcttggcgaagttgtgacaaacaaagacgttgtcggccgcattgcgaaatgggtagtcgagctgagccagtttgatgtccactttgtgccacgaacagccatcaagtcccaggtactcgccgacttcattgccgattggactatgccagataacaaatcagacaaccaaggcgacaatgaaacatggacaatggcgttcaatggcgcactcaacagccaaggagcacgggcaggatttatcttgacgtctccctccggagatcaattcaagcacgcaatccacctcaacttcagggcgaccaataacactgcagaatacgaaggactactcgccgggatacgagctgcagctacacttgaggccaagcgactaatcgtcaaaggggactccgagctagtcacgaaccaggtgcacaaagattataaatgctctaactccgagttatccaagtatctcgcagaagtcaggaagctagagaaaaggttcgatgggatcgaggtccgacatgtctaccgcaaggacaacgtcgagccagatgacctagcacgacgtgtttccagacgagaatcgctcgagcccggcacttttctcgacatcctgatgaagccatcggtgaaagaggttagcggcgaagtcagcccgaacacccccgacattagctcggaggtcaccgaggcagaacgcgccattgccgacatcgaaaccacagacgactggcgcatcccactaatcaaattcatcagcagtgaggagttgcccgaggacgatccagaggccgagaaaataacccgtaaagcaaagatctactgtatggtcgacaatgatctatataagaaagtgccaaacggggtacttctcaaatgcgtctcgaccgacgacggcagacacctcctcctcgacatacatgaaggcatatgtgggtcacacgccgccggtcggacattggtcggcaaagcttttcgacaaggctttttctggccaaccgcccttaaagattcatgcgacatggtccagcgatgtgaagcctgtcaattccacagtaaacacacaaagctacccgcgcaagcgctccagactattcctctgacttggccattctcgtgctgggggctagatatacttgggccattcccacgaggacagggcggctacagattcctattcgtggcgatcgacaaattcaccaaatggatcgaagcaatacccacgggggaaatcaaggccgacaacgcaatcaaattcatcaaagggatattttgcagatacggactaccacaccacatcataactgataacggctcccagttcatcagcgccgatttccaggactactgcatcgggctgggggtcaaaatatgcttcgcctcggtctctcaccctcaaagcaacggacaagtcgagaggggaaacgacatagtactacaagggatgaaaacccgcgtctacaacaggctcatgtcacacgacaaaaagtgggttgaagaactcccatcagtactgtgagccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgtgaacgagttgccgtccgagcagccagctatcaacagatcctccgccgttatcacgagaagcgcatccgtgcacgcatactttcgatcggcgactatgtcctccgacgagttcaaagccaagcagggcgaaacaaactctcacctaaatgggaaggaccttacacgatcacacaagtcttgcggccaggcgcattcaaaatcgcagacggcgacggtcgcgaattagcaaattcttggaacattgaccaactacgtaaattctatgtatgagtcaataccatccatacctgtaagcacccttacagtatcaataaagcctatttctaggcccatatcacaattaaagtgtttcgcccgatgatccctcactctgatgacacctagcgttgaaacctgtccttatgtccctttacgccgtctcgacaaggcctccgaggaacctaagggatcttcggctggggacacccagagccgataaggccttgtcagatcctgtagagacgaaagaccatgtaagatctggtcgtgtaagagttctcgccgtgcgtattaaccaagccgtgaaatcggaaatcaactttccaacttcatggctgggggctaggatcagagcttattcaaccaaggcagttcaaaggtccaagagccttatcctccgagaaaattcctccgacgacaaggctgggggctagggagagtgtacgactcaaacggctgactaaagtcgttaactgagaacgcactcttacacatgacatctagagtaagagacatttgtcaaagatagatttctttattcacaaaatacttcttacaattttttcaaaaatctttcgctacattacatcttttcctaagatatttgtcacagggtacgagtactaccaagaaggccaacgccagtccatagactggaagatcttctcggctgtaacattctgaaaattcgaccaacaaaatcaaagactccaaaaattcagatcttcaaaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattcggtgggtttggaaataaataaaatgttatcgcaaccatattaacaataattaaattttaatacgatggaatgagaattaactttaattaaaaattcaaatgaattatataaacaaaatatgagtgatattaaattaggtgaatcttcaattagaataatataaatatggggtaaaacttcatttatacaaaaaattaagaatttcggaatgaaattcatatgagaaacactctaaaatcggtttattggaaaagtgcattgttcattgcccgccacgtgttcgacctggtccccaacctttcccctcccctgccacgcgcgccgctccgcctcccctctgccgcgtcgctcgccgtcgcatcaccgtcgtcgtcgcgtcgagccccgtgccgagccgcgcccgtcccgctgccgcgccgctccccgtcgcgtcgccgtcccgcgtcgcgtcgccgtcccatcgccgcctgccacctcgccccgcgcgcccacgcaccccgt

SEQ ID NO: 21508 - DNA, 17086 bp, Oryza sativa
ctgcagccccgataagaaatttctaacctaatatatggatataatgctagggtagattaaattaaaaacatacgacaacaaaatattgtaaccgcaaaataatttaaaccaaaattggggtttgccatagttcgcggatagtaaaattaataaaaaggaattgactttcgcatttgacttccatttggatttacttggatttttatttgaattctaaccgaattcaaatcaattttcgcacgtaactatagagaccgagggagccgcggatccaggtgaaggccaagacccgcaagacctcgagcaaggcaagtcatcactattccttgaacatgttgatcccaattgcgaaattattttgtttataaataaaattgcatgcaatgatgaatatcctacttgggattatgccatgccttgattattgtttacccttaaatctttgtaaccatgtctacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatgttgatgacatgatttgtgaaaggagaaataaaattaaacaaatgttttcgactggggcggctggaggacttgggtggtgtccggtaaaggctagtgccgtccctggtcagttaaggactgagccatgaagttaaacatgaaacgacctcagtacagccgtacttctcgaatgggtatagacctagcggagtagatagccgagcggaggcagtatccctgcatagtggtttcacttaggtgtgtggacgaacaagcagtctgctggcggatacccgatacggatggccaaatggcggatacccgatacggatggctagagactgacttggcaagactacaagactacaaggagatacccaaaaggggacagcgtggattgggttcaactacagaatgcgatgttaggcttgcgtgagttttccccctcgggagcgccagaactcctctcactgctagaaaccgtgtacgcctagagtgcatgagggcctaagttcatggagcggatactgccaaagtgaggttattgaaaggctttgccgtggcaagtctcattcgttgggacgtaggctcatgtgttgggcaagttgcggagtacgggtaaagtgtacatccactgcagtgtgagtaaaccaaatctattcgaatagccgtgctcacggttattgagcaccgggacatgtattacacttggctagactctaaattcttaacttgtgtgggatgggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtatggtcgttgcctgtggcaatggcatgccgctgcctgaattctgctgccttatctatttctgcttttggatgtattccggacctctcggtccgatgatttaagactatgcctgcgggcctatgatgtaataattcgtattagatactcgtgtatgtgcacttgatattccagctatgaattcgtgtgtaccaaactacttgatccagggaaatggtactgtttacacgattgattcctgttataaaaacgggggtccacatcggccaacggcgacattgaccttgccagatggtctatctccgccggagtcctccgagaacgagcaaaaccctcacggagatattcgaggtccaggcgcgggcgatgatttcgtaggcaagccaacacgtgccctccggcgtatcggctcgatcgacgacactcctgcttcaaggcctcgtcgatacgcttgccgattccatcgagttgggcacaggccccattaagccacgagatgtacccggccgccgactcctcgggatctccgcggactactcgaagctccttgcatactctggccatggatgtgcagcaactcttcaagtacgagttaaaccacacctcacgacctcggagcgtttccacagcctgctctttcttcacggccagcatggttctctcgagctccgccacttcaaacttcgtcttccagtattggatatgacgatcttggctagcaagggcaccctcgagatctactaaacgtaataaccactaagtcaagctatacatctctttcgggaacatggctaacctagtcaggagggcattaaggggtgaagggactactaacctgaggaagtcgtcgccatcccctctatatcaaggggttgatccacatggtcaggcgagacgtgtggttcaaactcgagtaccggaattattgccagtgactcaggctgcccgcgctgctggacatcctcgtcatcagcatctctagaaaggacaaaagttcccgaggtcagcataccaaagtaagctgggatagtaatcgcacgcacgaaggcggtcagagttcaagttttacacattatctaggaaatacaagaagtcctactcttcaaaaagggggagaacagactcccctagatcaccgacttcttccatcacctccttacgcgtgtcgctggccgccctctggtccaagatctcgcgcagatcgagttcaggacgcgacagccttacacacgcgaggacatgacacgccccggtgtagatcctgttcgacgtctcctccgcaatcctggccgcatgcttggaggggatttcccccatcgccgtcaccagttccgcgagagaggaggtcagcgaaaactcatcgggattcaccgggatcgtggacttgacgccgcactccccggcgagctggtgaaggccagtgtaggtgaccctcaatgagccccggatctcggataggttgttcccgagttccgacattcggtcctcgagccccttccgttgtcactcgttgtcggccaccaactcgcgtactagtctgtcagcacgcgcgttcgccgtcgccgcttccgacctcgcctccgcaatctcgcggccgatgccgcgagcaccagcttcaaggaggcgccccatctcgacttggagctcctcccaggtgaggactgcaactggcagatcacgacctgccgcggggtcgctgactgggccactaggcgtcgcctcccggctcccggctgcgggcacgacatccgtcgaggccacgacgggcgacacactggaagctcatccggacttggctcgcgcagcctttgcccgcgcctccctacaggacgaccacgagtcagacaacaatcgaataagaagcgcggggattcaagaattcatctacttacttctcgctaatcgtcacaatgcgttgtcgtcgtggaggtgggggagacgcgtccgaggcttgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagatgcctccttgacgaccttcactttcagagatgtcgccacctgatggtccgcgagcggtccaatgatgtcagtcaaaggaagggcctacgcttaatcaagtcataaagtgatttcgaaaggagaatgcgggatgcttatcgaatatacttacgttgatggcttcatcacgttccgccgcccccttttcataaaggggcacagggatgtcactcgccgtggtcgggccactgatcatcacctggccgacgcggcgctccacgatttcgctgctcagacctgttaatcgagaaccaaccttcgataaatcaagaggaacgcgaacacaagcatgtcaagataaatgcgagaaagataccccgaggagaaacccgggtcgcgtcctctggcccggaatagtcataagctggatgggcccgagcctgaagcggctggatccgcctaccaacgaagtctgcaacaacttcatatcccgacaaaccctgtgctcggagatcgtcgatgatgtcgataaacgactgaagagagggggtcaaggggggctttgcggtccaagacggaatcttgtccggttgatcttcaggaaccacgaagacagggttcgagttcttgatctcaagataaaaccacctattccgccacttgctgcgagaagaagggcactggaagggaatgtaacgcgacttcaggccatcccgaagtcggaacccgacgcaaccagataccctgttggattccatccaacgcagttcgtagtaaaagcgaaaaagatcaagaaaaggctctaccccgatgtaggcctcacaaagatgcacaaagatgctaaagaaggcgatggaattggggttcaaatggagaagagaaagaccatagaaattcaaaaccaggagaagaaattcggaagatggagggagaaaaccgcagagaacacaatcttcgatcgcaaccatgcgacccaagatgagctgaggattagtacctcctgcttccctctccatggttccacggccaggaagagcgccatcctcctggagtttcttcaacgttgcactggtggaagccgatttgccgaggtccattgctgatcgaaggtcgccggaaaacgagcctaggttgttgaactagggtttcttgtggtggcggagaaggcaaatagtgcttgcaggtggtgtgtgtttaacaggtttggtggacttcaaaatggactctcaaaattcctttaaataggcgcactaccgacggtgcaaattccagggaatagagagagatgcccgccagaaatttctgggtccgttacgcgcggcggttttctggacttcagtataaaattcgctcgtgaccgttgggcttcaaatggcgtgctcgactatggtctatctccgcggtcctcacaccgggaatgacaacagtctcgacacccgaagtcgtaaatggttgcacgagttcattttaagcagaagtcggggggctactgtcagggttacgggttaggcataccctttacccttcgatatacgttacatatcgatatggcataccacgcgcatgcggatatttcctgtatattctaagaaaacctttcatgaaatctacagacgagaagaatcctactcgggcagaattgggtcgttgacgtatcgtatagggtctgatatctccgagttctacgtggagacctccagatctgcgatataaaagggaccccccggggagggtttaagggatcaaatctcagagccaacacaacctatacagcctacgaagccagagcctacgaggagccaagtcatcgagagctagtcgaaacaactcgactataatctcgccggatccgacaagttcccttgttccctttgtaacctgtattttctaccatataatcccacatcaactggattagggttattacctatcaaggggtctgaaccagtataattcttattttttgtttgcttgatgtcgtactacgtagatgcttgtaccaacgtaccctaataccctctatatccggtctacgggtatcacccgtcgacataggtcgtcaaagaaaaagtgtgattattacttgttcgtcagcatctgaaccaacttcatacatgtacagtccaaatcactccatgggctgctggcaatctaaattaacgtgatccaaagccattaacagtattgcaggttgcagcctatacagggcacctacaaacgtacgtgtaagcgggcagccactggcggcaggcgggatgtcggcttcggctccttggaaaggaaggcactccctccgtacctacgccgtttatctttttaaacatatttttaaacatatttgactattcattttattcaaaaaaattaagtaattattaatttttttcctatcatttgattcattgttaaatatacttttatgtatatataaagttttacatattttacaaaagtttttaataagacgaacggtcaaatatgtttaaaaaagtcaacgacgttaaatatttagggacggaaggagtattatagatcggagatggacggccgagtttacttccaaactttttcttcaaacttgcaacttttctaatcacatcaaaactttcctacacacacaaacttccaacttttccgtcacatcgttccaatttcaaccgaactttcaattttagcatgaactaaatacatcctacaggtcagataccgggcgacagacaaagctattgggaagagatagagagatatatgcaaggaagcacatacggattcggacgacttaccaaggtcctggcaaaaacatcttcaatttttataatagtggagaagtgtttgcactctactttccaaactactccggtatatacatgactttttctctcctcatatgcttcacggtatagttggccatatgggctgcccggcatggcatggtccaggcccgatcatgctcgggccaagatttgttgggccggcacaacccgaccaatacgccgggccatgccacgtcggcccacgtgctccactgtggcccaggcatggcccaataagggtcgggccatgctgggccggcccgaaggcacatgcagcccatcatgttttctttgaaataagtctatttcccctccatactctttgggttgtgacatataaaaaactaaataagtctattttacgtccctactctctagtcgtgccatataatacgtctatacgtctatatggttgaaaataagtctatttcacctcgctaaagttcgtgccgtgccgggccggcccaccgtgccgaggcataggtccaggcacagcccaacacccgaaccgtgccggcatgggcccgacaacgatcaggccgtgccgtgcctgggccaggccaaaatcccctgccttgggccgggccgttgggcctcgggcgttatggccaactatacttcacggtgaaacaacagtagtaggagtacgaagcaaaatgccaagatccaacttttttatggatcttcgattttttttccccctaaagaccactagggttgactagttggcgtagggttacagctaatggcttcacggtacgactcatttatcttttattttaacgattgaagtacaacgttttagactctgcaccaaataaaaacacacacatttatatttataaacagaaaatttttccgtttgaaccatcctttacctaacatttttcactttggactaggtaaacatatcttttatcttttgtgtcactttgaaccaccccagttttctaatccattcacatacaactcatcgtatattgaaaatgttatttatatataacttcgagagttcattgatgtactagagcggtgtcatatttgaggcaactgcgagttgtcattccccactttcttaagcaaatgtttgagagaagctgattgagaagatacacaaaataaggtgaaccattagcatacgattaattgagtattaattattttaaatttaaaaaatagagtaatatgatttttaaagaaactttcatatataattttttttaaaaacacacaattaaaccattcgggaagtatgcaaaaactggggtacctttcctctcgaccagcttatgccgaacacagactgtgttcgttccgagaaagggaagaaaacttccttgttttccgcgcacatgtttctcgaactgctaaacgatatgtttcttttaaaaaaaattttctttagagaagttcctttagaaaactatattaatttattttttaattttaaataattaataattaattaatcattggtgaatgactaattttcttaatcatacgctaataattaactttttttccaacaaaggcatagaatacatgacgttgacttttaagctgttataagaactacaactagtatgcttgtgaagtgaagaaccattcaggaaagttcagaggtttctgccgaacaactggcctcactcaggctgtgtttagttggatccaaagtttagattttggttggaattggagatgatgtgactgaaaagttgtgtgtgtatgacaggttgatgtgatggaaaagtactgaagtttgcatccaaactttggatctaaacacagccaatcagcaggcgacagagatctcatcaactgccctgctcacctccatgacagtttacagttaacagaatcttccatgaaaactccgaatagatatataataagatggatcccccttcaccgataaaataatacttacacttagattcttccgggaaaattcccaccatgagtatattacatatgatgagtaattgatctcagagctaagagcttttccaaaaaaaaaaaagaaataaaaagaaaagaaaagaaaagagatgaaaatgctctataaaatgaagaagtgacacttcaactagtgttgcactaatattggaacactcatttagggtacttgagaacttgaaattacgataatccaagcctaacttgctcataggaaactgtccggatcatgagaggagacaaatccgaagctatataaagtcttaatttggaaaaaggcctaaaaatggaattaattgtttctaccactatcaaaatgctagtacgagagcgcaccaaaacacatcatctctcccaattctctcatacaactaactattcaagacaagtacaagatgatctaaaagattaaaagtttgacgacagaattgcacatacatatgaacactttcttcagtataaacgtggttattgctatgcgcgctgtgaattcgattttatcaacttcaacttcaaattaagggactaattaaaacgaggaacaaatcaagccgacgacaagacactaatccaaaatccaaagtcaaatcataagccggcaaggacgtagtcaccgtcgtcgtcgtcggtagtcgacgtataaatcgttctctgcactttctgcaggctgcagcttcgcctcttcttcctatgctctgcatcctaaggtgaagtggatatgcatcaatagaacggacaagtgcagaactttcgaaattctaactagtctagagtaaaacatctcaacctttttaagtgaattatttggttggcatgtagagattattataaaatgcagttttggacatcaatattggttttatttgagaagctacagattttgagaagcatttctacgacggatatttatgtgctttcttaggcaccattagcatcaagtttttttttaagatagatatacactacttctgcttttaaatatacgatattattaattttcagatatgactttgaccctttgccatattaaaaaatataactatcacttatttattttattgttacttgaatttttaataattgttaaaggtactttaaatgtgatttatatcttgcgctatatcttttcataatatgaaatgatcctatccaaccttgcatacggccctgccaaggtggcagcgcttagcgccatgatcgttagcactatgccgttggacctcatcgctaatcccgatggtgctgaggtatggtttatttttaaaataatttctggcacggtttacccttcaaataaattttctaaaaggataacatttatcaaaatttcgccaaaacatacatcatgtctctcatacaactactctctccgtttcataatgtaagactttctaacattgcctacattcatatagatgctaatgaatctagacattattatatatatagattcattaacatctatataaatgtggataatgctagaaagtcttacattgtgaaacggaggaattacaagataatctaaaaaaaagaaaaccatatagcacagtgcagttaatctaaaagtgcaatataatctaaaagtttgacgacataagtgcagttgcatatgaacacttgcttgcgtacgtgcatggttggtttgagcgctgtgaacgcgatttgtcaacttcaacttcaaattaggggactaaacgaggaacaaatcaagcccacgagacgacacatacagtaatccaaaatccaaagtcaatcacaaggccggccagatcatcaccgctgtcgtagtcgtcagtcgacgtaaatcgttctctccattttctgcaggctgcagcttcgcctcttcttccttttttgtagactgcagcctagatgaagtggacatgcatcaatagaacggacaagagcaaaagttttgaaattcgaaccattcttctgcaaaacacctcaagcttttaagcgaagtagttgctggtaagtggtggtattataaagagtacaccctccgtaaaagaaaaaaattcaacttataaaaacgaatgtacaaatgtgtttatccagattcgttcttagaatttcattttttttatagagggagaaattatagacatcaacactggtttatttagtgagctaaagatttcgagaagcatttctactagcgatatatggtctgttagacgccaataatataaagtttttattcttaaaaatgatatatatatattgcttatgtttttaaatatatgatgccgtttgcttttagatatggctttgaccatttgttttattaagagaaacataaaagtataatttcttcattttattgtcacttatattttattattgttaaatgtactttgaatacgacttttatcatgcactaaatgttttcacattgtgaataatcaaatgctaccacaataaaagtcaacaccatatatatttaaaaacggatagagtaacattcataaacaacctatcgtagtgaatgagtatctaacctatcgtagtgaatgagtatctgtgcgtgtatatatatatactagctaaatgacggtgctttgctatggattaaagaaaatgtattaatgtgttacccatctttttctaaacgaaatattcatcttaatctaattttatgtggctatccatttagattggatccttttaatattaaggagttcaaggggtaatttgtaaaaacttactgtaataagagtaggcggagtccaccacaactgtcttcttttaaatgagcacaaatatgcaaaataaaagtttatgctatctaaagtgtacttttaacatctcaaactgaaaaagaaaaaaaagtgcaaaaacccattgccacaaaagaagggatcaaacccaaaaccaatcgacaattacgagccaacagagtcatagattactcaaaacacgtcatggattactcaaaaacactccacttgtgcactcgctcgcgaacacagtaacaaaatgtgagctcaagcgaacattcccagctcgttccaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacacatgcatctaccaattttgagatatattatcgattttgtgcaacattcagagcaaagatatgttagattgataagttcatcccaataaaagaagagacatgcggacattgttgttgatttcaacttggatattagaatttagaagtgctccctgtccgctgacctgaaatttgtgcttttttcaggtttcagaagaagtagagaaagcaattttcagacaagtcagcacaccagcgcctccaaggtgaggcttgagacatatactagctttcatttattatgattactaaatttcacatgtaataaaaaaaatttgatgtttagtttctttctgctctaacatacttaatttggttctttcatctgcagactgctagcaggattgaatcagcagcgtccaaggtatcaactcgtgttcctgaatgaactaaagcctgtttacacactgatgaaattagaagccaaggatggaccgggtcttaaggtggctatagtcgaaagactcgaaaacaatcagatgcgcatcgtcaggttcggtcatcttgcttctgctaaggttgaagttgtagtcctccacggcaactttaatgctaaaaatgaggaacaatggacccctgaagacttcagcaagcagatagtatgcgggcgagagaaaagcgcacaacttctcaccggaaatctgacactgaagctcaatggaggggaagcattacttgagaatgcaaccttcactgataactctagcttcactagcactaagaagttcaggctgggtttgaggctagccaacaattctgaagatagggttcttgaaggaatcactgaaccttttcgtgtaaaggagcgtagggtggagggtatgccattgtccctaagattcagattgtttgtttcttcagaaatgtcttttggaccttatagctgagactaataatatgcaacttactatttttgcaggatttgaaaagcactacccgccaatgttggatgacgaagtttggcgtttggaaaagatcggccgcaatggagctcaccaccaggccttgacaaacagtggagttgatactgtacagaagttcttacaatcatattttacggacgaaaagaagctttttcaggtagaggttctatgaatttccttaaatattaaatttcagatgatgtttccataacacaaggacctgataatatagatgagccgttggtttcaaaagagaaaaaaatagactcaccgaattccctaaaaaaagtgactgacagaagatctttgatatttgtctatagacttttagcaagatgtcacaggcagcttggaaaaccatcataagccatgccatgacatgtgaagtcggtgacgatctttgcttgtatgaagtgaagggcaacaacgtgggacttttcttcgatgcaatatatcagcttgttggggtgaagtttggtgattcttacaagcccataaatgagctcgacgaaatagagcaggtactgtttcctcacttccttcaacaggagattttctcactattttcctaataatttggtgttttttgttcacagagtgcagttgaaacaatgaagcaattggcttatgcgaatataagtggtattcagtatgaccataagatggtcaacaactatcctgtaccgcttcataggttccattgtgggggaacttctatgttgactgactttattcctaaacagcagatcccaacttgtggtaatatcttgttctgagaatttcaatcactagcgataattacttttttggggatttttggtcatctattccaattgtttacaggtcaatacaattcagccctggctggtcaaccatttgaatcaacggagaacttttcttcattccaagaagcctctaatgtaaggaagatattttgaaatatacaaaatacagtacataataaaatacatatgcatgttagtctaagatagtttcatcaattttctagcaggcttcagtggatatgtcaagatttgtgcagggtcaaacctccaacgtgcagtttagccaacagttgggcatgggcaattttatcccacatcattcaaatcaaggaacattcatacccagaccaagaatcactcctctgtgtatacctaataccgaaaaaacatattttaatccaaacgctcatagcagcatccaggctgatcatgctgccacacgaattggccagtatgcacataatgagcgatctcattcacctgaagaatcatacaaggtaagaacctttttttatgtaaaaatctatgtattttgtctagatagaaatcgaagagtaaaaatttgacattacttgtgctcttcattcaacagaactaatccattctgtatttgtgttgacagcgcttttctccagataatttcctccatacagatgaagttgtggctttgatgcaacctcacttagtgcctccaagcaacagtaattactctatgctgatttttttttggctacatctgattcattcatcttgatgctaattactaaggatggcatctgcaggcgagaatttcagtaacctgctcaacctatcaagcaatgaccaaacctcacagcaaattgccgctccattccagccatcaagaacaaacagctttgactccagctcatgtgatcagctcatacagaatttcatttctcagttttctagcaacgaaagagttgcggtgccattgtccccacgcaagtgggtcaagatcagggcagcgctgaagctggcatctgtgggtaggctctccagagcctcgagaaaggcttcgcatcgccccccagcaaggccaaggcttgtcccaatagtatgagcctggtgaaaacaggttgtaaaaaatttagattaaagatcgatcttggtgttgatgcagaagttctagagacatctggtcaactgaaactaatgattttgtcaaaaagttaggtgtatgtaatctgtacatagtagagcctgcttgtacttcatttagtgttagtatttcccagcagaggattctgacctctttgttatctctgaatttagaaccatgtaaacaaaaagaccatgtaatgtattccttttttgcacctaatgatccttgagagaaatttccttttaagaaagttcacatctatgatgcaatggtaaaaaaattgtaattggcctaaatttgacaatttaacatgatgaagcgtacaaacttgtcattgaacttctctttgttgtaatggcacatggcgggcatctattccaggctaatgtacatacaatacaaccgtaacttctgcgtgtgagctatgtactgatctcaaatttgaaaaattccttctgggtttacaatttctctgtcctgttggaggtcttatctgtttatctctatctttgatgtctcaaaaccaatttttccatcagactgaacaatccactgatccttatacagggttttagaaacatccttctttcagtttcctattgatctcaccttggcatagtgggatccaccttcgcactagtcgattattttggagtgttaattttgccatttcgagttcttcttccacccgtagtgctgaaaggtagctgcttgctgttcctgattggggtttgcagccttttctctgacattggcgacttcattgcaagatttggaatcctgagtaaattcaaagcagcacaacaggttaaagcaatccaatgcacacaattttcatggaaaatacaggatttaaattggacttacttcgttgctgtaattttcgtattctttgtttgaggtttctttataataaaggcacctctgctggcaataccatcagctttgaggccactggtggacaacaacatttcttggtcggaaggcgagctagtagcagcatcaaagctatctgagtcatcagtttctactggttcagccctacgcctttgcttgtcgggatcatatctttggtagaaaaatgttggaagctgagttgcgccaggctccagctctagaatggaatttccattctcaaattgattattaccgacagccattctatcggtcttctgaatgccattgcaattttcagccaagtcggatgagttgttctcactgaggacaccagaaaattgaaagctggccttcttttgcattggagtggcattgttccggaccttttacataaagaaatataatattcattaaatgaacatcattacctttcttgtgaaaagattaaaaggaataataatctactgaaggtaacataagtactctcaacaagaccatgaactacgctttcgtcagttttagtgttgtccagatcattcacaaaatgattctgaacttgatgtacaaatgcataaatctactgaaggtaaacataagtactctcaataagaccatgaactaccctttggtcagttttagagttgttcagattattgacaaaatgactctaaacttatgtacaaatgcataaatagcccatctccatttagaatgtttggtaggttattttcctatttgacattgattggaatcataactagcactcacaaaaaaacttcaatgtgaaaaggaaatatttttgtgatttccaagaaaaagagttgatcttgtgtgaaagagcagttaatacctctaagtttccaacttcttccattggctgtctatttttagggaaggcaggtattgcattgcctcttttaattctatacatgtcagggcttgactgtgtgctttgaatgttttctggttctccttcctttttagccaatgccgccttgagggtagcaatctgaaacaagagcagagaaaaacgatgattatataaatctaaacagaagtaccacatctagatagtttatataaatgagcaatcaggagttaagtgaacacctgttctttgagctctctaacctcactgccttctttgtttgcttttgctgcaccaagctcaactgaagc

SEQ ID NO: 21509 - DNA, 1028 bp, Oryza sativa
tcacatctcctaatgctgaaagtgactggtttatgtactgtgcttctttcagcctgtctcctacaacctcagacttatcaactctttcactaccagctagatccacaagatgcatgcaacctctcaacattgccccagatgttaaatattttccttggacatgaacagacaagcagctgcatgtagattcctcagccataagtacagagctcaaatatgaagttttctggacgttctcagtatgaaacaattgcatacctatgagagcggctacttcgatcgttgatggctgttgaacccactgcacgattcttctggccttgattcatcaattcaacaacatcggccgtagatgtgacaggaactatgcttgcatccggaacagcaagccctttctgtggagtatttcttatttctaatgtagattaatgttaaggagatacaagatatgcttcatagtaactaagataaaaaagagaacaacagaaaaaaagaagacgttttactggtaaagaaaaacacaattcaatggaaaaggatatctcctgtttccaccatcctgaaggagatccctcacttgctcattgtagatctcaatcatctgcacagaaatttcataatcgattgtcccctttctctgtgctttaatattaaataagtcatttagtgctctatagttaacaccgaggctttcctctgtcaaaactttcggtccactctgcacaaaattcataaagtggtttgaacaattttgaaaaggttatcaagacatatggaaataatatttttttagtacagttcattaccatggtaaaagtctttcctgatccagtttggccatatgcaaatatgcagacattgaaaccatcaaggactgaacggatcaaaggctgcatgtctgaaaagacctcttctgcattaacaaaaaaaaaaaagaagcaaagttcagtggtccatacaaatcaaagcagtttgagaaaaaaaagggaaatccagagcaacttataagttaaccttgagtagatgct

SEQ ID NO: 21510 - DNA, 2497 bp, Oryza sativa
aagtagtctgcaaacaagaaggtaaaggtcattaagaagtataagcatgattgtgcccaaaaaaaccataccaaattatagttcttaccatctcattagactctatagaaaaatcagtaactatgctttgcccctctgaaaattcactctggattgcctctgctgagtgccctttcattatcttattcataaaagcatcagtattcttgagtataaaatactttctggctgtcaaaggttttgaaaggccgccatatttacacgaagcttgtctccctgttttattactttcactgaatgacttcaaagcaagaacacaatccacaacccgaacacctttgccaccctacattcgaattggcagataaaatacatcagtttctcaagtgactcatatattagtgatgcaacattcatttcaagatttctccctctagtcatagatacatgtcattttggacagcgacgtaatcttccaaatgtaaattttaccactaatttgtattgtcaaatatctttaaaacccattaaaattaaaatgttatgaaattactttttgagaaaaaatctgtataatttaattgtgtccaatctaaatatttaagaaattgatttaaaaagtttgaccagacacttgttctaaacaacaaatatttgtgaccaaaggcagtattgcaaatgatgaggtaagccgggaagcctgtctaaagaaaattgaacctctaggatgaaaaagtggcttgtgacatgaactctccaaatcagcatgacagagttaccttttctaaatcggacacctcaaatgtaggaagccttaaatcttctacaacaacaaggaagttccgcagattctcaaagtactgatatgcacacagagctgagccatccgtggggccagcagcatctgactgggcttgtacaacctggaaacattttaagattgccaagagaaatgtcatcacatattagcatttgtggcttctgaataatctataaaatttgaatgcgaaaaatgcaaccttaggtatggcaccaggctggatcttattcagtgcattgcaaagaacaatcccatttctcagcccaagccggaattcctcctcagacggttcatctggcaggtctcttgcacacactaccccaaccgtgcttcgcaaccaacttgccgcatcataccgtctcattgctgcaattgtcaacccagtaaaccatcatctcacactgactagatgtactgtaaatactgctaaaaatctctgctaagaagtgtcctaaacatgcccaacatttttgcttaccacaaaattatgataacacgattcataattcattacatcactacataattttcagtggcattataatctggacacatcaatgtatactaattttcatagtgctactattatctggacacatcaaggtataccagtatggtacagctaccacttcttagtctgaaccaagaaaggcataaagcataaacccttctccccacacaaagatctcgtgaaaccgacacaactgtgagctcaacactagctcaatttcaagcgaggctattaaatgaaacctttaatcaccaccacccaactaaatcatcaacccgaatcgcaccaacaaaatttgaaaaagccgaatcgatactaaactgaatctgaccaaaaaaaagttgaaacgtcaaaatcaaaaccatcagagcccccaatacgagattctccccagttcgatcaaccatctaaaccataaaaaacccaaaaaatgaagctgaaacccgaaacgggtcaaccaagaacagcagagcaaacaaatcaagaaatcacccacccacacacacacccagagtgttctacgaaatgccgcccgagagagagaacccaccttcctcctcggccctgcgtgacgccacgtccatgtccctcgcccacccgtgcatcctctccaccatctcctcctcctcgaccgccgcggccatcatcgcctcgaaccggcaccaatcacggcgcctcgaaccggcaccaatcacggcggcccgatccaccggcgggatcgtgggagcgaggagaagacgcccgggagagtggatcgcggcgaggagggctggatcggggggtggaaccgggtgattgtggctgggttttgatggggaggaggggggtcttggttttcgaatggcgatggcgctcggaaggggaagagagctgttgaagacgacgtgtggggggtagggactgagttgtgaataatagttttttcggggggtaaactgcatgtgtttggattattatgattagtttgttgttatggtacctcttgttttgtttttgaaggatttccacttgtgagaattggttatggaccaagttttgcacctcttgggtcaataatatgggtccttttaatattgaggatacattttgagaaactttggcacgtttgatcgcaatggttaaagtgcatagatctgtattattagcgtgtcgcataatttatcttt

SEQ ID NO: 21511 - DNA, 3509 bp, Oryza sativa
tggagtgttgagtcaattttgacaagtttttggtcgcagtgactgaggagaacaagaattccgttcgtctttgtttgggaccaagtccacgaaattaggagataatttaatcaccgatattttggagcaagtcaaatgaaaggtgtgtcgggaaatttcaactgtcaatttttattatgcatgtgaagacaaaatattgaaaaaaaaattgggcactttaattatttggtgaaatttggtggcaaatcacgatcgtgcatgcaggtcacacgctaattaatcctctacactaaacacaattaatagtttgttacttgaacggctcagatattccatcacatctatcacggatgaatctatgcttgcactgcatacatataaatattttcaaatttgcgattggtctcaaggaacaattgcgtccataatttcgaaaggaatttgatatcgggtacaaccgggtcagagacccggatccgtttgtggaaagctgagagagacgcactcgggcccactcccaacggtcggggatgcgaaaagttgaccttacctgaaactttgcagacaagcccctcaactttcctgacatttgattaattcgtgaaatgtttctctcattcaaatttcatataactgaccactcaattttatatggacagaaaacagaaaatgcatagtatttttttaagataatgaaatataacatagtatgaaaaacaatggaatgcacaatggcgaattcatgatgcaaattgagggaggctagcgtaaaaacatagcatgagtggagcaatattaactgaatatttcccgatgaaatccaaatgctcatatcatcaaaagaaaaaaaagaaatccaaatgctcatatcatcaaaagaaaaagaaagctttctctacattaattcacagctaaattaacatatccaaaaaataaatctatgaaaaaattggaccttttatataaaaagatatggtcttgatcttttcattaaaaaaattgatattgtctaattagaggcaagtcttccaagtggggctggtgtctcaactagccccaacaacctatccgccatcagaaatgtaaaaaatatatatcaaattagaaaatagtattgtctcagttttaacacagaagagagcaattggtttgctttcagtacggattatgggaacaatctatcatgacatgtttcaagaatcaacaaaaacccggcaattttttgaggaactccctactccggcagcaagggacttcggctcaaggcaaaagaggacatctgtgcctcactgaggacaactgttaaccagcaaatctcaacggtatagttagctccatgccctagtttttttcctgaaacctctcaatcccatattaagcatctttctcactgataaaaatcttatggaagagtatttccttgtcctcttaactttggtgatttacatgtagagctgtaaatactttcctttggcctgtgggagaggccagcctttttatctctctgttccaacctctgcctcaatctgggtctcgttttatatgagcaaactatcatatatcctgttaatcttgccttatttactgccagaaaaagctgtactattgagcttgaatgcatgtagttctttttgttttttgagacagaatgcattttgttgagagaataatgatacaacactcttactgagagcaccaaaatttcaaaaaacaaaaatattaaaaatagaaaaaaaaaatgtatccagctaacattgcagctggaacatcagtatcataattgtcaagtaatttgaggattttaacaattgatccaacccgtgacccctctcctgcgtaggtggctcggggtgaaaaccctagccgttgccgccccctccaccctatcctccatctccttgtgctagtgcaagttgctggccaaccgtgcggtgtgagcactataaaaaaaacgattttcagacaaccccctttcatttcacaggtgggcatttgtgataacatgaaaattaccttataaatttgaagatacatttgttcaatgaccagacttctctgtcaactttaagcaatgctttcagtcataaactttaagcaatgcctgcatgtttgaagagcgctataggacatattacatatattgttctccaacttgacttattggttgtaattatttaatcttacatgcaaacactaagcgggacagatatatgttactttcgaaacaactgcctgcactccataattcttctgtaaggaaatttaattacttgcatttcattgaggtgaataccaacaatcaatgatgttttgtctatttctagatggagattgggtctgttactcccaatttactgttctattttgctcatcttgtttaccactttttttttcttcgtttttcctccatgggttggtcgatcatcttgctcatcttgttctattttgcagtgatatgattagactatagagcagcttcaccaaaggagagttcgtcatcgccatcgccaagtcttgattagaagttagaacacatgatgatgttaaactataaagtacgctgggagctaatgaatcatcagtatatatgataatgaactcttctgtttgaattcaaaagttacaaatttcttcaccgcactcgttttattctcaatgcctcctaatccgatgtttgtccctaccaattactcatgtcactcatgagcatgcgctgaatccatctcaaactggtttgtgctcatgaaatgtgattttctgctctctgtgagctctctacttaaagctctactttcacatacggagacacgtgaaaactagcacatatattttggttgcacactttctcttgtgtgagagagctttactttccttcttatctctcttcccgagcaaagcaacatgtctactagagcatggatatatgcaagcgttgttgaagctattaagtccattacggacgaatatataattgcattttatacataaaaaagaaaatcacacttgcgattagtctgaagaaaacaactgcaactataatttcctgaaagattttattgttgggtaccatgggtaggagacaggagtggacctaagctttgggccaccaggaccatggcgtgaggcctaggactaccatgggatagacattttaccaccacgtaatcatcatacaaggccgtattctccatgggcttgcttgggccttagcccaattttgggtccctccctgattagagaccctagattatggagaacatcgagagcattcaggatcaccctgtgaaatcaaagtttgttttgattattaatttgtgatgaacaattggtattatagataattaattttgatatttggatattattggcgaagtagtgctatctgtgtggagccatacaaaccaggcagggtaggttggtcaggctagtgtgttgtgtgttgtcagattggctagctcgacggtttgaccggctagctccagattagagtaggttttgggttatttatt

SEQ ID NO: 21512 - DNA, 2599 bp, Oryza sativa
ctacgcacaggatatatcatagctatgccacattacaggaatgataactagtaaatcaacacgatatagttagctctgtgctgcctccctttttcagatgcagcagtttgtaaatcttcactccaatgctccttttgtttcttgatacctcccaattccatatatgtaactacgtacagaactacacacatgttaagcatctggtctcacggtgaaaaatacatatgggagaatattaattttcgtgtcctcttcaactttcttatccctaacaattttcatgtagaggaaatgtgaacactatcgtgggagaagatcacacttgccctttttatctctcttcctgcctctccctcatctggtctctccttttatccgagcactgtaacatatatatacctataccttgtcaatactactgtatttactcccagataaagctgttctattgagcttgaatgcaaatagttgagaggacaatgctactatgcactcctcactgattgcaccaaaatttcattttgttttctgtaaacaattaaaatttctaggtttgaagtgttctcatggtacactagtacaaaaccagtcaactagtcatccgtaacgggtctgaaccctcatctttatcggcaaagtgcctcttgtggtgacgggttcagcaatgaggcctcagttcgtgcctcctgcggtgtctctgtgatggggttttttccggcccatcagaggtgagtacctttgtgatgggtcgctgtctgtcgttatagatggagtgatttagatgtccggttctgtactagtgacaattatatcatcttgatgcaattgactgacataaaaaacaataaaatttatatgaagttaacacggcaacatgaggatcagtctgcatcataataatcaaattaagccaatctgaatcgttcatcacaatgccatgagaggtcccctggaatagtcacatgttgtttacatgcgctcaatatctttcaaaaataaatgtcataaaaatagcacggaatatcttttcaaaagaaatgtcacaaaatcatgcactgacattactatcatcgcataaaaacaacatgaaatccaaatgctcatatcatcaaaagaaaaaaaatgctttttctattttaattcacaagtatattaacatatcgaaaaaataaatctatgaacaaattggtcatttcacaaaaaaaaatttatttggtcttgatcttttcattaaaaaaagtttgatacaatctaattagaggcaaatctttcaagtggggttggcgcctcaactagccccaacagtcggtctgccattagaaatgtggaaaaaatatatcaaatgtcaagaatagtactgtctcaattttaacacagaagagaacaattggtctacttttattagcaaacaactcatcagaatgttgtaataatggcaattatgggaacaatctatcatgacatgtttcatgagtcaacaaaatcactgcaatttttcgaaaacttccctgctcaggcagcaagggacttcgactcattgcaaaagaggactgttgggcttcactgaaaagtctgaagacaactcttaaccagtaaatctcaacgatgtagttagctccatgccctagttttattcctgaaacctctcaatcccatatatgtgtaactgcacgcatgttaagcatctggtttctcattgataaaatgctatgggagagtatttctttgtcctcttaactttctgaattccctaataatttacatgtagaactgtatactctcctttggctttttttttatctctgttccaacctctccctcaatggcctcgttttatatgagcaaactaacatatatcctgctaatcttactgtatttactgccagaaaaagctgtactatggagcttaaatgcatgtagtatggagcacaatgctacaacactctcattgaaagcaccaaaatttcattttgtttttgttaaaaataaatgaatgtatccaactaacatggaaggtggaacatcaatctacatcataattgttaagtactttgaggattttaactattgatccaacccgtgaccccccgtgtaccccttgcatgggtggctcggggatgaaaaccctagttgtcgccgcgacgccggcccctccaccctgtccttcgtctccctgtgctagagcaagctgacagccaaccatgtgatgagcattgttaaaaaacgattttacagataaccccctttcatttcgcaggtggacatttgtgataagcataaattaccttagaaaaatttgaagaaacatttgttcaaatgactagacttctctgtcaactttaagcaatgctttcagtcaaaaactttaagcaatgcttgcatgtttgaagagcactataggacatattacatatattgctctccaacttgatttattgatcctaattatttaattcatgtgctacttttggaacagctgccctgcactccgaaattcttttgtaaggaaatttacttgcatttcattgaggtgaataccaacaatcaatgagtgatgttttgtctatttctaggtggagattggatctcttactcccaa

SEQ ID NO: 21513 - DNA, 2209 bp, Oryza sativa
aattcaaaagtgaaatatttcatcgtggcactccttttattctcaatgcctcctaatcccatattcgtccctaccaattaccatgaacatgcactgaatctatctcaaacagctggtttgtgctcatgaaatgtgcttttctactccctttgagctctcttaagctctacttcacatcaggagacgtgaaaactagcacatatattttgattgcacacttaattttctcttgtgtgagagagccttgcttgccttcttatctctcttgctgagcaaaaagtaacatgcccacttgagcatggatatatgcatgcattaatgaagctattaagtccattatggatgaatttataattgcattgtataaataaaaaagttccatatttatgattggtctcaaggaaataacaacatatataatttcttgaaggattttgttgtcgggtacattgagtaagagaccggggacctaagcctcggggcacctagactgtggcctgaggtctaggactggaggctcatggggatatacatttttccaccatgtaaccaccatgcaaagtcatattctccgggtaggctgttccaggccttgggccagtcgttctgggtccgtccctagttagaaaccctggattatggaggattgcctaacggttggggaggcaaaaagtgaactgtgcctaaacttttaatataagcgcataacatttacacgattagtgaaacaacaatcttattagaatttgagataaccgaatcgaaatacaatactcaatttaatatgaacagagaatacatttggaaaagaaggaaataaaggggagagactatatcaaatgctgaaaacaattctgtctcaattttctattacacgggagaaaaaaatacattttgtttcctatgataagcagcaattaatttatcagtaagttgtaatagtaattatgggaaaacacaatcatgtcagtctgacatgttccagaacaatccactgaagcagcagggaaaaccaatgacgagatgtgttcgcttcgttgtaatacaagagatagcagaggaatgatgactactaatcaccacgatacaattaactccatgctgcctccttttcttcgctaccaagctcaaatcttcactcctgtgctcctttttgttactgaaacctcccaatcccatatatatatatatatatatatatatatatatatatatatatatatattaaatttgtttggtgctccatggtgcccgggcaccattgttgaaattgagtatataaccaattcaaatgagtatgaaactttttcaattatttaggtattaacattaactactttactaactacttcaaagcaagtttgaactgaatttgaacttgtttttgttagattttgattctaggtatatagcatccatacatataattagttaggtatgtaatcatgaattgtgaaataaagttaaatttgagttgttttgttgatagatatatgtatgaatcgaattcttataactaggtatatactcacaatttaaaaattttgaaaaatttgagtaattttgtgcatttgaaaccatggtgcccgggcaccatggtgccccatatgagtgtcctatatatatatatatatatatatatatatatatatatatatatatataactacacacatgttaagcatctggtctctcgagtgataagtactttctgatccataataattattaacatgtagaagaaacgtaactactgttgtgggagagatcacatttcccttttttttatctctcttcctgcttctccctcgatctggtctctcgttttatccgagcatactgacacatactcccagataaagctgtgccattgagcttgaatgcatgtagttgagaggacaatgctacttcactcctcgccagtggcggagccagaaaatctacacgcgtagggctgaactaacgagcgttcaaatatttttagaaattacatggtatttttcaagattataatggggatcatgaagctaggcatggggctcaagccctagctgccccatgcctgtatccgccgcccctgctcctcactgaaaccaccaaaaatttcattttatatttactaaacaattaaaatttctaggaagtaagtgttctcggggcaattgtatcacccgacgtatgtgactgagatcaattaagccaatctgaa

SEQ ID NO: 21514 - DNA, 472 bp, Oryza sativa
ctaagcatatacaacaaaaatagaggggggtcaacttgaagaaaccaaaccttgtcaaggttgaatgtggccaatgcaacttccacgttcttgcagactaggtcatgatgtagccaaaacttgaaacgccggtgacaaagcgcaatgtaggcatcattgcataaccttttaggctctggctgctgttgatgtcgcaactcgaagtgacgcttgcgaaacaacaaggaaatcaaggtgacatcgtcagagcagagcctgtcaccgtgctgcaacgcatgcagatatacaaacccaagcttagccaggttgtcaggtgatgcgagaagctcttgctgcgcaagcggcgctgggtggaaagcagcagcagccgcagcagcataagcttcgtggacaccggcagacgggtaaccgatcttcttgatgcctcagctctgaaacacaaacatccaattccccacctgcagtggcaagt

SEQ ID NO: 21515 - DNA, 644 bp, Oryza sativa
cgccgccgggaattggcccctcgtgacctcgtcgccgttttccccttctcccgccgccggttgccgccgccgcgattcgccgccgtcaagcttcctccggcgaatccgagccgttggctcgtctcccctcgtcacgtgcaaccacccggtgtgctcgcttttgcctgtatcgccgtggttcgctccgccgctcgccgccgtcgtccaccgtccgttccggccggcgtcgtcgtctacctcccgccggcccgcgtggcagccacgtaggcgccacgtcggcaccagctcagccaagaccgggtcgagccgaccccagttagcccctccccgtgcgcgcgttccaccgcgagccgtgaggctgcgcgtgggcccgctgcatccgcgtccaccgcgaaccgcgcacgtgcaccgcgtccttcccccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccggcccgttaagcccggccgagccgccctttctctcgggccgctccctagccacccg

SEQ ID NO: 21516 - DNA, 748 bp, Oryza sativa
tgcgcccccaccacccccactagagaatttttaagtagtagagatatgtctccaccacttcttagtttcctttctgccaacccatcctgacccaccacttctcagtcggcccgccactattgcgtccacctcgtcgatgaagacgatggctgtgtcctgtccctggcgagccggaactagccagtcaggcaccatactcggcccattgtaccatgcaagcctggtgctgttcatgccgaagaatgcctaccgaggtctcgcacacgatgaccttggcccgcatgctcttcccggcgcctggtggtccatgcaggagcactgggtgtgtcagcggcagcttgacgccctcccggagctcctgcttctgcgcctcgcaaccattgatgtcgtcgtacatgacgcccggcttgtcggtgtccgccatgatcggaaccgtggtgccgagcagccggcgatgtcggagggaaccacgccgacgagtgcgagcgatagacggtgcagcttgacattcaccgagggcttgaggaggtcgtggtggagagaaatgggaaaaaaagagaagacgatgaatctgacaggtgggcccacgtgcagatgaggaagaagactgaaaacatgacgtcgatagtatggttcccattttgtaaaatttaagtggcacggttacgaataaatgaattataatgatatttatctgaatagacacatttgtaatgacacggatcaaattaacccttttcagtttgag

SEQ ID NO: 21517 - DNA, 1251 bp, Oryza sativa
tggtaatggagtcattgtcagattgagttgacgtgcttcatgatgattgccacgtacggatcgagtccgaagaaggcagttgtaactattaattaggaatagtttgttagtttcctttttatccttaggaaagtgtgtttagtgtccgattatgactttatgttttccttttatctttaggaaagtttctttcttgtcctacaaggactagtatctacccatgggtataaatatgtacacccgtggtcattgtaatctatcgctacgatcaatacaattcggcgcatcgccaccctttttacttctacttttgtttttacgttccggcagaacttggcacccgacgcggggctgcatcgtcttcgatctccggcgaagggataagtctaatgttccaccggtccaggcaattgtatcgtctacgtcggcatcgttcaaggctgcatcagtacattcgacctcttggattactctggtttggataatatatttgcctagctatttatcatatgtctatgttaatctagtcctagcatctcaatttagctctatcggctgtctctcgctttagggtttctgccggtatcggctaaatcgccttgctagattagattagcctaggcatctaccaccctgaaaatcagtcaacggcttgattgtctagatattgtgtttcttttcatacttagtgctgcatcagttaagtttgatctactaagtcgtgcttagaaccataatctctagcctgcgtcttgattgccaataagggtttcatcggggtttcagctaatgagttatctggacgttgtatcggcttacaaggattgcatacatattggatttagccgatcgcaacaaaggttttactgtttaatctaatcttgtggattttatgatatcggaccaccagccgatgtatgctttaaccttcagatcagtgcttattatatcttgttctagccaattggtttctactcgactatattgttattacatcatcaacagccgattgcatttatatcattatctacattggacatatagccgattgcttaaaccctatcactatcggctggtatcggcgtcggctggaatcactacatcggcttgtcagccgatcggctgttttatctgttgtttacatatattgtcagttgcaggatcaaactgactggcacacccgcatctcatcaatctttggacctgcacaggagttaatcagatctcccaggctggtgttttcgatttttt

SEQ ID NO: 21518 - DNA, 412 bp, Oryza sativa
gaaaaatcgtgttttggttgagatggctagaacgatgttggatgaatataaaactcctagaaaattttgggctgaggcaattaacactgcttgttatatttcaaatcaagttttcttgagatctaaacttggaaaaacttcttatgaacttcgatttgggcatcaacccaaagtttcacatttgcgtgtttttggttgtaactgctttgtcttgaaatctggaaatttgtataagtttgaggcatgttctaccgatggattgtttcttggttaccccgcacatactcgtggctatcgtgtacttattttggggactaacaaaattgtggagacttccaaagtttcttttgatgaggctagtccaggtactagacccgatatttcaggtacactatcacaagttcagggggag

SEQ ID NO: 21519 - DNA, 703 bp, Oryza sativa
atagtcattcaaagcttctccagtttcatctcaaatttaatgtactcctttttaaaaagatctcgacgaagctctttaatgttatttgttccttgatgaaaattgctcaaagcaacccaaatctcatgagtagtttgaagatgagcaacacgatcagaatccgaacgagaaataccactcaaaagaatgttgcgagctttgcaattttgttcaaaaacagttttttcagcagcagtattaatagcttcaagaatcacataagcatgagaaacttttctccaaatatcataatcttcagccataatataagattgcatcctactacaccaatgagaaaaatccgttccatcgaaaacatggggcttagttgaaaacctagcgggagtagccatggcaaaaactctagatcaataaaaatccaaagaagaaaacaaggctctgataccacttgtaggatcgaatcacaagaactaagccaaccagaggggggtgaatggttggtatacccaaaaactgaaaacttttagcggaaataaatgttaccctcaaaattgacggatcgcggtctgaccgagattgatctgccggtctgaccgagtggatgccgccggtctgaccggtgttgaatctccggtctgaccgccgagatcgcctgccgcgcctgtcgccgccgccggtctgaccgccggtgagttgccggtta

SEQ ID NO: 21520 - DNA, 2139 bp, Oryza sativa
tcctgcagccctgtgaaagaagcacatgaggagcccaaatcactacacggtggccgctaatgcgcgaccagtcgcgcgtcccccggtgcgcgcggcgcctcagctacagtactactactagtagtactagtactactactagtactagtactactactactagtagtatgtattactattactagtctacatatgtatatatatgcgtatacaaactttacatacgcgtatacaaactttgtatacacgtatacaaactttatatatgtgtatacaaactttgttatatgtataaaattggtatatgtacatttaaaaacaaaaaaaatacatgtatataaagttttatacacgtatacaaactttgtatacgtacccgaagtgtaaaaaaccagaaagaaaaaaacgaaacagaaaaccgcaaaaaagggaaaagagaaaacaaaaaaaaaaggaaaatccagcgacgtgtcagcccctcacctctccgcggggccctctcgcacgcgccacgtgtccaccgggggggggggggagtgggttgcgcattagcaatttcgtcactacacacataaactccatccgccacccctaatagcagcgatctgcagctcccagatacccatccaaatcacctccattccaggacgttcaatggaactcgggcacaaaaaagtcgacgaatccttcccttgtcagccaattcgacgcggcagatcgataggccatcggtgacaagttgaatggccacggatatttttgtcgttggtgcagcgatgggacagaatggctgcccggtggcgcgacgagattaatttgaagatgatttgttctggcgttcttgattgataaagggttgcattatgtctataaaaatgcatcctctcatgaataaagcacgttactttggccgtacttgattgagaaagggttgcatcctgtctataaaaatgcatggtctcatcattaagtcagatctactaatgggggttaatattattttgaaggttcttttttatttaaaatactaccaggcctagcctagaagttatatatcaaaagaaagagtatttacaacattgtacaggagaacaaagaaagaaagccttaaattacaagaagttgtaaccagctgaggacagaagagctaaggacttcattcatccacaaacatgtaagagaatctcatttttaaaagcaacaaatcaactatcttcacttggtagcacattatcaaaaaccttcgtatttctttgcctccatatatgcctttactgtaggatcgaatcacaagaactaagccaaccagaaggggggtgaatggttgatatacccaaaaaccaaaacttttagcggaaataaaagttaccctcgaattcgacggatcgcggtctgaccgagatagtcctgccggtctgaccgagtggaagccactggtctgaccgaggttgaaactccggtctgaccgccgagatcgcctgtcgcgcctgtcgccgccgccggtctgaccgctgtgctcccaccagtctgaccgccgctatgccgccggtctgaccgccggtgagttgccggtaagaccgccgaaacccggtgaaacacaaatcgaagaactctcaaagtggatgacgactttattgattctctctgtgtttacaaagtgtaccaacagcgctccttacaaaaatttcgactaaacttgaaaccctaactcaaaactcaactctattgctctgaaaagcgataccgggaagcctcacgctccccctctatttatacatgaggtaggcagcataaagccacgaaccaaactcatactaagagttctaaacactttaggaaaccctctagtacaagaaagaaactttacataaccaatcgtaccaaatttggatccttccaaatttgactccgcatcccatacgcacacaataacttcatcgtatgcgatatggaatctccatcaaccacgtgcatcaactctagccttagtatcccgcatgatatctgaccaccacggacatcgtcttaccaccaagccgactcccggtccatcaccgcaaatactctcccgaggcatcgagtcacctacacatgaaacaaataaagaaaccatattccgagaccaagctatccccaact

SEQ ID NO: 21521 - DNA, 653 bp, Oryza sativa
cgtggtttccggcggcccgctcgggcagcggcgaggtggaaggagggcggtgggggtggtgcggtggtggcggctgggtcgcctcccgtgtcgcccctaccctgggagtgacgcgggggcaaagggtttggcctagcccccgagagaggttttcgcagtgaggcttccttgacgacatctccagtgagaaaaacgatgatgaacaccgacatcgccatccgtcgagatctcaaggagaaccaagacaataggttttctcctggtagcccacctgaggaagaggggtggctcgacaatgccccaaagatggaaaacaatgcctaaaacaccattgttgtcgacctggcaagaccaagctgggctttactatgtcgctcggtccatgaagacctgaagaaaaagctccaaagctccaccacctaccatcctctatcggtacatggtcaccactgtactgacgccctccaccagatagcctcaccgacctctctttcgtcggccctccgcgccatcgaccggggcggcctccctgccatcgcccgaaccaacctcctggagcaaccagcatcagccttcctgaaccactgacgccacctgcgtcgtgctagcctcccttcgttccccgccggatgcccctcgtcagtcagcctcag

SEQ ID NO: 21522 - DNA, 846 bp, Oryza sativa
caggcgtcgttatagaagtccgagtcccatgtcttcgccaattatgagacccaacctacatggcaatggatttgggccttggaatggcatacaccaagaggtatgtataatgaattaattactgaaaagtgcaaaaggaaaacaagcttttaattactacaagaatcttcttgtctatacatttactcattgttttcaacttctgattctgaagaaattttcttcaattgtatatagaaggtcatcaaaactctgtaccattgattcttatgttctttggctggcgtacattaggttgtgtctttgtgagcaatactaataagatttgtttatatgacagagattaggctttcctcctcctcctcctcctgggacaagtatggactggcaaggcgcaccgccaagtcatggctcttatattgtcaagaagattgtacgcatggaggttccagttgatgcttaccctaatgtatgtgttcctcttatgcgatttatcatccagcagataaaatgtcttgtttttaatgtctgctattttcgctttgctccagttcaatttcgtgggacgtattctaggaccgaggggtaattctctaaagcgggttgaagcatcaactggttgtcgtgttttcattagagggaagggttctatcaaagatgctgataaggtaacaaacgtttgtaaatgttaattactttacatttatatactcatataacatgcgttatataaattaaaactaagtattacagctagctaggatgataaacttttttgttatgtttaatttaatatcctttgtagaaatcttggaaatccttcattggactcttccctgattagta

SEQ ID NO: 21523 - DNA, 660 bp, Oryza sativa
cctgcagccccaacaatccgatgtgacagttactgaatcctaagttctcatcacctacatgctaggctttatgcacctaggaaccaactctagcaggtggatgcaacatccatacttgtagacgtagagaaagaccacactactagaaaaacgatttttcatggcattggtttataattttcgctggcggagaaatgccaaaactaccagcaaaattgtaacgagggggtaaaggacaccgaccgccagcgaaaatggatcttcgctggcggtcgcattataccagccgccagcgaagatatgtctattttcgctgatggtcacttaggtgcgccgccagcaaagatagataattttcgctggcggttgtgtcatacagaccggtagggaaaatacaattattttttctggcggcccacttaagcaaccgccagattttcgctggcggtagaaggaccgcttgcatagatggaccaccatctattaatattgaccacgcggcccaccaccaccaccaccagtccaccacccacccgccccctctctccagctcccctcccttctctccctctctcctccctctcttctccaccgacgactacgctaggcgggtgcgcggcggcgacggtaggcgggtgggcgacggtggcgggaggtggc

SEQ ID NO: 21524 - DNA, 2538 bp, Oryza sativa
cccgacacctgggtcggtgcttgcgaattaaatgaatttccaaaaccgcggaccggggaacgtaccgggtgtacggttttccgctcttgcacttaaagaccgtttccttggaatttcatccaaacataagacaagtacgaccacatgggtggaatgggacacccctggctgagtaactagcttatcaggggagccttgatgccgagagacatgtggattcgccggggtggtgttggggaggacccctgggcttcctggcacagtatggtctgggacctaacctgttgttggtctgggacccctctcgtcggcatatggtaaacctgtgtcggctttagaaatgccttgtaatgaaagcttggaggtctcccaacgtggctgatccccacgggctgggtgatccgggttagtaatgtcgtgtgggtaaagtgtaccccctctgcagaggttaacaaactgttcgataagccgtgcccacggtcatgggcggatgtgaggtgattcctagcgtagttttatttgactactgcttgtgaaattgctgttgtggaaaggggttcgatgtttggaaaatctgcagctgatgggatcagctacgcccgggtggccgtttggaagttgttggcccgggtggccgtttgaaaagctgttggccgggtgccaaccttgtttcaaaatctaaagactaatacattgcacatactccgaccggacgagacgcactgtctcatccgtgtcgtttaagaagcactcacttagttgtttcagaaaagagttcaaataaaatcaattgcaaaaacacccgcctcttcttgaagcctgcattaaacacttatataccctggtttgctgagtactcttcgactcacccttgctctatataaataatcccccccaaatgcttaagaagatgaagcggatcctgctgatgaggagttcttccaggagcaagccggctacgatgagttttagggtttcggcctagttcccaagtcgcgcctgtgttgtttagcctgagtcctggcttccgtttcccttttgtaatgcagttgtgagctcgggatctgtccgcagcccaacatgactgtactcctactctataataaagagacctctgttgctgtgatattctatcttcctgtgataccagcactgttttctaggactggtatcgattaacaggttaatttggagcgtcacggtttagttccagtcgggactagttcggggcgtgacatttagctagggtgaacttgactgtgagaattcgcttggatatatttttctttgagaaaatcatgagctataattaggagtctgactttcatctgaaattagtaagtgagtttttttaaagagatttcttatacgacttcttttgtatttctaaaagtaaacgaacttaaaatctgattcaacacggataatgtaccaaaatctcggcaaaaacatcttcaatttacacacagacacaaagtattatgcatgttataccgcaagatttatattttagagtactttaatgtgatgctaattttatatttgtccgaaacataatatgaaataaattaatgatcaagtatgttattgaagaccgtatagaaaaaatataggccttctaatttgggacgcagggagaatctgatttcaaggttttactgcagtgtatatatgtattgaagtttatggaactatggagcctaagactgagaggtttgaatgggttagcacactgggacaaggctgcaaacttcttcagattacgcctagcttggggaaagcctgtagatcatcgtgtaataccctgtgttctagagaatggttggacgaattcgagggcgaatttaattaaagggggaagaatgtaatgccccgagtttccaattaatatgtttcgtggaatattagaataaacgcacaaaagttcaatttttaaaccgttgtttgaataggcgatcaggaaatatttcgtggaatattagaacaaacgcacaaaagttaaatttttaaaccgttgtttgaataggcgatcaggaaccgcggatgcgtagagctcgccgagtagtgcaaaatagacaataagtttatagtaatcggtgatcgaattaatatgggccattcgatcttcatcaggatatctattaaaccaactgaaaaaaaacaaaaaaaaaagaaaaggggaagagatcgatagcccagcagctgctacaagccctagccgccatcacccaaatcgctgctgccgtcgcgatttgttcttcactactgcatttttcagccatttaagttactgatgtacatccggatgcctcctaaacctactgcatgatgcacacccaaaaggtcatatacatgacgaggtgtaaattcacatttgagtgagcaacaggagaatatatgtttcattcggaggagtcctctggaccagaaatggtactggcaaacaagcgacttatattatatatatagtcctcaaagctggatacatatggtgtcacaacccatttattcgattacaagggagacatacatcgagca

SEQ ID NO: 21525 - DNA, 1252 bp, Oryza sativa
  unsure (1)..(1252): unsure at all n locations
tgtcctcccacagctcctgcggctctgcccgcactcccagtggcccgcgctcccccagctcgcgtgcgccgtactcaccagtgtactccccctacccacacccagttagcccctcctacacccccggacacaccccagttgcttcctcccgccgtggcccacgctttatccgcaccgcgcggaagcgtgttgttggttcttccaccgtgttccgtttccactacccagctcccccaccgccagcggcccgtgctgctgtcggccctcgacaggttccgccggtcccttcgcgtcagccgatcgacatttcttcgactgaggagccgactacaggaggcagccaggccgacgaggagtagaggaggcagtctacagcagccgcccgtgtgttaggcccttttgttccgccgccaactctttcggagtcgtggcaaggtagtgcgtgcgtgtgtttgttgtgggtgttgttcggtagtctggttctcctaggtggtgtgcgcacagtcaagctcggcgtagctctgtgacttgtccacacccgttgtatcaggtgtttttatgatttgaaaaatccagtttatgcttagtgtgcgctatctgagtggctatttacgttgctccttgccctcctaagtgcttatttgattcttacnccgccctcttctgggagtttagatggctagccgcccccgccgtgcagctcgtgcaccagcccgctttggttttgaagatggtagagccgagccagaagcaaatcatgagcagtctcaccacagcaaccgttcgcaccgtactgcttcccgcaatgcagaagttgagcaaccccgccgcagcaaccgctcgcatcgcacggcttcctgtgatgtagagatggaacagtctcaccgctctcaccgcactgccagtcacaattctggagaagaacgcctcccttccccacctcatgtggaaaacaacatgcagcacttaatggcagtttagacacaaatcttgcaaggattagccgcagccgtagccggttttcagcatactgcgcatggaaatggccaccgtcacatgagcaacaatagatccaagctgacagactttctgaggtctcgtccgccagagttctctcagaccgtcgagcccgtcgaggctgacgattggctgaaagatgtggatagaaaactcaacttggtgcagtgtactccggttgagaagacgctctatgcctctcaccagctaagaggacctgctgcagattggtggg

SEQ ID NO: 21526 - DNA, 1721 bp, Oryza sativa
tatagctatttttggttatgcatatggacaagtatttgtataggttcatagctataaatagctatattttgggacggagggagtaggataaactttgcattttcgttaataactttattttttgtctgaatagctaaccaacccatacactactacactagtaccgaatcttttgtggagtccaataaatattgtatctttatcatttaacacataactttcttctttttatttatggttgcagctatcataccagattgttgactcctttgtttggcttggtattcgggatattataaatgatcttcggaaaaggaagttgaagttaagaccagttacgtacctaagtagcgcacatgcttattcaaatgatattcctcatgcatatatctggagtccttaccttgtacccaaaccaaagggtatgtatctcttggctctttattgcactaactaaacacattctctcactagttagctcatcatgtttgttggcacagccataaatatggtgattgtatgatgtagctgcaagcatgactactaaagtatccaatatgtatttaattatcaaaaggaaaaagtccattttgctcactcgaactatttcgctggggcacttaaccctctaaactattttgtctgctcactttaccccatgaaccactaaaacgggtcactttttctatcttatggaagctctgaaaaaatattttgaagggagtaaaatggacctttcctttctcacaaattgtctgtatattatatgtttatatttatattccatcgtaatttccatggaattaacggttatgaatgagattaaaaatatgatgttctcttcctttacagactggggacccaaaattgacgttgttgggttttgcttcctcgatcttgcttcaaattataaacctcctgaaccccttctcaaatggcttgagagtggtgaaaagcctatttacataggttttggcagccttgtaagtttagcatattttcttgtgttttttttctatcatgtccctagtctctacatatgattattctataagttcaagtatgtttccttattgtcttcatgacaacgttagccctttattgttgggtcaatttcatccgtttactttgtccttttttgtcgtacaaggtgaatggataatagatttggcagatattttatatggagctgattcaatacacttcttaagcaaacaatcatattgacgtttgtgcaattgccccatttattaggaccttgataaatttgtatctagttgctttccttttttttttaaatcctgaatttacttgtctaggaaattgaaatgtagtcatgttttctcaatatgcctatattgcgcccaacaacatatggcccacatgtcgacctgccactgctactgttcattaataaggaatattttctcactttccatctcctttgctaatccactagctataaagcaaggtctaaagttaaattagataagctagaagcctagaacaaatatgtttaaaaccctgggaaaagctaaagaagactggtctggagctcaacaaatacatagctgtgaatcctgaagcccaacctgagtgctgaccatcagcatgttgcgcacagtatagcaatattgcattctcagtacaaaaacaaaataaaaacatagcagagtccaccaatacatgtataagaagcttataaccagagtctataacat

SEQ ID NO: 21527 - DNA, 13212 bp, Oryza sativa
gaccaccgtgtattggcctggttagaccgcagcttgagggccggtttgaccgacggcatgtggtccgtcagaccggcagagtctgagcccgagtttgttttcgtcgggtcttgggattccttattcgggaggctatgtttcgggtttcctttggtttctatcctgagttggacgtggaggaggacctgtcggaggcaagaccaacccctctataagggataaggtcggttcaattgaggacacaatctacacacaagccaatttagccaattgaatcgctttttcaatatttcaatctagttcgcccatctttgtcgatttgcgccgtaaatcgtccgccttcgctgcgagagtgcgaaatcctttgtaggtttgtcctgtaaaccttccgtttgcccacgagacaggtagttatctattgtttcatctaaatcggctccgctagccggtttaatctatcaaaacccatcttagtctagctttttgctagattagggtggttggcgactccttatcaccgcaaggcgtctaggtgtccgatcgtgcttgtctacttgtcaaaaaaagttgccaacacccacttaataggatggtagccaaatattggtggggcgtagaagagtagtaaggtctctggtggtaccaaggaaacacttttttttcccagtgcaaatcagggagtcttgggtacttccagtgggaaataagaaatttctgttgttttgagcttccttacgtattagttgctaagattttctctgctttcgtttataactgatgactcagtaatttcagccaattccagaaccagataagttgacaagaatcatagtggaagcacttgaaattactggacagagaggtatcattaacaagggttggggtggccttggaaattgtaagtataaagtcgtaacagttctttggatttgacatattaacttgccatcattattcatgctctctaacatttcttattatgccattttgcagtagaggaacctaaggaatttgtatatgtaatagataacattccacatgactggctttttttgcagtgcaaggctgtggtaaggctttctgctatttcctgattgttatatgccgacaatctagtatcgcgactgaacatgctgcaatgcttatctagacaaactgggtagaaaactgattatgactagctttaaattcaccggagatttatgttaagcttgaagtcactgattaacacgattgcatacatactacataatcagggggggttctggacttctggtattctgatttagcagttttacttgactgcatgctaaataccttgtattttcatgcaccgccaacagatagaatcatagaagtcatgcgtgctgtgacagtggaggattttttttttttttacataaaggggagatttgattaaaacatgagttgtaactgtggaagacaatgcttgatttttcttattaattttctaatttactctgataatagttgtagccttatttactttgaaacctactttattgagatatgaacacttttgcactacttcaagttttgagtatgatattgtttttgtttcaacagtgaaaatataacgtgacattattttgttcagtcattttgcatagaaaagaataagactgcattcttttttgttgactgctgttgtattcccttttcccttgtcaggtacaccatggtggtgctgggacaacagctgccagtcttaaggctgcggtactctctctctctctctctctctctctctctctctctctgtttgtgtttgtatgtgtattgtggcacactgctaaatgtctccatttctaaaatttgtagtgccccactaccatcgtaccattctttggagatcaattcttttggggcaacatggtgcatgctagaggattgggagccccacctgtccctgtggagcaattacaattgcatctactggttgatgcaattaaatttatgatggatccaaaggtatgttgcaaattttgctagttgctgattatttgtatttttatcgcaagttattcactagtgtcaaaattgtcaagtagcaattatgccacatatagaaaaaaacaacaaaggtatttttagttgtacgttctgttgccaaaaaatggaacttatgatctctttttttttggggggcttccattagaagtctagtacttttattgatgtcattgttaaatcaaattttatgtgtttctttacttgataaacaatttcctacaattgttttggtttatgttctctacgcaaccaactcagtactgttcaccatttgtcattttttgggttaataatcatgtgaacaactcgaaagtgaaaatcatttacctgtgagctgggtacttgcattcttgtctgtgaaagagtaggaactcagaacattcttgtctatgaatgcttcttatcctacattcagaacattcactatcttttcatggttgaattttatacatgcaaaaatttgatcattcaacattctatattggttgcatcactgataagatgattaaaaaaattatcaactctagtgcagtggtgttgtgtgaacaaagttactgtttcttatagtgaagttgctatcttaccatcagaaatcctgatatgttcaggtacagtagtacagcaaacagagttgtggctttgtgaggactccctatgcggaccccttgaacagtttacaaaagtacctgtgattcttttcaactagcactcaagtattatttttagaaatttagaagtagctagatataggcatcatacccacatgaacttgagtctttgctttttaacctgtaattctggaaaaactaattgaagaaaatgtcttcttgattatagcttgttgaaaacactaacaagaaatgacaaggaactagggaaaatatagcttataatactttcttaacaagggcaaggttgcacacttttcaatttgagttgtggtgttttgatcaatgccaggtgaaggagagagctgttgagctagcaaaagcaattgaatcggaagatggcgttgacggggcagtgaaagcatttttgaaacatctcccacagcccaggagccttgagaagccgcagcctgcaccgccatcgtcaaccttcatgcagccctttctcctccccgtaaagagatgttttggcatcgccacatagtccgttgctctcaagcaatcgtgttaatattttggcaacacaaccaacaaccatgttaaaagagaaatgctctcctatagtttttgttcgtcacagtatagaatgagcggtctcctgcagttttcttcaaacgtggagagattgttcttaccttaatttaacacctgttcagctgttatagcttgattcatgattggtttgtatagcagcggtaacgggctcgtttgtttagccttaattgtacagttggcagtcacaaagaatgttgcttggcactgcactgttggaccccttatcttttttttttctttatgttcttgaatgcttttcctggtactaatcatttctgtaactacatgacaccccgtgttgcggcggaacttgtagaaaacaatcaggatgaggtgctttttaaaacaaattaacaagaataattgcacacaacatgttaaggttgtggcttcacgcatgttaaggtattggtttggttgcacaaaacaataagtccctaggggagggagggacttatgtttttgagagaggggctctcccaaacaccccctagagagagaggatttgtacctggaaatgacgaatcaatgcgtccatgtcctctcctgaagagtatttacactggagcagaccaatgtggcataatttgtttacgcacttctcttcctaatttacgctttccccaacacaaagcgtattttcctagctttactcttttcccaggctggtgtgttttcgaacctcctagttcggatctcgtccctcatcaagaaaagaggtaacccgtacatgattaattaattattagcttgataaactagaaaaatagattaatataattttttaagaaactttttataaaatttctaataaaaaatataccatttaacagtttcaaaattgtgcgcgtgaaaaataaaaaaataaaagttataaagggagagtatataacccagccacctacccaaacacacatgcttctatgcatgtttggtgaggcagaatcatcctacgagagagaatttttcccatccaaagttgcaaacagctggtaggtacttaagctggtaagtcacagttaagtgaacgtttgtttccaacttaggccctgtttagttgcggaaaacttttgggtttggttatcaaatcggatatatagacacagtctaataacaaaacaaattatagattccgtcaggaaactgcaaggcgaatttattatgcctaactaatccgtcattagcaaatgtttaatgtagcaccacattgtcaaatcatggcgtaattaggcttaaaagattcgtctcgcaatttacaagcaatatatgtaattggttttttcctacatttaatagtccatgcatgtgtccaaatattcgatgtgacagcgtgaaaatttttattttgtgaactaaacagggccttagcatgctaatggacagcggtgaggtgcatggggctgcctatctaccacttgtgacttgtgtgcgaattagtaggagacttgaccacaataatgtgtctgtcgatcagtccatgatggaatgagcagctttccaacaagcactcaaataaaacccctcaccaacttggcatttccggtccgtgttctccatgctgttttttttcacagccacatgcacgtacgaagatcatcaattgaagtagcacccccatcatgatgacacttgtctcctgttgcaaaggaagccgggaagaaagcagccaaccatgggaatcgatcgaccacaccccactttcacctcttctggtgctggtgtggtggtggtggtggtggtgtcccaagatccgctgcagcgctgttttagtggccaccaacgcggcgcgccatgtggaggaaaggaaagcacatcgaaggtgaactgaaaagcatagcgtattcaggtggtgtactctttttagggcgctatcatgaagtttcagctgagtactgtttttaacgtcaaaaattgtggtagagagtttctctttctcgcggagctcctggttgtggtgttttctggtcggaccgctggtacggtccaatgccaataactatggtttctcgtggaaaagggttttcgctagggggacattggtagttggggcttgaggcccacagcctagatccataatcccattataattctacgaaaatataatatagcttttaaagattactaaggtcatattaggttggtcctaggtttgagttttttctagtttcaccctacttttttcacagagcataactttaataggaagaacttgttgcatgcctaatgactagaggaacttgtagtggatggtgttctcttttgagaatttggaagttcctaactttgttgcacaagaaaaaaaaaaggaagttcctaacttcctaagttctaactttctcttaaattgttgtaaagcagaaattgccctagagtagcatatatgcttgtggttgtcttaactcccaagtgatgtattgcatgagttgttgacaaattaatttagtcatgcactttgtataaatggatgacaatgttttatatgtattagcatgattttcttttaaacaaaggactatgcacaactggattataatataataataaattgttaccagtttatggtgatagctagaggagcagaggtgaatgtgatgaatggtgatgtagctgtgagcaatcaattcctaaggaaaactggccgcttactggtttttgcgaacaaaagtttgaatccaactttttaaattcaaaaacttgttgtaggcggtaattggctgaactgcccttaactatatatccggttcttgtttttgaattcaaaattataaattcaaatcctttggcataactaatgcgtaactttttctagatgtgccttgcaaaatatattagttctccacacataagttgcaagagaatatgttgttcaaatgatttcaaatccaaatttacatttcaaatataatttagattgttttcactactaaaaaaatagtttttacaggcggccaaaaacacttttcacaggcgggggagagaaccgccagtatcctatcgcctgtgaaaataggtgattttcacaggcggttccgcggctcgcctgcgaaaataatttcagggaacaaaaaataaaatccggtgctacccgccagcatcggcatccccctccagccgacggctctccacctccgcccggcgccgctgcccgagggcgaggagagcgctgcctttgccgccactgccgaccggctcccctcttccgtccagatctgggagaggagcggccggtgctgtctgcgccgccaccgccgtcggcccctcctccgccactagcatctaggggaaggaagggataggattggtgcccagagccgccgccgctcctcttggccaccgcctcctcctccttgcgcgcgctgagatgccgacggccgccagctgctcctctccttgcgcgcgccgaccaggccatcggttcctcctcctctgacgtcgctgcggctgtcacaccctgattttcgtttcaggatttataaattatttaataaattattattagaatttatattaaatgttcattaatttacaagagaagttaaatgtggaaaataaaatttcccaaatataaagcatggatggatttaatttttattaaattctccacggttaattatactctctggaattttctcagatttttcggagctcaattcctaattttaatcatacaaagagcagttcagcaattatttaaatattaaattaatcattaaatgatctgattttaatattgttaaatactttgagtgtccaagtattttcaggatttttcttgaaatcatttgagcattggaagtatttttaacaattcaaagatcatctcattgattaatttattaaattggaagtcctttgttgctcccttccggcccagcccaaaaagtctattctacgtctctctcgctacagtgtcgtcttccagctccaggcagagcccgagctgccgtcctgtgcctgttgccgtcgcctcctcctccatcaaatccggtgcatccgttgatccccttccaaaattggttgcaaaaacggattcctctctatctcctctacctaatcccgaagaaacccccatcaaattcgttatatatctcacgaattttggccgtttatattcgggtgaactcggataaatcctaacttctttcaccaaatccatccgttcctgagccgatctcttcagtccaagcctataaatagcaccccctagtcgccctctttcgttttccccatctcccgagctctctcgtcaaccgtagagccgccgccacgtcgtcttagccgccgccgtcgccggccgacgaacagccgcctcgcgccgtcgttttggccgtcgccgccgcctcctctcgccgccttcggctgcgcgtggaagaggggaagctcggccgccccctccccgccgtcgccggtcaccggagagtcgccgccgccgacgaccgactcgccaccgccgcacaagctcgccgccggccgtcatccgtcgtcgttcgtcgcgttggtgagtatcgttgagatcgcgtcgtcgtcctctacgtgtagatgcccttagatagcccagccgacctctctagctccggcgaggtcgccacccatgccgtggctgccgtcgatgacgtcatcgtgacatcatcatcttttctttttccctttttctaatagattaaatcttcggaaaatcataactaaataatcgtagatccgtttcaggtggttcaagttggtaaatttttctaaaatcgagatctacatgttaaaaatatccacatgtactgtttgtgcctgttttttactgttttgttgattttgttctttcgctttagtttccgacgttccggaggagagcgttttcgttgaggaaggttcagaagtgtttgcggaaggtcaaggaaagtcacacagatcccaaacaaccctttgagcatgttgaacccgtttaaaactattgttttatttcaacttatgcattatttttgaatgtcatcgggtggtgaaccttttcccgaataattaatggccgaagatgaccttattttcctatgggttataatctgattagctagaaccttatatattggtttggttcagctaaatgctatatatataattgcttagccatgcttagaaacattagctcattaatgggatgaatcatatatattatattattaattatggttatatttaatggtagctcacgatggttaatcgtgttatgataattaattgataattaaaacttgtcaatggtgggttgtgagcacatggttttgaaggtcgtgctcatggcaattaaggaccggttcgcgagctactgttgtgaaacatttaccgtaccaaccacaagccagcatgtgcaacggctttatcttttgtatagcatgatttattatggtgtgccagactgtgaagcggcgagaagtccgtgggggtcgctggggagtccattgcctctggttttgagaggaagattatgatacaggaacggtgcactgtggtaagttgtgttgtgcagagggtattgtcacagcctctattcgggtactttccagtatcgcgacgcatggtagacatgatgttgaggttgtgtcttgtgggtatagtggtacacctctggccagagtaaaattattcgaatagccgtgcccgcggttatgggcgagttgagcaatgtttttcgtgattagtctcacactactcattaatgttaataatgtgataattaatttgactcctggtttggaatggataattcctggtttggaggttagatctgtacgaccggggttgattgttcaggtttggttgggcctgagcagcatgggtgtgttgtttagtgttgattaaaattgatgattaattactctactgttttacttctcttaaatgtttgctaaatgctgctttcgcaaatgaaccatatattatgccatcctttggtatccttgtgcacttgcatatttgctgtgtggcttgttgagtatgtcatatgctcattcttgcaataatcatcaaacctcggttgaagaaaaaggatccggaaggagatgacgtttggcttataccccagttgagctgcctgtgggagtggagctgaagccatcgctagaccgttattccgttgctgttttcttttcttttgtaagtatgtaacgttattattatgatggatttgtatattaaattgtcagtttgtgtacctcggctgattcctggacgaggattttatgcacaaataagttcggaaattattagtgaatttcagggcgtgacagcggcccccttcctcccaccgctgccatcgccgcacgcgtggccactgccctcccctcgcccccctcagggcagatctaggaggaagtgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaggcgatcctagcggggcttcagctccactccacaggcaaaactcaactggagtctgagccttggtcttctaacttcgtcttcagctcagaagcactacacttctgaaaagagggaataatagcaaggctgagtacaaccaccgtactcagcaagccacaccaatgatgcagacgtgcaaagggatacaaggacggtttgtggctatttgcataaaggcggttgtaaaacattttatttagcaaacagtaaaactgttgaataattaaggtaaattagatctccactgatcaatgctacaccacgttgaacaggcccaaccaacccacctgtactacagtgcattgggtcgatttattaagtgtgagactaatcacgatgaatctggtcgatcgcccataaccgcaggcacggctattcgaatagttttactctggccagaggtgcacaactgtatccacaagacacaacccaccgacatgtcaccgcgtcatcatgtgcccatgacgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccagacaccccggccgacccaactccatcacgcccaccctcgccaccggtgcctaggaaagggtcgagctatacttcagatcaagcagttacccactcccgcttgtggtaagcactgtaagtcttctaggatttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgcaattatcccatcgactgagctaatggtaattaagcatggctaagcataacgttctagctaggtcacataagtaacacaagctagtcgatttatcacccaaggttgacaaaggacagatatcaagtgaacatggcacaagcgagcagaaaggtaaaccctgatcccatgtaattagcaaaacatgcatatttatttgcaaacggtaaaacatttataaattaggatcaacatgctcaagggggaatgtgtgacttgccttgcttcttcactttgatcttctgcactcttttcctcgcgaccgcgatcttccgaaacaacggattctacacgttggcacgcaaaacgaggaaaaacactaataaacaccaaggaaaaagtacataaaaagtaaacaaacatgtagaactcaattttagatgaattttgcaagttgaacggcccaatttggagttcgaatgaattagatatgaattttagaagttttgagccattttaatggatttctacaattattaatgatttattgcgcaattatcaattattttctcaaaggaaaaggcattcgctgacgtcagcaaggggcgccggcgccgacaggcgagccccacacgtcagcgggtcaaggagctcggtgcaccgtggaccgggaccacaaggacggtccaccgccggtccacgggatggacggcctagatcggctcaagccgatcgggcggctgaggagagtggtggctgggcacgggcacagccagggctggcccgaccgaccacagagggcggcggcgcgcagacggccggacaaccggcggcggcggcggtgcaacgcggcgctgggacgggaggcggccggcgaagaggaaaaggaggagggaggcggctcaccgagaggcgcggcgacggagggagcggccgcggagggaggcggcggcgctccttgggtcgacgacgcggagggactcacggcggtggatggcgagggcgaggaggcagacgaggtgcagcacacgacgacgaagccgacaaaggtgacggcaagcggcgaccgcggctatggcggtgatgattgccggccggagacggtgaatggatgtggtggctcgggtgtgtggtgggaaggtggtttcggtggtggcgagggagagaaaaacggtggccgagcttgggcttgtggcgacgaagccggcggtggcggcggagcagtgctgcggcggttctagcgacgggaggcggcggccggcgctcacaaaggcaatggcggcttgggttggcagtggaggtggcagcccggtggtggattgggggagtgtagcggtggacggcgtgcggcgtggagtggtgatgccgacggcatgggttgcgcggcacggcgatggcgctagcagcgacgaggtgcggctggaggcgacgaatgggtcggcggcctcgggtgcacggtgaagaggtggttccgggggtggaggagggaagggaaacggatgccggggtgaagcgtgggacggcgatgccgatggtggcgacggcgctgcgcggagatggcgagagcggcggctagaggcgaccggagctcgccggagagcggcggcgcgcgggagcggcgtggggagagtgggagaaggcgagggaagcgccggcgaggaggggaaacgagagaagggagcccggggatggattttataagctcggggagggaaaaccgttgccgggcgtggcggatttggggcggcaatgaccggcgacgtgggtgacacgtgggcgaagtggagctcgatcccggcacaatttttgggggaaacgtggggagagtgtagaggaggtggatgggaaccgatttcatgcggtttgggcgcgagggcgcgagcggaagaggccggaatcgtgggcgacgtgggcggcaatggcggcgcagcggtttggatgagggaggctggaggtagaggaagggtctgacaagcgggtcccacggccccacttgtcggcctgaggggagggaggaggcgcgcaaggacgcaaagcagacttggggaggggaggcacgctgggccggcggcccgaggagagaaggaaggagggggcggccagcctgagagagggaggaggcgcgcccaggccgcgaggaggcaaaggagacttgggccgaaaccggcccaagggaaagaaggggaatttaaattgttttctttttattttaattgataaaatgaactttgtattattgtaattatttcttgatctccgaaaattcacgggaaattttagagagtattttagggcacaaagaatattgcaaaatattcccggccaatgatttttaagggaaaattttaattctcccaataattcacttgattaaattgctttaacttttatttaatttctagaaaatgcattattaattgatttttaatcccaaacgaaaatcggggcgttacaggaagcgagggaggggagcgtcgccggccaccaccct

SEQ ID NO: 21528 - DNA, 3678 bp, Oryza sativa
ccccccccccccccccgccctcctcgggccagatctgggagggagggaggggccgggagccaccgcccgccgccaccctccgcctctcgccggtagccgccgccctcaccccgcccctcttaggccagatctgggagggagcgagggaggggagcgccgccggccaccgccctccgctgccgcctccatcggtagccgccaccctccgccgctgtcagcgccaggaagaggacttagaaaaaatctagggtatgtagcctctatttatattcactatgtattttcgcaagcggaccacctaagaggtctgtctataaaaatgaagggtatttccgcctacaaaaatgaattttcacaggcgggcagcgggtttcaccccgatttacattttttaggcggctatttggctccgaaggtcatgtccgcctgtgaaaataaatacccaacgtcggtaaaaatgctttttctagtagtgtttcgctggtatatgtgtcggtaaaaataggttattgacccagcgcctgtaaccggccagttcaggatcaacattctgatccatgagtgcgagtcaaggttaatgaaattttagttttccaagtcaaaaagaaaaatgcatatgttttcgcccgtttagtagtatttcttgatggagatttaagttggaagaatggaaattatccgtgtggttaagagcaagtataatagtgagctataagtctactataagcttaggtggaggagagaggtagtgaaaaattaaggatgctgctcttatgcaagagctagcttatcacaagctccaagacaaatctattaaatgcataagtgagagataaagagaggagaagaaaattgtagccaaccttatagctattctattatatatattggctttaagatgggctaatagtaggaagtgggctctattattatccttgctcttacggttatggttagatgaaattagagtctatggtgcaacaatctccaactttattataagcatggatattaactaccctctgacaggagctacgtaatctgggcgtgagagctaattggcacagctgcgttgaccgtgcatgcttgtctcatgcctatggcactgcgttgggcccaataggcatacaagtatatcggtttagctcattagcttatcagtctcgtagcaaaaacttaaattttaaaacctaattttagaactaattttgatgtttttgttatggtagtttatttttaacattgccttttaagtcacacacatataaagagaaattttctttgccaagttcaccagtttctttatacgtcaacggaaagttattatttctttatatgccattggttgaactttttcttaccctatatgccatctatatcaccatcttttatacttgttttgactttagtcaaagtcaaactacttcaagtttgactaagtttataaacaaatataataatatttccattagcaaattagttttattaaattaataattaaatatattttataataaatttatcttggttcaagaaaatcactatttgtttctataaatttggtcaaatttgactttgagtaaagtcaaaacatcttataacctgaaacggagggagtaatagggacacaaaattacaatattacccttttaatccctcgaggggatgtctactcgtttatttgcgtgtcatccaaataattataaaaatatatttttcaataagatagaataatatgtgatatatcgcttcacaaatatgaaactttaaatttcacttttacaaatttttttagaaaaaaaattcaaatttggttatgagcacacgtatactagtttcaattaaatttattgtttttattacaacctgtgaagatcaaatttgaattaatttattgatatatcaaatattaatttatcttatcatttattttttaaatattcataacaattttaatgactgtaataacaaagggacatcccatggatggactagcaaaaatgatagaccaactataaggtgaaaccattatgcttaagtgcgtatgttaataatggctgaacagaagcaattagaagaatatatgagggtagttttattattttgctgaaagattgacaaggtgaaagcactttgaccgcgatagtggcatttaaaggatgaaattttagttcgatggtttataaggaaacagtaacttttcagtggtatataagaaaattcataaactttgagtggcatataatgaattttctcatatataaaatttttactcataaactatttttgtcgctactaagctctaccgctaataatctaactataggcgatacaatatgacttacaggtttgaaatttttgtttaattttgagtttttgaaatattcttaaataaactaaaatattgtaatagagcctttgtaacagaaagttttatttcccccgaaagagaaagttttatttaaaattttaaaaatccgagtaaaatttctaaaaaagtttaatcgtttagctcatactttagaactttcaactcagaaaacttttatagatatttcaatgacactaatgctggcactatttctttacacaagcaatggattgtttctttcttttgcaaccgatgttggataagtctgcttctttgtctactattaatatgaaaaccactgccctagcagtgttcatgctaaaaaaaatatgaaaattacgctatactctcttcagaccattttacaattttttggctacttgcatgctggaaggggcaattaacttggggaaaggattgggggaagcaacactggtgcgatgatggaatcatggacgaatgaccgcacccaataggatttaggctctgtttggggagctttagattctgagaagcagctgtttggtagccagcttctgtgaatctggaaaagctttgaaacccagcttctccagcttcttgcttcttagttcatttttcagaatctgtaactacagattctcagaagctatggattatttggggtagcttctagcagaagcagcttttggaaaaagctgcagctgggagaagctcccccaaacagggccttaaatccttgtgctctcaaaatttatggccatgtttgaaaaaaggaaatgcatagttctgatcctttggaatggtctcgatgcctcctatttcacaggaaataacaaccaaagctaaatgaaaaattcattctgaggaacacctagaggtcttccgactagctccacaaggtggtgggctagctagcctgggttcggagtctcaccccttctatttatttgatattagatcatttcttaattaatattcgcgtttttatgaaaaaattccttctcgctctcccctatgtttcctgtgatccaaaaaaaaaaaaacctcaggtttcactgtgatccaaacacctcatgtttcactgttcctgtgttttgaattgcttagtttttcatttacactcaaccacattcttatgtttcttccctgtccctgtctttttcattttttttagtgcgtgttaagggggtgtattcgtgatcatgtgcgtatggtgtatatatgtcttcaatgtaattaaaaaagagaggaaaatttaggtaaaggagtgtccaaattaatatacaatacataacctttcttactccctccgtcctataatataa

SEQ ID NO: 21529 - DNA, 3831 bp, Oryza sativa
tggaattattgtttatttttttacttactttattatccaaagtactttaagcacaacttttcattttttatatttgcacaaattttttgaataagacgagtggtcaaacagtgcaagcaaaaactcaaaatcccttatattatgggacggatggagtaataagcatatgtggatgtgtatatgttttgaattcctgtgttttaccttttttatagtgtgggtttgtgaagggaagtgtagaggtggccatccaaggtagcctcctgcttgtttgttagccgatggtgggacattggtcggtggctgtacgtcaaaagggtttggagggtggggctagctgctgctatatccacagagacactttggcatgcgagggttgggagattctgagcgaaagcctagtcctttcagggccgacagtgggatgctcttgagcatcgtaaccccgttggggggcactgtcatggtgtctcttctctccatagtggaatcctcaggtgaaaaccacatccttgtttcctagggcaagcaatggcaacgccatcgacatcgtatattcttcctaaagacgtcgcttggtggtacatttccgacctaacttttgtccagactttgtcctcttgtggcatcctaatcgtctcaagttgatcacgttggagcgcctagtgggagagagcggatccattcttctctcttaccctcttccccttcaaccctaagatgtggatggagagaagtgtgttgggtatcgtgccttttgctcccagtaattggtgtgtcatagacgcttagtttgattagccatttttgtttttcctaattagcctcccaggataactttttatattttctcctactatattaatatgaaacctctattgtctcgtacagttcgtttaaaaaaaagaaaatataacctttcttcataatatacataacattacatctgcatgtgtatgtgtgcagcttttttaaaaaaataacaaagagaggtacaccatgccaaggatagaagtggtggatgttatccacagaatatctggtgtctttttcaggtgaatgccttcccacttcctatatcaaaatcccccatcatttgcagcatttgcactccctctccctctctctctctcttcccactaaactctttcaacctggagactgggacaaggtggaggagatcaaggtggcaacccctgcaggtgctgagtgcaggaggtgcatcctccctcccattgtgtgctcctcctgctatgcacctccagcacccagcagctgcagcagccatggctgctcctgctcccccagcaacagctcacctccagcagcagaagcctgcaatggcagcaggcagcaggctcatgggacagcagcagctcctcctcatccagaagagaagaagcctgtgaagagcaacctcaagaaggcaccaccagctgcagttgcagctcaggaagagaagaacagggtgtcgttggtggtgagcaggaaggtgacctggccggatgctcagggcaaggatcttgcccatgtcctggagttccatcccaggtaggcatattgaaagaaaaagcccaagaaaaatgtaatttagtggtaattaaattggattgtttcaaggttcagacaatggtctgacatgaatggctggctgctattttctgaaatatgattctttttaggctcattatggcatataaattcaaagttcatgattgatgctaagttatatactggaactgtttttcttgatagatttgtcttttggattgcatggatcgactaatggtttaactatttaatttttcattgaaagcatattggaggatgggaatctgaaaggagcaacaagatcctgcatttgtgtgattatgtgagctagattgaggtaaaataaatttatatatggagttcgcgcgtatatcccacaaatttgtcagaccgtgtgtggatttaaacaaaactgttacataattatgttttcaatcaaactggagtaaaatggcactacatatattgacctcttaaaattgttttagatctaaagatactggtcacttttgctacaacgctagctagccaactcgcaccaatttttggtcaactaatatagaaagctggcttgttctcttattcgcaactgttatatgacattgatgtaatatcaactgtatgtccagagtatacggaagttgagaactagtaatcgacttccagttttcgaaacatataaatattcaaaacaattaagagcaaagctcctgcttttactataaaaaagttcaaaacaatggtgttcaattatgttctgttcttattctttggtgaatttgtagatcttctgcccttaattagtttcggggaaaaaaattgtgctcttcgattatgtagacaattaatgtcaaaagagtgttcttttcaacacacatagcggtagaaatgaatccgctcagattttgtttgaaattcaagatttacttaaactaaatcagttcgtctaaacttctagtacaaaaacctagtactgtgaacacgtgggctgaaattaatgtactagacgtaggagtacctcagattaatggcccagtgatgatccatcaacatctctctaaggcacagacacagctgctgctagctggtctttgcaaaaccgacaacgagctctcttgtcggagggtcccacgcgccagacagctagatccccttgcccctctcaaacttcaccttcatgtcatccttccatcatcgagaaaaatcaatgatggaatgcctgtaatttcttatgggattgaaagttataaaaatatattgttttatcattgtttttaaaataaatatgaatattagttaggtatgtatgttgcaaaaaaataatcgctttcactttatcatgggctgagaccattgtttattttaaccattcttatctactccaaaaacattcatcaggaaagcttagggcctgttcatttgttatgctattttcaaccttaccaaatttcggtatagttgccaaaaaaatggctacatttactttgctgccaaattttggtaactatataagaaatcctaccaaaattttggcaagtcaatgcaaaaatttggtaaggtattttttggcatcaaagtgaacaggcccttagactatctctatagttaaaaatataagttctaggctactactttctaatttctctgtatcgctagtctaaggccatgtttgattcagattaggattattataatctggattattaagagtaagctgaaacaaccaggtagattattatgatagattattataatctaataatctcctttggaggagattttttcagattattgagtggctaaagactcactacccttagatgcctccaataatctagagaaacaaacaactcacagcttattctatatcagcttattataattcagcttagagtaatctgatttaataatctagattataataatcttaaactgaaacaaacagggcctaaggctctttttatttagcttaaaattattagaatctacagatagcttattataatgtataagctaggttattataatatggcaatccactctaaaggtgctttttttaaattattgggtagctaacagctaacaaacagctaataatccagataatcaaatagctaacagcttattctatgtcggcttattataatccagcttatagtaatatggctcaataatctagattacaataatcttagggcccattggaatttgatttggaggaaaaacatggggattttagaggatttcaatcctataggaaatgtttctatgaagcccctt

SEQ ID NO: 21530 - DNA, 15512 bp, Oryza sativa
  unsure (1)..(15512): unsure at all n locations
tcctccaaatcaaaggggccctcaacttcttggtaactttcctttgagtctatctatctcatccaattcttaggtttttcctacgattcaatcaaacggttattcatgtgtttttcatgcgttttgcaatcaactattttacacttacattcctatcaaaattctacgtttttcatgttttctcaatcctacgattcaaaggtacccttaaactgaaacaatcaggacctaaatctactctctatctctcagctctcatagcaagaggtaagtgtatttgaatttttcacaaaaaaaaaggggcaggagtggtagtggcaaccgccaccagtaccaagtatataaatattattgttgaatttatacggagcatttttttaaagaaatttctccactatttttccattagaatatagcgattatttctaacaaataataccttgactttattaatttgaccggataaagtctaaggtaatagttagaggcaaaaatttgcttttctgtccacatgattaaccatgttgaaatttcagtattcagatgatttgtttgcattgcatcaggtatgtgagcatgagtcaaagcacatctcgcaaggcaaaaggagaaggtactgtttgtctgaatgcatgagctgatctggttctgcatgagaagagccaaaaaagccaaagctttccttgagcaccgtcatcagtgcctgctcttccaattaactgtatgcgtgtgtctcctccgtggtttacatcctggcatgtccaaacaaattacttcagtgctttccgtcctggccaccaaagcaaatgtcaagacttggacaatctagagagagaataacatttcgccgtctgcaactatctttatttattttaagagataattataccttggcttgggcgtatatttttatctacttgcttcgttccaaaatataaaggattttgcttggatataacacattctatgtccagatccgtagtactagaatgtgtcccatccaaaaaaaaatatgttatattttgggatggagcatgtcagaatttggatggagagaagatcttctgtagtattacatatgcagtactgctcactaatatgtgggtcccatagaccctcgggtctacatgtccagtgcgcaatactgcacatacattgatatagaggatctcaatctatctatctatctatctatctatctatctattatctatctattatatactaaaagtccattaatcttcctacaaacactctcaaaccgccacatggacatcctataaacgctcctagatcgccacgtggcaggaaaaatccaaaccttctattttcatttaagtctgtggacccattattttagaccgttagattagatcttttaaaattccaccactcctaatcttcttccgtgtacgtaatagggtgtagaaaaagaacctccctactaatctactgcacgtgcacgtatgacacaattatttgtgtgcgaatttttcgttttgaacaactcttatgcacaagaagttttgtagaagttggtctcggcaagatgaacaaacctgccttatgaatatcttatacatataacaacttagcacgacgcataatctgtgcattaatttgtacacctatcgaaaagtatccatccataatcacagtacagaattgtagtgttgtgcccattgtcaatgtcattagcagattgaagtagtgtctgtgcgatgacaagaaaaatacgtacaaaatgtttgctagataaaagccaaaaaaattgcatacatacctaggacacaccattctccaaaaaaaacatatataatacctacctatgcaagatcaggaaaaaaataatgatcccctctcgatgctcagattaaaagttgttatgtttgtatgcttatgatctgtccgcctaagcttacatacttagtacaagctattcgctgaaaaaaaaacatatatggatgctacctaggaatgtactattgcacggggaaaaataaagaaaaataaacaaaagttcggatctataataaaaaagatatatcaaaacccactaactcctatgttagtgagagattgttactcgagcaaatatttttccacatggtactcggtagtgtcagccgacttcacatgttagggagacattcacatttaattctaatcgtattaccctattaattggtactgatggttatctataatacatttggacataagacatggagaactatatatgtctgaagtattcgtgatttttttattgtattactaatgtgttaggctctttttatggtactaaaacaattccatttattaaaagggacccaacttttaagacaataataatctgtagtggtgataggtgtgataggtgagtttacatgtaagcaggactaagtgattattgtttgaaatttgagagacattattatcatttagtgtatcaaagtctatcatctatttcactttcacggtataagtatttttttcttcttttttagttctcattatatgataatttaccatctcctacagtgaatatctaagatgaatatggtgagataatacttcttttttagtgttctttttatcatcaaaacataaaatacccgcgcatcagcgcgggcttccttccttgttgatttgaacaaggggtagagagacattttcacttaagaccaggtaaatttgcataaggtttcatcatgtacccttctacatcctcccaaaatctctcccttctgccttgagctcgctacgccggtgaacaggctgccacggttgccggcagaggtgaagggcggtgtgcaccaccacactacgctagacaaatagcaacagtcgcgagtccatctcctcttctttagcttccttctcctcaaggctcaagctagcttgtgctggtgagcaggccccttgctcgtaggctaagattaagcatgcgagtcggtcgagttcaggtgtaggtggacatggagctcgcctttttatttctagcctgacctctcactcaagatctggctggaccggaggtcgagccaagcgcctacagaggagaggcgaactggacgaaccttggcaacgaacaaatgtgatttggagcttggaaagagtacacccaagatctctcatcttatcaccgaacacgaattacaaaatcatctctcaacccaaaaggccaaaaccagatacaaaacacatcctctaacttccaaacacaagtacaaacaaggtctctcagcggtattatccatgtttttggctggcatagcgtatacgtggctcctttgagtggattttcatcacacgtaacattgacaaggtgcttacatggcattttgatcaggaaagaaataataaaataataaaaaatggtggggtccattggtcagatccccttcttccttttctctcatcttcctcaatttcttgcgcaagcagggagaaagggcagaggagtaggtgacctcgacggcagcggcgctggggattggagtggtagccggcggcaggtggctcaaaggagcaccaacgacaacggcggtggggagagtttgaggggagagagtgtgtggaggaagctcctcgtgggtctccagcgtcgctgccgttgatgaatccatccatccattgctttctggtcgcgcaactctccagctcgttggctcaccccataggccacagcatcgctactattggaaacgataggctactgggaccggcacgactctagatcgggggcgggaggagcaacctaggttgtgtggcgatagcacggcattgggaaagagcagctgtcagcaaagaggaggtgggcatcgatggcggcgtcaccgagcccatgaatcgggagctcaatgacgaccttgagctcgaggccgcattcgaccacggtgagctcgcgggggtaggagtggccgggagaccgccatgctccttccctgccgaccgccggccgcgcccgcgacgccgtccctcctccccattggccgtcatcaagaagatggggacggtcggtcgagctcgatgacgccgtcatcggcgacacccaactcctccagggccagccgtgctcctcgaaggggaggataggagaagagaggaagagaggtggtgagggagaggaagtagtcattgacatgtggggctaacatggatcccacgctaactcagctgccacgtcggacaaaaccgtctaagtacctagagtgacctggttttgtaaattgagggatgccatatatttgattttttggttgaaggacgattttgtaattcggtaacaagatgaacctccgatgtactttttccttggagctttagaccagatctggagcaacacgtgaagatggtaggccacgggctgatctcctgttcaccaaggctgtagtctgtagacgcatgaggatagcagcagtgggcaaatctccaaaagtcggcaccgtgaccaaggttgctcgccgacgtgatgagcttgactgctcgaggagggtgaagggagtgaaagaggggagatgtttgagaagaatggcacaaagaagtggcacacgtaaatgttgaaatgatatgatctatatgggaatatgggatttggcaagagataaaaaaaatagctgaaagaaaccaaacatggtgtaatagtcatttgtgctctaatacagcacaaatgaattgagtttgattttgagagatcttataacttgtacctattctactaatgatgggagtttcatccatcgaccctcccgtcgcatcacacacagataataacccactccaaaaactgatccaaaaatatcaccacacaacaccaagaacaatgccaatcagatcagctaacacaacccactcctgcataaaaactggcactccacatcctcacctaacttgttgggtggcaatagaagaaaaacaactatatttttacgtatgttcatatgtttctactctcttccatcataaatactactcttttgtgttgtatgttcgtggtccgcatgaccgtgaggtgctaaccttatctttttattttgctacaagtttaggtacactaaaatttaggaaaaagtccaaatatcccccctcctaaactttagatgaaagtccgtctagcaccctgaactttaaaaccgaacatccaacccaactgaactttgccatactatccatattaccccctaaggtggttttagatgacggttttgtatattttggaagtttaaacgaacaattttgaataactaatatatcatatttacatttgatcagttataaatcatcattttattcttatacagtaatatcatgctattattatgttggtacttgtttggaagcgggaggtaataaggagaaaaaacatttaagtcaaaattttaatatatatgttcaaagtgtatgacatgtaattaaactcatccaacttatatacaaattagataaaaaccattatgcaaaatcatccttgggggttatataaacggtattgtaaagtttaggaggcaaatgtccggtttcaaagttcagggtgctagatggactacttccatccaaaggttaggggttatttggattttttccctaaaatttttaatataatgctcatttagaagatgtgttaattacccaataaaatgagatgcttaatctgtctgtcaaagaaaaaggatatcactatattatttttaatggtggaaagttgaggttaagaatgcaattttaatagtcaaataaaaattgaagcggaagaggttttctagacattgacatgggaaactattttgatcccaatgtttcctcatttgtttaaaattactggaatagttataaaaaatctttttaaaaaaatttaacggcactcacacaacatatatataccattcaaaaaaaaactctaagtccaaactccactcacacgacatatgaaaaaacaaattcaacgtatgaatagtaacggtactattcacacctaaattttttctcaatgtataggtcaaatttaaacttaaattttagtggactaatatatgtcaatatactttatattggcattttttttgaaaattttcacaattatttgcattggaattaggggaaaagatacacgacataatatcccctcaagcaattagaatccattccccattgacatccaagtttctttttatgggaattactatcaggctttgcccaacggtatagcttttataaaaaaaatatttatctcatacaaagaggacatagaaaaatatgaagaaaattacaaagtttgtaatcaatcaaacactaggtgtttaaggaggtccttcattctacacatatgcaagagaagttctctcctgaactgaatcctccatccttaaaaaaatatcaaatcatttatctgttaccaaaaatgccaataagctataaagaaaatcccaaggaaacccttcattacaaagcacattcttgccaaaactatcatctcgaagaagttgacattggtgctccaactgatacccaagtgctgccaacattccaaacaaaatggacaaacaaagaaaagacgcagtcttgtttatctcctcctttcagagcaaagaacacaagtaagatcatcatcttttttttcacaatgcctacggtctaacatatcttttgtgttcagtcggtccatcgataaaagccaagcaaacatttttattttcattgacatccaaggtgatgtcgaggttgagaataataagataacaataactatgaaaaaaatgatagcaacaattaaattaatatttggttttgacaactgtgggaaatgaactaaaagcagaaaggggaattaagtgcatggtaaccggatgggagacttggctaagctttcttttgtcatcagaagccaagattcccgcactcctagggttcttctttctctatttgagagggggaagcgtgtggatcttactatttcagtttcttgctagtaaagcatatactaaacgatccaatacgaaaagtcgaccatgtcatcatgcattgcaagcttgcacgatacaacgtgttccatttaagcaaaggaacgaatacagcaacgaactagtaaaagatacgtcgtcataaagaatggacacacacacacagaagcgatcgagtaaactccaatgcaccgatgcacatcataatttagaggtccaatgcacatctgtaagagaagctaggtcaagccaacaaagaattgcattcgaaagtgacggtaccgaagatgatatttaaggagcaaagttttgcatctagactagactgctggataatatacattgatatatagcgtagaccaactaaagaaaaataaatttgagtttggcattactatttacaaggatagctttggctgtttgccaaattaatttatacagcaagagcaatgctgctttagatcaatcacggatatgatggctcctgtgggtgtatctcaaacgctgccgtctgggcacaaatgatgggtcatcaaggctcctgttgatacctgaacgatggctactaccattcggctgatcaaatagctggggacgaaagccatgatagtcgctgttgttcctgtagggtcgattcaacaagcctcgacgcgctaggctctgtctactcggccgtcggatacggtgccaatctgaccgtgagctgctcctattggtgaacgaaaaccggggcaacactctgttattctgaggctgaaaccttggcagtccatgcctttcatctgcccagattattgatgattctggagcttcattcggcagagcctaggggagttatacctgttatcaggtgattctattgagtcgcgccaccactcatcgttgctttcatctccagtgttttcatcaggagacatcgcatctctagtctcaataacatagtcaccaactattattgccccaggattctgtgacctaattgcacttatgacatcaccaacctcctgttcacgctcaaggcgatcccaagtccttttcctcgaaagatccacatgtgcaggctttgcaagcaaatgggcggttctagcgtgttcacgcagctgctcgtaggttccaacaaatttgcaggaatcatgagaacatgttctcaacttctcgttaagatacttcctcacttctccagcaggaatccagccagatacagaacctctacagagagggcacttcaagtcagctgaactttgcatggcatcatgacattcttccattaaaatgctatcttctacgggtaatgttgaatttgcaggttcttggttattagcattattgacatgtcttcctagtcttgggctttgtaaatgtctgggaatcatactatagtgagagcttcgttcaacagttctgttattggagtttgaaatcaccgaagtggttgagtgtgaagcacggaccttactatctccattcatttttctgaatcgatctaggcaattagagtgtcgatgacttgtgttacaaatgtaacatctacagccattcttgtaggaactgcatacaagtaaaacagcattgtggggttgctccatacaaatagggcaagaaatcctgtcccattccatatgcagagcagtgcatgatgtgactgtagatctgttacttttcctacttgtcatcttgaaatcaactgtgttgaattcacttgatcgttagaatttttgaaaaggaaaaactattcagtgtctcaaacttagcatttacgcaattagtgaaaaacattaccttgctaaacatatccttatatactcattaaaaaccatcaattttataacaacaaacatgaatgatccaaattagaagtgccaaaacaaaataccaaggcaaattagtcaggtctaacacaattattaagaactgtataaaaatgaatttcagatcatttagcaggcatcagattttagttttccaaataaatattagtcctaaagaaagtattgtggtgactagtgaggacgatctcatgcataaaataattagaaaaaaaaacgaaacaagtgaatgagaaagtgcagctaaacaacaactattcttgaatcattatatccatggttcctaaacaaagattgcactaaaaaagaacaaactgcagaactcccccctaaaaacattattttcggtcttctatggtgtatagaaatcaagaaagtttgtttaaatgcagaagaggtgttggcaacatgtacacaaacaaacaaaacaacagatgaaaaacgaacaaatgggacatcattaagcatatacaaataagtacatttaacttatctttggacagaatgctagtactaacctacagggagcagttgtatgcactgaacacttcaaaagaacaaaggatggttatggtattcacgataggaatcctgaaaaaaaatgtttacagttagtaaaagagaaactaggtaagcagaatctacgtaaacagaatccagtgacgagaataaagaatccaaaacaactctgtacagacacaacaataggtatcagcacattgtggttcatctggaccaaacataaattcaccatactttctatcagtttggacaggagttgcagaaaccattataatcaaacatattcagctgcaaacggctaattttgtagccattctccaatttatctcattatgctagacacaggagttaccgtaagaaaatattagatctccttcaatacattatgtacgtgtatgcatccatctatttcaaacgttcctaaccaaatctacacgtacgaactagaattaggtaaagtttcctgtaggaaaaatgaacaaaggtccttgagccacaacatttagtgagcacgcatgtacagcgtgcgtgagtttattatagcattcatgattgcataaagattcagcactacataagttttcatcacatgtattacggtgaatatctcctaaattaccatagaaatggactattttcaaccacaggcttctatataaacactaaaaagcgtaaaatcgcgcagtgatccatgcacagttggcatcaagcaaacttggccctaacggattcatatgtatcctggatcgatcatcgtcagacctccgtacaaatcaatacacgaacgaacgacaaggacagcaacccacgaaaggggagaattcctgacgctcctcgttcatcgatgccttgaaacgatagaaattaatccccccgcaacccactcttgttacaatctccgaacagatcagaaccaaatcgctgcccccccccaacccaaattcacccaacgagacctaccccaacgagacctacccaaatcagcgaccgatcaccgcaaaccgaacccttccccccacacaacccaccgatcgatcgggacggatcgaccgaccgatcggtcgatccgcaggcgcagatcaagaagcaggacaccgacggcgggggagggagagagagagagagagagagagagagagtggaaagaggggggaaattttacgggggggtttgacgcgactccagatcggaggacccccgtcgccgtccctccgccgctgcctgcctcttcttctctttttcttccccctttttttttttcctccagttttcttttcttctcgaggaagaggtgggtggggggtggcgtcgcttgctgcgtttgcgttgcgcttgcgtttgtgtggtccgcgcgtgagagcataggtcgcggttttatagacgggggcgaggggaagggaggaggatttgctttcttggtttcgtttcggattttctttctttttttttttccccttcggtcggttataggaaccgacgatatgttcatgcgccgggttaatcgggttaggtgtaccgcctctctctctctctcgtttgcgttctgttctgtcacgcacttgtagtgggtccgatggccctaggcagtcagcctaggggtggcccacgcctcacatccgacggcctttggtttgatttgattattttttttttcgagggactgtgtaagcaggcgtaaagtgtaaaaaaacgtgattaaggttatcctttatccgtctcaatacaagtgcacatacttcatagtacagaatgtgacatattctaatactataaatctaagtagatagatgttaaattatgaaaggagtcaacactgttttcgtaaaaaaaaaaggagcctagcaaaaacccgtaagggttaaattaagaggtttgaattgaattcaatttattctcattttggaacatgtcgtaactcaaattttaaatgcgctatttcacgaaaaaaatgatggagaatgatgcaaaaggcctcccattcaaccctacgctatgatgggtgtcataactatcaaacaacagctcagcggggagattgtggcgcctaacgcaaagcgctagaaggaggagaaatggattcctgtgataaagttgtggctgtggcgcacagaatctagaagatcaaggagatctaccttcattccattcccatcaaggagcatcagatcgtggagcaacttgtgtcggggcccaagaaagaggtgataaagatcacttctatgcagaagcagacccgtgcctggtagtgcatcaagttcaagatgtttgttgtcgtcggcgatggggacagccacattgagctcggtgtcaagtgcgccaaggcaacaacgatgtctggcgcaatcattcttgccatgtttcgttgtgccggtcagaaggggctactagggaaacaatatcaagaaagccccacaccgtgtcgtgcaaggttgccgacaagtacggctctgttactgtccgcatgatgttgccacccatgggctccagcgtcgtggcgacgcgtgtgcccaagaaggtgcttaagttcgccggcatcgaggacgtcttcacctcgtcacgtggctccaccaagaccctcagcaacttcgtcaaggtatcttcaattcatctatgctctgtgaaatgttagcttcaattcgtcttcacctattgtgcggttccacctaaccacaccactgcaccatcgtgctcgtcatgaggccgccgccaacagtgcttgccttgggagagagatggagaagagaggagagataagagtcgctaacatataggtcctacctactgacttagcgagttaaccgtggtcaatatgtcacgttagcagaaatcatttatcaaaccacaaaagaaatctatttgcaccggttttgctctttgagagatgtgactgaatcatgagcaagcattgggagaggcaatatagacttttcctgtccgtggcgtcgtaagtttatatgtgctgtgctttaatgggctgagctcaaacaacgaacaaattgggttaggattttgttcaaagtgggcttatatgggcctgaccggattggattacgtcactataaagcctgttgagagcgtcggtttttttagtgctagttcagattgtaactaaaataaatcttaccaaattttagtaggatttcttacgtatttactaaatttaacaacatattaagcgtagatattttttataactttaccaaaatataatatggttgaaaatagcatcaaatgaaacgggcccttaatttccaatacaagccgccgccgctgcctccgttcctgcgacagtctcgccctccgagacgcggtgcggcatcgccgacgcggagcaaacgggatggtagtgggtcaggggagggatcgtcgttcgccgggcttcccctcgacgcgctgttcgagatcctcctgctctgtggtttggttgcccgccagcagcccgagggagatctccatctcccgccccagcggctcagcgccgtctgccgcggccgtggtcatcaacgcgcacgcgtcctggtcgagcccgtcgttcctcgctccatcgtacgtcagccaggtttaaggcgcatcaccagttcaccaccgacaccacgctgaacccggccattggtgtcgacaaagagcatctagattctatctatgtgtgggattaattagtaaaacagcatggatcagcacgagacatgatttccgttgattgctccggctggccagctgactaccagaacgtacgataagttttagatcaatcagcatatactcatccggccggagactaggtcatatttagattatagccaaaataaaccttgtcaagttttgacaatgctaaaattttagcaagaaagcaatattgtcaaaattttggcaggatttcttatgtattgattatgtattaatcaaatttggcaacaaactaaacgtagatatttttggcaattttacccaaaaaatagtatggttgaaaattgtatcaaaatgaaccggccctataaatgccattgtcacgtctaaagtaaaataaaattttggtgaagtgtatctcgtgatcacgtatacttcctttgaagtagtacacgtatatgaactttttgggtttacggactcgagcactcaattgacttccgatttcatgcatacaaatcccattggcacatattgcattctcagcggtcttatgtgtgaccttctgatttactttttgagtaaatataaaaaaactgcaattatctatattaatataaaaagaaggagttgccccttgcaatcctactggtgaaatcatcctatctcatctcatccgtccatccaccatctcatctaatctatccgtccattcaccatctgatataatctaatctattctcaatcgctgtgccaataccaccgattccacctccgaaacgagatgattccgccccgagtgcgcgatgagtccgccgcaccaatctccgccccctcctccactcctcgcatcctccctcctctcatctcatccacgcgaatccccgccgcctcactcgctccacccgattccccgctactgccagaccagccgccccctcctccctcctcctcagccgcgcgaggaatccccgccgcctcgctcgctcctgattccccaatgccgctgcagtccactgccggaccagccaccccctcctcgctcctcctccctcctcctctcagccgtgtgaatgcccgtcgcagtccatcgttggaccagcgccgccgctaccgcgcctccaccgccggaccacctcaatcgctgcacgcctcctcgcgagtccccgccgcacgccaccgcatcgtgtgcccctgcaggcgccgtggtggttctccttccctaacccgtcgaagttcaccggagaagcccggccccttctctcaaactcgctcaccagagacagagaagatgaataaacgcgtggagaggaggaagagggtgagtcgcatgctgcctgctccgattcccctccatgtgcgcgagttctggcatcacggcatgaactacctcttcggccccagggatctcatgcctgttgtgaatgtggttgtctgcatcggttgtgatccgttcacggactggcttcttggttctttctgaactccatttcttgactcgaatccacattctctgattttttttttggtcttgtatctatgtaggatagcaggagagagatggtgcagtccaccgctgccactgacggagccggccgtggctggagccaatgttgtccccagtcgccgccgaagctgaggtcgtccccttccgccgccgcactccaccattgcccccgccagagccgaggtctgccagagccgtgctcttccccatccgccgctgccggagccgatagcgtaatgttaatcatattttcgcatattgtgtgaaatattttgttgtataaattaatgtatggagtcaggagcaatatgctctagaaatacatggttatgatgctaccttcaacgtgctgctgctggcctgatcttcccttggtgatgaacaacaagatacatgggagaatggctctgcaagccaacattgttgacaaggacaggtaaatcagattcactatgttgcagcttcaatccaaaaatattatattgcacacacaattcacatatggtaaatcagattcccttgccgccgccgaactccaccgctgccacaggttttgccccggaggtgttcgactgaatgccactcaaccaatacggtttctatttattcctaaccattgcctcatatattttattgttcatgggtctatctatctccttacaatggagggatacatcgttgggctaggactaacagcttgcagcttgttcaccattcagctgtaagaaaatattgtacatggtttatccagttgacgatgatacatgttggttggttttcatactactttaaatgttgctctattaacctccagagaagatcaaggaggttgttcctacgaatacaaatcatgctcagacgctattaaatcagccactgattcacatattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21531 - DNA, 15348 bp, Oryza sativa
  unsure (1)..(15348): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccaaatttggcacattcctctctatcgcgaagtctagtttgcctcttcctgccggcctcccttcctccctctccctctggccgaaccaaatctcaccaagcccatgcgccggcctagcaagcaaagtggccaagttggcagcacaggccgcctctaaccgctgacgcatggggcccacaccaacactgacgaatccaggtcgcgttcgatggtgtgcccgttgacgtcctaggcatgcttggcacgcactaagactccaccgcatgcctggccttaccatcaccaaacctccgtgaccacgtccgcgtgaggatgcagttcgtcggcgtgttcgtcatcatgaccaatgtcgtgcccatcaatgaccaggactcgcgcatcaacaactatggcttcaccgaggaggacaacctctctcacctcgactgtcacgaccggaaataacccaacggacgttccttacgtgcgtgtattattccttgtcccaggaggcaaggtacaccaaaagttgatacaattcagagtttaacaagcggaagcgtaaatagttaattattacacgggcaacgagggcccagcacacacgaagacaacgaaaaacagcggaagacttgggcgacgaccacaggcgcttgacggcaggcacgagctagacaccaaagccttcgtcatccaggagctcctcttctgggtttgaaaaaaattgagcaagactgagtacaaccaccgtactcaacaagacacacccacaagtgcagagtaaatgcaaaggagtacaaaggagttataatacggggggttagggtttgcagtaaacagcatttaaaagccacttagttgctcaaggctaaatttaaacacgatcctagaactatttgatattattaaacaaggccgtgaacccacacgagcctgccttaacccaaggcctacgatgattcagaccgaaccggcaacccgaccctgggtcccagctcgtcccaagccaacccaggccaaccattccacattttagttgttaagccagttttaagaattaaaacactaacttgggtacattgctaggtttgcccataaccgagggcgcggctattcgaataggttttactctgatcagaggtgtacatctttacccacaagacacgtctttctcacgtgcaaccacgtgccacataccaccacggcatatggacggaagacatgacatagtttccaacccatcctagccatagacaagagtaccgacccaaccccacctacggccggaacctccgggacaggtaggcaggactgagcccctagcagcaggacaccagccctgtgccatgacatctcgactaccgggccgcagctcgtgtagccttcatctgtcctagagatgtccatcgacccccgacttcgtccatctccatccgtgtacttttgtttataaccagactgagtcacaaactaagccttacccactagacatgtgaaagtacggtagtgctttgcaacagaggcccgaagaccggtccttatgtggccgaggtgctactatcaaaaccatgcacccaagcccagcctaaaaccattttgatggttttgaatagagggggaggtgtgcatccaattccacaataatccaaccattccataatgtccaagcgatatgaatccccaaagtctagaattataaaatcacctaatgttgcctaaataataagagaagcatatacctaaattcagactagtggaaccatgagtagagtgcccactagttggggttttgtttattctagggtgaacaaggtaataataacaatagcaatagtaaggtcataacaaaggtaaataggcatggctaattaaaacagtgataacgcgggaatttaaataaagcggtaatgcattaatttaaatcaaaataatttcgcaaagtgggatccaatatgttcaaagatgatgtgacttgccttgctcgctttcccaaacgtcggcttcaacctccacgaagagtggatcttccgaagctgcagtgtctacacgaccaacggaaaagaaaagggcttttactgtaataaactccatataacaagcaagaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaaaatggtttattgcgtcagccgagggggaggggcgcgcggaccgggtccacgggagtggggctcacgcggcagcctcacggtccatggtggaccgggtgtgcccgggctcacaccggccggcgccgtgggccccatgcgtcagccgcacccgagggcgtgggcggttgacggccgggccccacgcggcagctgctcggcgcgcccggaggcgtccacgtcagcgcggccggcgggaggcggcgcccgcgcccctatggtcgccggcggcggccataggcacggcggagcggcagccgggagagtggaagggaagggggaatggaggcggcggtccacggcacacccccgggtcgacggcgacgacggaagaggcggccggaggggaggaaggcggcggcgcggctcgggtggacggggacgacggtgttccggcggtcggcgaactcggcgaggtggtggacggggacggcggcggtgcggcgaagccggagaaggcgacgccggggtgggagacggtcccggcgagcgaggagggccggccggaggtcgtcggcgacggaggagagagagagggcgacggcgcgagctcgattccggcgaggaggaagggcggcgagaggcggaaacgaacgggagaagcgcggggagggtttaaatagggttggaagggggagagggcggccggggaaggaaggaaaccggccgggaggtccgaccgccatcaatgacgccggcgagatttgcgggagcaaatccgcccgtttgaatgagagagagagaggggaaaatggggggaaagggagaggggatcatggggagtaatcccccctattgattttacgcgggggcgacgggatgcggcagattcggtggcgggagcggcgggaggaaggggatgacgggtcggccctacccgtcagcgagggtggcgggcgggcccgcccgtcagcggcgcgcgcgcggggagaggccggatgggccgcgggggagaggagagagggggagggagatgggccggattcggcccaagagagggaagggggatttttagggcttttctttttataaaatcactttaactttgtttatttcttaataattattatttgtgctctgaaaattccactaaaatttatttacacattttaggcttttaggaaatatacaaaaatcctccaagccttaattgacttttaactttgcacattttaatttttttgaaggctctcacaaggattttaattattctaggtataatttagaggatgtattttaggattgttttgggacgcgacatcgacctcggcttcaagttttacgacctcactgataaggtgcatagggtcctcggccagactcaccgcttcgactatgtcaacaacctcagtgtcagcgccaacttgccagttatgggcgggactctctggtacaccatctctgacatcttctccactaactgtgccatcgacaggttcggtcgccacgccggcatctctatgcaaggtcaatggcagggccagttaaacggcttcaacttggtcgttgcgagcttatctgatcgttacccaaataacaatacagctaaatatcggaataagtttaatttgaagtttagggacaaaatatgtactgatcaccaacatgatacatgcatgacatctgatatttgagagcacacaaaatacatggatcggaacttcctggtcgctgtgctgctggtgctctacaccttggatcaacaagagaattggtgccgacgcctgggcgccggtagcatgccagccaacgaagatggcatggagatgaccaatgaacaaacaattgaaaaggttgctgattgccatggagtagaggacttgacggcctccaaggtggacaccaaaggtgttgctatagatggaaggcggaactcctacacgcatgcatggcaatgaaatgacacgatggacagaggaggagaaggggaaaaagaacaggtctatgagagcagccataggtgtagatcgccacctgtgggagattttgccgagcgagatcagtgatgcgccatgtgacgtgcgatacaattatgacgaatggataattatcttttaatcaaagaatggataaattgactacgtttgacaagtactgatatgcccttttgaatcaacggttcagatcaattctactagtagaataatactaccagttgagagcatcatagtgggactatgcttttttttgtttagtgattcttttgaccaatatgtttctaatttcatagttgttcaatgttcttacctgtactactctgttttcatgccttgccttatatgctatcttcctatctaagtgttaacatatataactattctcacagtcgttttgataagatttttagaacacatatgtagttgaatgagaccgaaaaatgttataaaatcaatagcttatttgattcaacaaaaaagtataagggtaaagtcattccaagacagcggctgaacatcatggtacaaatggactagcaaacctacctgccaatcttacaaaagaggcataccaagaacaataagtacccccacatactgttcaattacctacatatgatctcatctacttttgtcataataaagtatctatttagatagcagatattgtaatttatagaatggctaataatttatttttcttaggcttactcaatcccaacaaatttaatctttatattatttactcaaaagtcaaaattacatatttctatatgggattaagaattccttaaacaatacgtgatatatcttccaattgactatagagctacgagacgggcatcccatgggcaggacagcccattggcatcgcatggcccatctctactaaacgaacatccgtttttaggacaactactaaactatgctttctttgatctagtcattccgtcaacaactaattttcagacaccaccatgcacacggttcctcgattggacacttgtgggaatggatatgcagacttgcattgtgccatgcatgtacaatgtctgtgttgtctaggacaaaaggtgaccttatgtagatgcatgtacagtggctgtgttgcctgggacagaaggtgatcgaccttcatcatcgctactaagcaccatatcttgacattgagtcacccttcagcgatggtgatgctcggtgtcaagtgccctgtgcatggcctcgctacagctctactttgacacaggatcacatcagttgccattccagttatttcggaatgtttgtcctaagacatcctcatctggagataggaaaagtgggtttacaatgcctatcgccatgataataattggccatgctaagcctagtttgttggacatcttttgccgctctcctcagtgatgagcaacaatttgtcgcttggattttaatctaacaacatgccaaaaacatgaagactgtcctttgtgtatttgaacaactctcagggctaaaaataaacttaatttcataaaagcaatattttttgctttgggaataccaaggaagtggaggatcaatatagatcatttccttttagataacttggtatccccattcattatcgaaactccgaaacatcgattggaaaggcaatgacgatacatttgagagcaaactcaacacaaggaagggaaaaacatatcatatggtggaagactggtccttctaaacttagttctttcgagccttcccttgtttatgttaccattctttgaaattccatgagggggtacttcaaagattggattactataagtcacatttgttttggagcaatgatgataaaaaaagaaaatatagacaaactaagtgggaaaacatatgtcgaccaaaagaccggggggactaggtgaccaaaacatttttataaaaaacaaatgcttgttaagcaaatggcttttccaactggttaatggtgaaggcatatggcaataccttttatgaaataaatacttaatgggtaatcctctttctaaaatgttcaacgaagaaggaatttcccaattctgagctagtttaatggaagtgaaagatcattttctgaagtatcattcgtttagatgtggcaatggaactgaaataagattttgggaagacacatgattgggatcacgtgctcttaaagatcaataccctgctgtatataatgtggttcgatagaaacagtctactttggtagactgttatgagcacaacaccattgaatatttcttataggtgagccattgttggcaaaaactaatcgagtggaacgatttgattctcagacttactaatataaccctgtgaaataaaaatgattactttgtatgaccgcttcataaaagtggccaattttttgttagctctatgttaggatccgcaagaggattatatgggatttaaaggttccattaaaaatcaaggtttttgtggtttcttcgtaacaaagtaatccaaacaaaatataacctggctaaaagaaagtgtgtgtgtgtggggggggggggtagggacaaatattgtgcatctgttatgcaaaagagacaatccactattttttttagtattatattgctcgatttgtctggagatgtgtgttctttacttttgatatccctccaactcgtaatgcaacaatattggtttagaggagtatctaggtccatgaaaaagattatattaattgaaacttgtgctttatgttggtcaattaggtgttgccgtattgacaaagcttttaatgcatggtaaacaattctctaacccgatgcatgctatcttcatgtttttctattggctccatttttgacctacgatgcggccacaaaaagagcttgatactatgcacaatagtgctatacttgtgaaattgatagcgatgggtctattattttactatgggtgacatagtttcattagaattatggctgaatctatgtgatttaacactcttttttatttgttaaacaaaattatggttacttacactggtggagaaactatctttcgtcggtcggccgaattccacaatagtcccggttgcaataaaaaccaggactaaagaggttaaaaagggtaacgggcatatttgatctttagtcccggttggtaacaccaaatgctatcagggcttatcgggccccccgggatctttagtctcggtttgtgacaccaaccgggactaaagatcccggcgatctttagccccggttcataacaccaaccgggactaaagtcccaccgctatatatatgtcttcttcctcctccagcccgaccaagcttgaaaatttcttcaaaaaagaggggaggtcatgccaaaatttctagtgaatttattttggtgattatatacaaatcggaggtgcctaaaaggttagcaacttcatcctcattgtttttttgtcatattacatttggagctatgttttgcacacttttttgtctccaaaattttgttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtggaatattttataatttttgtatgaataatgatatgtcattattgtatgactgttgaaagagtttgtaattattttatcattattgtatgactgtcattattgtacgaataattatttgtgtacgattttatttcatttcatgtagatggatcggcaatggatgtacgctgaccggcggtccaaagtgtttattgacggcgtgcattattttttgagagtggccgaagctaacaggcattataagggttttatttattgtccatgcaataagtgtaagaatcagaaggagtattctgcatccaggactattcattttcacttatttgagtcggggttcatgccaaactataattgttggacatcccacgaagagcaaggggttgaaatggaagaagatgaagtggaagacgacaatattccggactttgctcagtacgctggatttgaaggaaatcaaacgggcgaggaggaaagggatgctgatggtaacgacgttgcggatgatcttggtcagatgttgcaggacgccaaggaggattgagaaagtgaaaagggggcccataaattggacaagatgttagaggaccacagaacatcgttgtacccaggttgcgagcaggggcacaaaaagttggataccactctagagttcttgcaatggaaggcaaaaaatggtgttagtgacaaggcatttggcgatttattgaaactcatcaagaacattcttccggaggggaacaaattgcccgagacaacgtacgaggctaagaagatagtctgccctctaggactggaagttcagaagattcacgcatgtccgaatgattgtatcctatatcgcggtgaggagtacgagaacctagaagaatgccctgtttgtaaagcactacgatacaagtttagacgagatgatccaggagaagttgacgggcaactaacgaagaagagaatttctactaaggtgatgtggtatttccctataataccacagctaaggcgtttgttcaggaacaaggggaatgctagaatgatgcgttggcatgctgaagagcgtcaataggacgggatgctgagacaccccgtgatggttcgcagtggcgaaacatcgacagaaaatttaaagactttggaaaggacgcacgaaacatacggtttggtttaagtacggatggcatgaatccttttggagagatgagcagcggccatagcacttggctcgttacgatgtgtatttacaacctccccccttggctatgcatgaataggaagtacataatgatgccgattattattcaaggccccaagcaacatggtaacggcatcgatttgtacctgagaccactggtcgaagatcttaaactgttgtggaagaaggaagctaggtgtccccgtgtgggacgaggacaaacatgaggagtttaacctacgagcgctgctgttcgtaaccatcaacgattggcctgcagttagcaacctatccgggcagtccaacaaggggtacaaggcttgcactcactatatggatgaaacagaaagtacgtatcttaagcactgtaggaaggttgtgtatatgggtcatcgtagattccttgcaacaaaccacccggtatggaagaaaggcaagcactttgaacatacggcggaccaccgtacgaagccaaaacatcgcagcggtaaaacaatgtttgctatggttaaagatcttaaagtagtgtttggaaaggggcctggcagccagcctatagagagcgaagatggtcacacggcgatgtgaaaaaaaaactccatattttgggagttaccctattgggaattcttggacgtccgccacgcaatcgacgtgatgcacctcactaagaacatttgcataaaccttcttggcttcctaggtgtatatggaaagttgaaagatacactggaagcacgtaatgatctgaagcatatggaacaacgcggagaccttcacccggaaccaaaggagaaatgaagccattacttgagtccagccagctacactcttagcaaggcagagaaggaaagtatgtttgaatgcttggagagcatcaaggtaccgtcaggatactccacgaatataaagtgaataataagcacgaaggagaagaagtttacaaacctaaagtctcatgactgtcacgtgttgatgacacagctgctgccagttataataaggggtatcctcccagacaatgtcgggcaacaataacaaagctatatgctttcatgaacgcaatttcgcagaaggtcatcgatctggatagattagaagtccttcagaatgatgtggtgcaatgtcttgtcagctttgagctgatatttccaccttcatttttcaatataatgacgcatctgctttgtcaccttgtcaaagagatcggtattctcggccctttgtacctacacaacatgtttcctttcgagaggtacatgggcgttctgaagaagtatgttcgtaacagtgctcgtccaaaggcaagcatcgccaaggggtttgaaacataggaggtcattgaattctgcatagaatttattgaagaccttcgcccaatcggggtaccagaatcacgacatgaagggtgactacggggaaaggggactctcggaaggaaagcaataatgacggtagacaacaatttattctgtaaatcccatttcacggttctgcaacaatcttcattggtggctccttacatcgaggagcacttggctctagttcgcgccaaaaacatcggtaagtccgatgcatggattacacggcatcacattgatactttctccgcatggctgcgacaacatctcatggttaacgagacgattaaccaacaactggccttcctggcgaggggaccatctggctcgatcacgacattccagggatatgaaatcaatgggtacacattctacacgagagcccaagacatgaagagcatgaaccagaacagtgttgttcgtattgatgccatgggacacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaagattggatacttggacgaaccttttgtccttgccaatgatgtaacgcaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggcaaccccctttcacggtgacgattgaccctagcatcctcctatcaaatgaagacaccccttactcacgtagcgatcataaggaaggaacaatagtgaggagaaagtacgtgcggtcaaccgtcaccgccgatgtattgctgtaattgttgtgtacacgatgtaaactattttggatgtattgaatatctatacaaatcaattgttgtatggcatatgttaattatgtatgattattagaatttttatcaaattgaaatcatccatatgctagttatatatgattattagaatttttaaaagttttaaatcatgcacgtggtatttacatatgttacttagaattttcagcaatttaatatcatgatatgctaattatatatgattattagaatttttattaattctaaatcatgcatgtggtatttacatatgttaattagaatttttaacaatttaatatcatgcatatgctaattatatatgattattagaatttttaacaattttaaatcattcatgtgcttattatatattatccacttagtttactacagacaacaatattttttcgaaggttttatcattaatttttcgactttaaataattgtaatgcattatttactattttagaaacacatatgtaatgaaattaaaaattcagtgctattatctttagtcccggtttttaactctaactgggtttaaaaataatttggaaatagagggaaaatatctttagtcctggttggtgagaacatccaggagtaaagatatctttactcctggttcgtaagaacaaccgggactaaagatcttttctttagtcccggttgtaggtacgaactgggagtaaatatatctttactcccggatgttctcaccaaacggaactaaagatctaggggtatatatattcccggtgcgccctcgtcttctccaccaacacttagaagtttttcctccgatcgatctcggcttctccttcgccgccactgcctagggcaaccccgcgccgacgccgccgtcgtctcgcggtcctcgccgcctccgccgccgacaacgccgccgcatctcttgggggagagtcgccactgcctctctctctctctcgatctatctctctctctctccaaaccgccgccgcctagctcattgccgacgccgccgccgacgtcgacgcgcgcggccgaccccgaccccgactccgcctcccgccgatgctgaccccgtcttcgacgcggccgtcaccgccaacgacgtaacatccacgcggccgccacggtgacgacgccgacgccactgccacgccgccgcccccgcctcgagctcgccacgccgccgtcgcggcacgctgccgccgtgcccccacgccgccggaccgcgccacgtcgccgcgccgccacgccgccgctccgctgccgccactgccgcgcgacacgacattgccgaacatgaacgaacgtgaacgaacatgaacgaaccgtgaacgaacgtgaagaaattcttcaagggaatgtccacaacaaacaaggaggccttaaagctatcggactatgaccgaacacttcagaaagcctatcacaagaagtccaaaccagtccctcagcttggagaacaaccaaaccaagaggtcgagctattggtgaccggcgaagattttggcataacggatttcatttcagacaccggtctaactgtggatcagctgattggaggcgcaccaatcccgaaggcggtagtggcatacaagtttgaacttggtaaaccgcttgtcacgcctgagcagctgcagtccctaccgacacagatgtacaaattccatgaacagtacatggaaatgagcgccaagggtagagagatgttcggagcgaggatcagaaaccccgacttcttgcaaggagaagatgttctcttgatccatttcaaggatgtcttcaatctgtaccatctggacgccctcgacgtctctcttctgagcgcatggattttgtaagtatctttgagatcgatttgtttcattcataactagctccttgtatatatgtaaacaataataatttcattttatcattgtagaatggagattcaaagggcccgacggcgtggggtttacgatactgggttcatcaaatctcgaaaaatcaacaccgacatgatcgacaagtacgagaaagacacagaggacaatctcgtccatctcctaacgcaacagcatttcaagacgttcatactaccgccgtacaacacagagtgagtttttattgtcgtttgaacaaatttcgttcccatacatataagatgtacattttcatatatatctcatctcacgcatattccagattccactgggtcctgttatttttcgacttggacgcatgcaaagtcactgtgtacgactcaatgaataaagaggagaagatttttgacaaggtcttccaattgatagacaggtaatataatgccatctattccaatgtcgcgggaattctattgctattatgttgatctcgggtaataattaattaatcatagcttgcaactgcatatgtagggcatgcgatcggttccgtcaattggtccgcgggacttggaaagaaaaacttggacggaggtttcattttccagtgagtacatgcatgatccaaaattatattgaattgaatctctaattacagttaatataaagagtatattaagtctctcatcgtttctcacgtagtgtgcaaagcaggaccagggaactaacttatgcggctactacgtatgcgagtatgcccactgcctatcaaaccaaatatacaccacacgagagctcgatgtacgtatacataaaccattcaaaatttcattgtgtatcaatttgttaagttgtttattaatttcatatattgatatgtcattatttttcgaatgatagcgtattcatatgagggataatctcccacacaagaattttatcacggttgttcaagaacaactgatgggattcatcaacgaaaaagtccttaatcccgatggtgaattctactacgacggatcgacaattcataacatcggtccttcctcttctgacataacgccggcgtcgaagtcgtagctatagctagcgagcaaatgaattgtactatatatatgcatgtatataaatatttatatatgtacacatttaatttactgttaatatatattttggtaacatatatgcacataaaatgttaagtgctttaaattatacatatgtgtgtaatatatgtattatatatatatatatatatatatatatataaaatcaaccatgcagcaaacagggccatgcaaataaaaaaaatggtacaccgatctttagtcccggttatttcacccggggctaaagatagctatacttagtaccggattcgtagtcccggttggacaaccgggactaaaagggggttacgaaccaggactacaaacggtttctccaccagtgttatttttggatagaagtaagaaatgtatatcattttcattattaaaaagaagttccaaatgtgatccagatcctgtatgagccgtactcatgttcttcgattgtgatgttctgagccgaagttacgttctatttgattgatgttctggggtaatcagataagtgtttctttgtccttgagaaagcggcatgcactgatgcacgagaaattgagttgcgatggttcatgcactcacaacccagtaagtaatcattaagaaaggaatacaatcttctgtttggatcagaagcaagaggctagctgatcgatattcctttgagtcacatcagcagaacagataccatttcataaaacag

SEQ ID NO: 21532 - DNA, 9938 bp, Oryza sativa
gttttgggtcagctttggggctaggttgcgggttcggttgaggatcttgtttcgggtcaggctgtggcgttggttttgggtcaggctgtgggttcggctgaggatcttgttttgggttaggttgcggcgttggttttgggtcaggttgtgggttcggttgaggatcttgttttgggtcaggctgtggtgtaggtttcgggtcaggctgcggagatggttttggatccggttgtgggtttggtttaggatcttgttttggttcaggctgtggtgtaggttttgggtcaggctgcggtgatggttttggatctggctgtgggttaggttgagggttaggctgtggactgggctttgtctctggttgtggttttggtgttgggtcaggtttaggattgggatctgctggctttggatcagatttagcttcaatcacgcgtccattggcaatgtgatcaggaacatttgccgccaatgcaatggcaagcgccaaatggaagcacagtgagaggattgatctcatctcgttgtcactacaaactctactactcactcttgacagtacacaagctgtggtagctaggtgtgttgcagaaatggcagggagaggctaggagatttatagacatggagagccaactggcggtagacgcgtgtgatgctccctttgcttcatcggcaacgttagcatgtcactagtgatccaccttttcttcgtcgttgatccgtgtaactttcgcgcccaccagcccattcagatccatcaggaaaagcaccaaataaacggtattaatttgtgccttgtcgttgtcatcactgtggtgatattgcaggggcttcttcaattaatttacgttgtgtttatcacatgtacgctttctcaatgctaaaggggaagaaatgggaattactttgtgtgactactttatctggcttttttttttcatgtatgcatgcagctactcgatcttgtaactgatttacgcctaactttgcaagcacggctaatgatgtgcagctctttccccccacctgtgccatatatacaattagtaactacgtggttaggacgcggtttacaattaactaggtaaattatgataatcttatctgttctagctgtgatatgatgttttactattttcttgcaattaaagttgtaaaggtaaacttgttttgcacacaaaaaaaaaacttgggtgagacacggtagttcaataattttatatttgtataagtttcacacaagaatcataattttatatttttcaatccagtccttatttatggcaggacaaaaatctcaaaataacatcttgattttttgaattaaattcctcattctccagattgagttgttatatatggatacagattaaagacgatgtttatatgtagatataggatccaaattggtagatataggatacgtctcctcgtattccactaatgtcaattataatataaatttgtttggaagattctaaaaaaaaatgcgcccatgcagaatatattaacacttaccatttcaaaagaaaaaaaatcaaatctaaattcaacatacaaataagaaaaagagaagttaattatattttcatcaccatttataaccgaagtgacactttgttctatctcttagcagaactagttaggatggcaaaatttattgcaggacacttaaagttcgtggtatttgctgcaggacacctaaagaatgcttatttgttatagggcataaaaaaatggtaattatccgttgaacatcgaacatattattatattatatccgatgcaaacgtagagagaaatagtgtgaaaaagtcctattttgcccctgtgtctatcggtttgtaagtggtcatgttcgaaccaaacccaggccattctcattctccctatttggtctattgtcaatcccttggcctgggtccggttcaaactatatccggttgggttaaaaagcatgtcgtatgggcaaactcgtcattttagaaagtttctctctctgtttgcacaggatataataaaataatctgttcagtgtccaacagctaattactatgttttcggagtgttctatagcaaatacgcgttatttaggtaccctgcagcaaatttcgtaaactttgaatgttctatagcaaattttgccatttaggattgttgtagtttgaaccacccaactccttagttgaacttatcaatgaccttagcatatcggcgaactttcccactaccatataggccactctttactggaggagagtctagatgcagctggagaagaggattaggctggtccgagtccaaagtgcaacagagcaattaaaactgaaaagattaattataagtaatcagaaggaaaattttagtaataaaaagcggtccaaactggaatacactatgcgaagaaaatataacagtgaattgttcactgtaatgtctgcatggttataaatttgttaaacagcttcgttttctattcgtttcagttacgtggaagatcgtacaccactacttcgtcactcaacttcctctgttgaacaacttctgttgttgccaaaaacacatatatagaatcgcatttcttaaaaaagtataatagtttccttaagtattgaatcaatctctgcagttataatctggaattagtatgagtaattatttatgcataatattttcttatacttattttataaataataaagtttttccaataataatggggtgacatgtgttattctagttttttgggtctttgattgtctttgaggctgctcgtgtacagcacacgcgttttcacctgttttgacgaactactgttactttattttcttgagcctttgtgtccctgtctccagccctgcagtccatcacaaacctgttcttggtgagcggcacgcatgttgatttgactaatggataaggtgttcagcaaatcaccgatattgagagtgctggagatggactttgggaagaaaaaactggttggatatatcaacactaaaatccaaataggataatatacggcatgaaacttaaatagacatgtaatccaaataggtaacagcacggttttcactaaccatgcagttactgtgataaccaccttaccatggaagtggcagtaaccgtaccccacccaaaacagtttggtgattagaggggtttgtcccttttttttcactctaatgagttcttcctcatacaacatcagtataattttcactggacaagttttgtcattatttatttaaaaagtgtataacaaaatggaagagttcttatgacaaatctatcgatatagttttcaaacctcaaagcataatgtttttttatcttcgattattttagattttaagatttgatggtacatattggaaccatctatttgaaaacggcagtagtaccataccatttcgaatgtactaggtagaagatcgatatgctataccaaaaaggacaacgcgtcatactctcatctggccggctcggggcgaaaccctagccgccaccactgccactcctttcccttattttttctgccttgccgatgcaggacaatcgtgtggtaagccgggatggtagtggtagggctacatcacggtgacacatcatctctggcacgatagaggcagacaacagcgcgtggtgagctagagtgctggacgccactgcggcgctcaccggcgagggaggatggggacctggtgccgccgtggctagatcctatgttcccatggccggatcaggcacctccatgtcggattttgtcgaggtcaagtagtcggcgtgatttagagatcaagggcgatggtagggagaggatggtgtgggagacaacaacgagtggtcaacataggcgacaacagctggaggccagtaaggctgcaggcggtggaggctcacggccgatgagaatgacagagggcacaactttggcgatggccacccgcaccgacagcgggattgattgcgagctatagcgatggtagatggtgaagccgacaacatcgaggcggcacaagagctaatggagttggtttgtccaagcttgctagtcacacccttttcttctccctagagctcctcccctgctatggccatcccttttggttacggggagctctattggtgagacgacggtgggggtggttagagaagacaacgctctagcgacgaggcttcgtgggagttgtggcatactaggctgcgggttggtagaggttgttcgggtgacggagctctacggtggccacgacagctgcggcaatgcgtgctgcagccgaacttttgacctaccaccctccccattcctaataggactctccaggtgaaagccagtctagaaggatgggcgacgatggcgcattggcgcataaggcgtaatggcttccctggatgcgttgcccacaaggtatttgctccatgcctttgttgtctcctctcttgttggtctttggtggcttcttgtttataatcatcaggttgatgtaagggatgagtggttataatcctaataaaacctaaccaatcccaatcctaaactaagcgcttgagggtcatcgaagggcggtactagactagtgcaggcggcgccccaaaagatgtctgcatcttgcagttgattgcagcagccccttcaggatcaagccggtgaccgcagctgatacgactactgcctctacatccactgcctctacatccactctagccatcgacaacctcagggcaactacgacatccatggcttctaataacagtcagtgaccctaattattccatattaaggtgatcatagatggctaagaacttatgtcagtagatcaaataatctacattgccttattctgggctagcggacggcggtggtggtgtttttttcctggttatgatcttataacttttttatgttaatataaagcttcactactaaaaaagcaattttttttccaaatcatcaaaacctatttttgcatgtggttgagctacccgtttgcccgaaagtgtcagcgaaaatcaccatttttccatgcgggtggcgcacccgcacgcaacaaatccgattttctcatgcggatgcttatgtcgttcgcacgaaaaatataaatccccaaaaataaaaaccctagctaggtgaggtctgccgtcaggctcctcctactagatctgcgccggggatggttgctgccgccggatccgggcgggaacagccgccaccactagatacgtgtggaagatagcccagccgctgccaacaccccttgcctcacgccggtctcgtcccgctgccgctgccaaatctgctcagatccatgtaggggacaggcgccgctgccagatccgcgtggattctggcgggggatgaccactattgccggatccaagtgggggaggccgtcgttgcaaatctgcgcggagaacggccttgcccctaccaccgtcgcccctcgtctcccatcgggctcctcccaccgcagccgcacgggggccggcctcccgccacttccacatgcgcacgcccgccgctggctactccccctcgagcttgccaatggctactccccctcgagcctaccattggctagtcgcccatcaccgccgctcaggagggttgtccgccgtgcgcccgccgctggctacttcccctcgagcccaccactggccagtcgcctgtcaccgccgctcaggagggaagttaagggatagagaggagagaaggtgaaaaatgagagagagatgagtttgaaataatatgaggaccttcttggcggacctttaagagatccatatgtgaaaatacattttcccatgcggtcgtttaaaaggctcctacgggaaaataggcttatttttctatatggcgtcttaagaggtatgcttgtgaaaatagatttttgcatgcgggtctcttaagaaaatgtatgctaaaatgaaggtcgatttttacgtgcacaaccagttatggtccacctgtaacctctatagatctcgtacatgaaaatcgtttacatagtagtggttgtatggttctggttgtttaaataaaaacatatatattctcgatctcagaacaacagcactgaaatcagtcgatcgacgtacgaggtacaagatcgatatgcagcaccagctgtcgaagcaggagccagtagtgttcagtagtgttccttccaccgctcgtctcataagctagttaagtataaataaatactcctttaatttcatagtgtatggcgtcattgatttttttatttatttttcatataacctttgaccatttaccttattaaaaatataaataaatattatttattcattgccacttgtttaattattaaataaaatttaatcttattatttatggttttacatatttatattaaactttttaaataaaacgaactataaatgttctggattctggactgttcgttacattgcccgtacaacgacgaaatggatcgatcgacacgacggcaggcagccccagcacgcatgcatatgctctcgtggcgaggaccagccggagaagtggcgcgtacgcgtctgcgaatcatgcaaatgcccgagcgcgcgcgcgtgcgtaaagcccctcgtcctcgtgtttcctcgctcgcttaatttgttgcacggccccaggttcgttcgatccatggatttaaccgggtgcaatcgcgatatatatgtacgcgccgcctgcgccttttgatcatgaagcgaatgcacgatgaactgcgaaacggccggattttcgctaagtggccacaggagctcgatgcagatagacacttgatttgatgccattcagttaccggtgcgcgtgcttggtcgatcgatcgatatgatttaagatttacacgacaaaagtattccttctttactgttctcttagtgtctgcgtaagtcttcttttcctgcgataatgcctgattttatttacaggccttaaatcataggcggagcactgatcaactgcatagaacaattttggttgtctgcaaaaacacttttcgtagtaggtgactgaaaaagaggtctgttcactgggctagatgaattttgtggtggtccaaaatatggccccctcttactctctcatcctaaaatggaatccaattttgctatacacactcctaagtggaatacttgacaagaagctgtggtttagtggggataatatggattggcccttggacacaactgcctccactcttctgtgccgcttccaagtgccaaccatgtcttatttgttagtaaccgcagcggctcagttcaaaactacgtttttgactcgcggtgttggtgcatcggaaaatgtgttggatcattagtgtacgattaattaagtatgagcaattataaactggataaataaatttacttatttattttaaaaaaggaaacttctatatagagaagttttacataaaacgtgttgtttagccgttaaagaagtgtgctaataaaaaccgaaaacttaccatttcacattttgggaaactactgacgagtagatcaagttgttcgccagcgaagttgaacttgaacgcctcgttacttttttttaagataatggaatagtcatcccggcctttgctcaaagagagctacagcccattattacaatctagcactataaaaaatgagtgtagttcagaaatgattgaagaaatgaccacacaaaggtaaatttaaccaaaacaagatcaggagaacacattattagagtgcgctcctttttacatttgggattaggcaaccgtgtagcatgtctcaaatgtttgggaattggctgaattgtgttgaacctaggctcaagagaatattgtttgtgggcatagctgcatttctttgagcaatttggttatataggaatgatgtggtcataatggctccaatcctacatctttcttgcaggtcattttcgtgggaacacattgggcaaggacttggtctttgcttcttaagggaaccgatgaagaaatagttaagaactattgcaaagtgctggagaagcgtgtggtggaattcttctccgtgtatggctggaaccttagaagaagattggaagcctagtcttttcttcgtttgttgttcttaaaacctttgtgctgtcatctcttatgtaatgggagaggtcagttgatgcattttgtaccctttaattagggagagtcttatgtactcgtgttcggatttttggctgtgtacaccccataaaggtgtagaggccgggtttgataatcctttatctaaaaaaaaggagaacacattattgaagatcaggtaaatttaacgcctcgttactagatgtattgatgttgctcacccatctgcaatgaccaattgagcttcaattcgtacagaattaaggactttaaaagatttaattttcataagaattggactaattcttgcgaaattccttcataatttctgcgttccaacatagccttgatagccttgattgagtgtgcatgtttggctttgagattataccgtgaggaaccctggtgcccctatcaaactaatcgtaaatatttgatgtttagaactatattcgttaaatatttcaaaactttaagaatattagaaaaggtttataacaatctaatgagtttatgatttttttagataatggaataacattccgccctttgctcaatgagctacaaccaattattataaaatccacacacgaacaaactcaacacacactgatatatgatgtaaaacacaagataaaaggcaccaacacaagataaaagaacactcaattactcaaggcagagaaaagaagggaaaggagggtcagcggtggtggctagggtttcgcccagagccggccagatgagaacatgaagcggggtccttttcttttcttgtatagcatatcggtcatttacatagtacattcgaaatggtatggtactactgccatattcaaatagatggttccaatatgtacagtcaaatattaaaatctaaaataatcaaagataaaaaaaaacattatgctttgatgtctgaaaactatatcgatagatttgtcataaggactcttccattttgttatacactttttaaataaataatgaaaaaacttgtgcattgaaaattatacggatgttatataggaagaactcactcgagtgttaaaaaaaggacagacccctctaaacaacatggattgaactagggttcagcaaaccattttaggtggggttaccgccaccttcatgataagacgattatcgcggtaaccgtgtggttaccgtgaaaaccgtgttgttaccgcgaggttgaccgtggtatcacaaactacgtgataacagcgcaataaccacactgttttgcaaaccctgaattgaacccatcgtgttaccccttcacattctccctctacttgtaaactatgtttatctaaactataaatttatatatacttatgcggtaaatttcaaatattacatcataaattagaaattccaccctgtaaatttttcagtaatcttatattagtgtttacatgtctatttaagtttcataccgtatattatcctatttggattttagtctcgatatatatccaaccagttttttcttcccaaagtccgtctccagcactctcaatatcggtgatttgctgaacaccttatccattagtcaaatcaacatgcatgcatgcctctcactctcactcactcaccaacaacaggtttgtgatgggccgcagggctgaagacagggacacaaaggctcatgaaaataaagtaacagtagttcgtcaaaaacaggggaaaacgcgtgtgctgtacacgagcatcctccacgtacgacaatcaaagacccaaaaaaagaaaaactgacattgaataaaacatctgtgaccccatgattatacgaaaaacgttatttttttacaaggctgcaggaat

SEQ ID NO: 21533 - DNA, 1741 bp, Oryza sativa
agtttggaccgctttttattaccaaagttttccttctgattatcaataattaatccttttagttttaattgctctgttgcactttggacttggaccagcataatcctcttctccagctgcatctagactctcctctggtaaaggacggccttcgtgtaagtgggaaagttcaccaatgtgctaaggtcattgatgagctcgactatgttgggtggttcaaactacaataatgataaatagttccgctaaagggtagaacatagtgaaacttcggatataaaagatgaccaaaacataattaacttctcttttcttatttatatatagaatttagatttgaattttttttctttcgaaatagtaaatgctaatatattatgcatgggcacattttctttagaatcttccaaacaaatttatattataattgacattagtggaatacgaggggatgcatcctatctacatataaacatctttgtatccatatagaaccgtactttcaatcactggagaatgaggaatttaattcaaaaaaatctacatattattttgagatttttgtcctgccataaacaaggactggattgaaaaatataaaattttgattcttgtgtgaaactcatacaaatataaaattactgaactaccgtgtctctcataagttttatcagcaatacaagtttacctttacaactttaattacaagaaaatagtaaaacatcacatgacagctagaacagacaagattatggtaatgtacctagttaattctaaaccgcttcctaaccacatagttaattgtatatatgccgcaggtggggggaaagagctgcacatcattagctgtgcttgcaaagttaggcgtaaatcagttacaagatcgagtagctgcatgcatacatgaaaaaaaaattaaccagataaagtagtcacacgaaggaattcccatttcttcccctctagcattgagaaagcttacatgtgataaacacaacgcaaattaattgaagaagcccttgcaatctcacgacagcgatgataacgacaaggcacaaattaatgccttttatttggtactttttcctgatggatctgaattggctggtgggcgtgaaagttacacggatcaacgacgaagaaaaggtggatcactagtgacatgctaacgttgccgatgaagcaaagggagcatcacacgcgtctaccgccagttggctctccatgtctataaatctcctagcctctccctgccatttctgcaacacacctaactaccacagcttgtgaactatcaagagtgagtagtagagtttgcagtgacaacgagatgaggagatcaatcctctcactgtgcttccatttggcgcttgtcattgcattggcagcaaatgttcctgacattgccaatggacgcgtgattgaagctaaatctgatccaaagccagcagatcccaagcctaaacctgacccaacaccaaaaccacaaccagagacaaagcccagtccacagcctaaccctcaacctaacccacagccagatccaaaaccatcaccgcagcctgatccaaaacctacaccacagcctgaaccaaaacaagatcctcaaccaaacccacagccggatccaaaacaatcgccgcagcctgacccaaaacctacaccacagcctaacccaaaacaagatcctcaaccgaacccacaacctgacccaaaaccaacgctgcaacctaacccaaaa

SEQ ID NO: 21534 - DNA, 13571 bp, Oryza sativa
cgatcagctagcttcttgcttctgatccatacagaagattgtattcctttcttgatgattacttattgggttgtgagtgcatgaaccacatcgcaactcaatttctcgtacatcagtgcatgccgctttctcacaaaggacaaaggaacacttatttgatcaccaatcaaatagaacgtaacttcggctcatcccagaacatcacaatcgaagaacatgactacggctcatataggatctggatcgccatccagtgcatttggaacttctttttaataataaaaatgatttacatctctgacttctaccaaaaaataagtagccataaatttgtttaacaaataaaaaagagtgtaaggcgacaaacccccaactctcttatgtctcggcttctcatctctcctaaaagaggggagaaatgacgaagatacaatataggtaaaagttagtggctcaatgtgcagttcacttaattatagtataccagtgtagcactgtatattgaacgcttacaatctagtccattttccatgaaaacagacaaatgagatagcatgtaggtgatcctgatgcacttggatgtctaatatgagccattcattccaactatcaaatatttatttagattgactaacgttccgttgaaggctacatatagacaaagaaatgtaacattccataaagcagtacaatgttggcacgtatttattggatgttgtatgtaacatttgtacactaacgtggcaggcattaattacttaacacagtgtgcaacatttgaacaagagagtgtgacacctgaaaatctgtgcagcatctacaaatcaattgatggaatatcaaaaaggagtgaaaacattcaaattcaacaagtgcaacaaaatttaatagagtgtaaggaagatgggctaggggtaagtggtgagaagtggaaaagatgtcaaacaaagtgggagtagcatggccaattattatcatggcgacaggcattgtaaacctacttttcctacctaggcattgtaaacctacttttcctacctccagatgaggatgccttaggacaaacattccaaagtaactggaatggcaactgatgtgatcttgtgtcaaagtagagctgtagagaggccatgcacagggcacttgacactgagcatcaccgtcattgaagggtgaatcattatcaagatctggtgcttagcggcgataatgaaggccaccttctgttccaggcaacacagccactgtacatgcatagcacaatgcatgtctacataaggtcaccttttgtcctagccaacacagcactgtacatgcatggcacaatgcaagtctgcatatccattcccacaagtgtccaatcgaggaaccgtgtgcatggtggtgtctgaaaattagttgttgacggaatgactagatcaaagaaaagcatgcatagtttagtagttgtcttaaaaaaggatgttcatttagcagagatgggccatgcagtgccaatgggctgtcctgcccatgggatgcccgtcccgtagctctatagtcaattagaagatatatcaagtattgttgcaggaattcttagtcccatatagaaatatgtaattttgacttttgagtaaacaatataaagattaaatttgttgggattgagtaagcctatgaaaaataaattattagccattctacaaattacaatatttgccatctaaatagatactttattatgacataagtagatgagatcatttgtaggtaattgaacagtatgttggaggtacttattgttcttggtatgcctctttagtaagatttgcaggtaggtttgctagtccatttgtaccatgatgctcagccgttgtcttgggatgtctttacccttatacttttttgtcgaataaggtaaactattgattttataacatttttcggtctcactcaactgcatatgtgttctaaaaatctcatcaaaacaactgtgagaacagttatatatgttaacacttagataggaaaatagcaaagaaggcaaggcatgagagcagagtagtacaggtaagaacattgaacaaatatgaaattagaaaaatattggtcaaaagaatcactaaccaaaaaaaaacatagtccagctatgatgctctctacttgtagtattattctactagtagaatcaatctgaaccgttgattcaaagggcatatcagtacttaacaaacgcagtcaatttatccattctttgattaaaaaataattattcattcatcataattgtatcgcacgtcaccgggcacatccctggtctcgctcggcaaaacctcccgcaggtggcgatctacacatatggctgctctcacagacctcttcttttcccccttctcctcctctgtccatcgtgtcatttcattgccgtgcatgcatgcaggagttctgcctttgatctatagcaacacctttggtgtccgccttggaggccgtcaagtcctctactccacggccatcagcaaccttttcaattgtttgtccattggtcatctccatgccgtctttgctggctggcctgctaccggcgccttggcgtcggtgccaattctcttgttgatccatggtgtagagcgccagcagcacagtgaccaggaagttccgatccatgtattttgtctgctctcaaatatcagatgttaggcatgtatcatgttggtgatcagtacatatttgtccctgaagttcaaaataaacttattctaatatttagctgtattgttgtttgagtaacgatcagataagctcgcaactaccgacttgaagccatttaattggccctgccagtgaccatgcatagagatgccggcgtggcgaccgaacctggcgatggcatggtgtcacgcccggaatttctatccaaaattccaaacgcttacatgtgtgtaaaccctcgtccaggaatcagccgaagcacacaataacaaattgataatagagtacaattattactctaattaataagcgaatagaatgtcattacagaggtagatagttcctctcaatcaataaagttctaagcagcggaaaataaaaacagcgcaggcgactcctctccacaggcagcttgaccagggctacgcctaatcatccactccatcagcatcactatagaactcctcctctgatgaatgattgcaaggtgagtatatgacatactcagcaagccacgcagcaaatatgcaagtgcacaggataacaaagaatggcataatatggtctcatttgcataaacatcatttaataaatatttcagaatttaataaaacggttaaataataattaaacaatattaatccaacgctatacaacaaaccctgttgcataggcccaacccttatgaacaaccaatcccggctgcacagttctatctccaaaccaggaattaaccattccaaaccaggagctaaacaagttattaacagcatcatttaatatagtgagagatgtgaaactaatcacgaaagacattgttagacccgcccataaccgcgggcacggctattcgaatagttttactctggccagagatgtaccactgtacccacaagacacaacctcaacatcatgtcaaccatgcgtcgcgatacttgacaagtacccgaatagagattgtgacaataccccctatataatacaattcaaagcagtacaccgttcccggatcataatcacccccttataaacaaggtatggactccccagtgacccccgtgggcttatctccgccacttcacagtctggtactctactatgaatcatactatacagaaagtaaagccgttgcccacgctggcttgtggttggcacggtaaatgtttcacaaccgaaaatcgtgaaccggtccttaattgtcatgagcacaaccatcaaaaccatatgctcacaacccaccattatcaggttttagttgacaaattaattaattatccaatcatgattaaccatcatgagctatcattaagccatcattaaataatagtgaagcataagttatcacaatagtgtgctaatgtttctaagcatggctaagcaattatgtctaatatctagctgaaccattatataaagctcaactagtctaattataataacccaagaaatcaaagaataaagtaatcaagaacaaaagggctataacaaacaataagtttattccacccaatgacattcgaaaataaatgcaatagttgaatagaaacaatagctttaaacgggatcaacatgctcaaagggttgtttgggatctgtgtaacttgccttgctggccttggaattcctcaaaatcttctcctgcaagatcggactctccgggaacgtcggaatctaaggagaaaagaacaaaatcaccaaaacagcacataaataagcatgaacagtatatgtggatatttttaacatgtagatctcaattttagaaaaatttagagacttgaaccaactaaatccgagctaagatgaattagttatgaattttcaaagattaaatcggattaaatcatttatagatattttaatggaattatgacgcaattatgaattatttttgaagaggaaaaagaggattattgcgtcagcatctagggttcacggtggaccgggtgcacggcggcggctcacggaaacgaacggtcgggatctatcgatccaaaatgaacggccgagatctatcggtccacggccggtctacggcggacggcaacgatgacgtcggcgatgacgtcatcaccggcgatggcttggacggcacaagctcaccggcgaacgacggcacgacggcgcgaacagaaaacacctaaacgatgcgggcgatgcggcgaactcaccggtgaccaaagcgacggcggaagatcaacggacggcgacggcgacgaggaagaaacggcggcgaccttcggattgacgatgacggcgatgttccggcggtcctcggcgaaaatggaggggcggacgagatcggcgacggcttgacgaccacgacggcgacctccccgagcggtgacgacgaccgaagcgacggcggcgcacggctggacctgcggcggcgacggcggcgctaggcggcatggcgctagggctctaccggcgacaagaggcgaaggcgagggtggcgacgggtagcggagggcctgggggtccttttataggggctagggggcggcggcgaaggcccacggcggccggcgacgggtagcggagggcctgggggtccttttataggggctagggggtggcggcgaaggcccacggcggccggcgacgggatggaaagtttagggttcggaggagagagatcgatccgaatcgaactcaaatccacggatttccaaagcgaattagccgatgattccaaaagggaaaaggtagaagagatctcggggatcctttcccctcaatcaattcgaccggagatggaaggatgcgatcgaattggaagggcggcggcggctagggttcggcgcggcagcggcgcgaggttgacgacgggtctaacaagcgggccccacctgtcagcgacggacgcgcgcacgcgcgggcggctcagcttgggccggcttgggccgagggagagagaacggtttgggccgactttcggcccaaagccaaaaggaagattttaaaacctttttcaatttaaattattcatgaaatgcaattccatttattaaaaatacttccttagcccaaataaatcccagaaaaatctaggaactatagaattaagcaaagtatttaataaaattttatctagacaacttttatattggaatttattatttaaaattagatcttctcttctaggcttttaaaataaattctaataattccaattaaacaacaatttatatatttgggatttttagggtgtgacacatggttagtggagaagatgtcagagacggcgtaccagggagtcccacccataactggcatgttggcgctgacactgagtttgttcacgtagtcaaagcggtgagtctggccgaggaccctgtgcacgttatcagtgagatcatagaacttgaagccgaggtcgaggtgagtgaggttgtcctcctcggtgatgccatagttgttgatgcgcgagttcctgtcattgatgggcacgacgttggccatgatgacaaacacgccagcgaactatatcctcatgcggacgtggtcatgctgttggtcacatcggtcttggtgatggtaaggccaagcatggcggtggagtctcagtgcgtaccaagcatgcctaggacgtcaacaggcacaccatcgaacgcgacttggattcgtcagtgttggtgtgggccccatgcgtcagcggttagaggcgacctgtgctgccaactaggccactttgcttgctggtccggcgcatgggcttggtcaggttaggttgggccagagggagagggaggaagggaggccggcaggaagaggcaaactggacttcgcgatagagaggaatgggccaaatttggtcaaagctttagaagggattttaattactttttcatttaattaatcactaaaaggacctatgtatttttaaaattagtaattgagctttgaaaacttcgagaaaattccagagagtataattaatcatggagaatttaataaaaattaaatccagccatattttatataggcaattttgattcccctatttacttcacttgttcattaatgtgcactttaatataaattctagaaataatttcttatataatttataaatccctaaaacgaaaatcagggtgtgacagcacctctagctaacgagcatgcgtcaacacgcctctttgaccgccacatcgacaaccgcaccctactagccaccttcgccacctgtcattactatgccaccgcctcgctcactatcgcgacatctacactgaatcgcacaccaccacctgtctcgcacgtctaaacttgacaggatccactataaataggcccgcaaatccttcaattggcctcacctccaagacttaaaggaccccattgtcctcctccatttgccgcctcatttccctctctctctcctctccaccgaccgccattgccaccacaacaaatccaccaccgacaaccttccctccggtgaactctcacccaaatttatccttccatccccctgactctcactgtaatgccctcaaccaaacctctcccaagcgtccccactgatagtttagtcgtcaacagacctaagctctctgccgctcatcgtctgccaccacctgctactctagacgaaatccaaaacactcgaccacttcactatcctctccttcccccacacccatgctccccttcctccagaaaactaccaatcaacgggacgcggccaaccaccccatgctccagccctggcctcacacatgcttgggctaggccacccacttatgggctggcctggaagggtagcccaattcagccccaacggctccgtagcactgattgagcaaatttaactctcaaaatgtttctaaaattgtgatagaccttgtggcactattagttactaataataatagtattttcattttagggctttgtgtggttttcgtttatttgcgcataatcgacatcatcggaaattattttggatgcggaatttcgaataacttgaagacgaagacatgatcaaaatcctcccagttaaaaaaatgctatgttcgagaattgcattgctagtgtgcatgataaacttgatcgacctcggtttgcatgatgaatcgaaggaccaatttacccatagttctattacaccggtataggatgttgatacccattgatgaaccctaagttccactcgacactcaaggctgttgtttggtccgatctttcagtgagttgatgataactatgatttgggagaaacgttgacgatccgaatacaaccgtacaagacgttgtgttgtgccttagcgatcaatacacctctccgtgggttgttgatcttgccggcgcagatcaaccttattcccgcaagcaaatcgaagaaacaagcaagaacaagataaagcactctgaattgcagataggaatgaatacacacgataagttggggtttcgaatacaagcagatggacggtatagctgacacgcgggctgcaaggaagtagcaatggctaaactttcatctaaacaaaattcgggaaacccagaaggggtacctagctatttaaggatgtgggagaacaatcaagagggtcctaggttcgtgcttcaccaacttggggcgcaccccacatgggccccacttgagccgaggtcccaaacgaagttacaagctcaaaggcccatgataggtgacgcaacactttgtttctgcaattgcggccaaaagagatggatttcggggatgaggctggatctgttggaaagaggactctgagagctttccatcaagtactcacgggccgaaaacagaggtcatatgcagattctgtggccatttgaaatcagcagtgtagcaggtggccgaatcggattccagcacttggaggacttgaacttgatatcgtgctgttcatccatgatgtcagaaacggttgtatccgtagtagccatggtcacatcatcctccccttcttcacagaaaaccgtcctcgatttttccatatggtgctcatcacgtggtcgatttaaaacaacatgtttcatccaatcaaaacaagacaaactcgaagtaatatgattagaaataacatgtctctctagcttgcaagttttatccacatgtacaggaggttctaaatccgaacatagataaactctatgcaccaaatatatttctctatcattatattcgccaaagatatgaaaaatagcattagttggacatagcaaataatatttagcaaataacttctccttcaaactatcaagctcacaaaaatcatcacactgaacatagcccaaagtatttaaagaagaagtcaattcacattcctctacttcattagcaatgtgaataacatgcttaaaatcatcgcataaagaactgacattagaaatagcatgttcattcactagttgtggcattgatataagtgaagcattatcacacaactcttttttatcacaaggaacatcaaacaaatcaacttgtgacaaaggaatctcaacagttggttccactaatggttgctctactatagcatgaaaagtggacaaattcaattcattaacaacacactcaccttgattaatttcagcaccaataagtttacctttgatgccctcttcagatgatggaggtgcctcgactttgagtgtgaacaatgggactgatggctctttcatgtctctctcctccttgttgcagttgttcacttcctgcaaaatattagtaataggaggtatgggcacaacttgtttcttgttcacatcctcaatttgtttttccacatggcaagaaagttgtaacaaatgagcaaaagagctataactttgacaaacaagcatgtcctgaatttctttattaagcccacgtaaaaacctcaactctgtagcttcttcgcactcatctaaactacaatgtaataaacaagcatgcatatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaaggtgtttccaatcattagaagcaagtttaattaaaacactagaggcacacataaccttttgtttctcagacaagacatgcttttgaaattcactatcaaccgctagctcccaattaatgtaagcatgaggatcatagtttccctcgaaataaggcagtgcagatttgatcttacctagaacatcgtcacttacctcgtaatcgtcatgttgatcactcctcatgtctcgacgaagatgtcgatgttgagcacagctatccccaattatcttgcgtatccctgccattgttagtagaaaagaagaaacatacacaaaaatatgtgagttcctattaactactaggtagtagcagctcaaaaatcacacactcaagcttttaaccaagctcttacaagatcttaccaatgcaagcggaatgatgacatacaccgactcaaccaagcaccctaatggaggttggatgtatcgatgccttggcaaacacttgctgtacggctgcaatcaaacctgtggaactctgggtaggcttaaatatgtagcaaaagaatagcaaatgttcaaatcagataatgcaaagttgaataattgttcaaagtcaagtaccgtgctgatcctaggctagaacgtactagagacgcgagcctagacacaaacgataccacaagatagcaccggaaacaactcaagcacactatgatatatccaagcgatccaacagataacaagtgattttctcttttccttttttttctgtctttctttcttcttttttttgtttctctcttttttttctctctcttttttgcggcttttcttttcttttagcacctttctgccttttctcacttttttttaatttcttttccagcaaaaacgactcaaggacctgaatgacagattacagggactcaaatgtaaatataaaaattatagggactcaaatgcaaaagaccaaaccaaaaattaggaccatacaaaaatggaatgctcccgtcccatagattccgttttagcaaacagatctccaatttggcattccaaaaattttcaccaaggtgtctagccactcacggtatgcattggaaccgagaggagagggagtcggagtcagggaacaacgccgacttctgtgcggtggaaaactgactatgccaagatggtaagttcggtcttagagggaaacaaaccgacccaatctaatctaatccgcaaacttcctccaataacctgatccgttatcctttctttctccttcctcgcgcaacagatcttcttccttgcgcacaacagaacagcatgcacggcacaacctcgggaccgagacaaccacacggcagaaaccctagatgcaactcaacaacaccaaaaccgaccgacagaaacttctgaaaactagaaaaatggaaccgtagcagcgagccgattccgttttcataggtcccgacgacaacagagacatggtggcggcgacgactgtggtacaaaacgtgactagaactcgaaactctaaatgaactagacgctaagaccaacaacacgacgtgacaatgcaacaaaaattcaacaaaacaaaaactgaatagaacaatgcaatggcacaaatgtggctaggtaacgtacggaatttttttggctattttctagttataggtcaatgaaaactcaccgagcaacaaaagctctgataccacctgatgaaccctgagttccactcgacactcaaggctgttgtttggtccgatctttcggtgagttgatgaaaactacgatttgggagaaacgttgacgatccgactacaaccgtacgagacgttgtgttgcgccttagcgatcaatacacctctccgtgggttgttgatcttgccggtgcagatcaaccttattcctacaatcaaatcgaagaaacaagcaagaacaagataaagcaatctgaattgcagataggaatgaatacacacgataagttggggtttcgaatacaagcagacggacgatctagtcgacacgcgcgctgcaaggaagtagcaatggctaaactttcatctaaacaaaacccgggaaacccagaaggggtacctagctatttaaggatgtgggagaatgacagggagggtcctagggtcgtgctccaccagcttggggcgcaccccacatgggccccacttgggccggggtcccaaacgaagttacaagctcaaaggcccatgataggtgacgcaacaccttgtttctgcaattgcggccaaaagagatggatttcggggatgaggctggatctgttggaaagaggactctgagagctttccatcaagtactcacgggccgaaaacagaggtcgtatgcaaattcggtggccatttgaaatcagcagtgtagcatgtggccgaatcagattccagcacttggaggacttgaacttgatatcgtgctgttcatccatgatgtgagcaacggttgtatccgtagtagccatggtcacatcacccctgatccttgtcgctccacactcatggtacgtcggcactaatgccctcgggcataggtaccgacaaacacagaagcaccctttatttgttgttatgaaaaaactggtttctacaactttgaaaacccaacacatggtttcaacgagtttgcaaaataaaagttgtttttgaaagccgcgatgcaaaatggccgcctttgtcgaagatgtaacctcataaaagggtataatctatctatatttatatttagttgccatgatgcatatctcagttgaccacgggtacctgcaattgtgtcttgggacgaataccggctacacggttccacaggagttggtacgtcctaatttccggtacgtcctaatttcctaggatgcaccctctctggtgtcaccattagtatcagggtgaggtgtgacacctattcctcatacttattccactaagggtatctctttccttgtggaggtgagatctaactttcacaaactttaccgcgacacaccgcaatccttggggttctcacaagcgactcctagtcaactaggagaccgcaatcaccaacaaaaaaaaatgcacccaaagcttgcttggaaatgaactctagtgctcgagaaataatatttgtgcccatacaagaaactcaactcaaatctacacacccaaaagccaaatcacaaagattagagtgcatttaagaggaagcaagagagctcaagaatggaaagttccaaactcacaaatccacaaagattggaaatgaagggctaaccttgtaaagggtttgggtggggatttaaataagcaacccctagatctgtccgttgggtggagattccaggcccacctcggataatctaacttctaggttgcacatttcgatctcagtgtcaggtccccaatagtcaaaaaactcgatccaaggtctttggaaaacactggaccgaatactccgatcgtaacatcagaaaatatgactttaaatcacaagccaaatagagaataaagtttggtaaaacttccaactctctgaggcatccaatagtctgactaagcatcggatatcccgatcacatcggatatcccgacaccaaatttggttcgaaacatagaactaagttcctcaaaaaaattaacactccaatgttcaatatgaggtcggatagtctgatgttgctcaagtgaaaaggcaagaacttttactttgaagtatgacttcaacgatcttggactccatggaaagcttatttcgagtgctattaaaacctatataaaacagggtaaattggaaccatgccattttaattttgtaaagtttgagatatgcca

SEQ ID NO: 21535 - DNA, 22866 bp, Oryza sativa
tgcaaaattataatggcatggttccaaatttacccaaaacatggtccaaaacctttaaaagatgttgaaaaacttgcaaagaaattaggtgtatgtgttatgacatgtgaaacaacctagagttggaattttagtttaggtttttcaactcacataaagataaatcattttgagcacttgagacaaaactaaccaaacacgcttacatccgtcttagtagtcgtcattccaatactcaatctggtctttataaaaataccgggacaggtaaaaggctaagaaaagggatgtttagcttcattataccttttccttgtacttctcttgagtttaactagataatggacatcactatctttaatcatcacttgacttgatatgcatcaacgcatgatgtaccatcacttttatttcttcaagccaattgatgcctttgaacttatggcatccatccaatgcctttttatcagtcactcttcatgtggatcaacacatgattcccatattctttctcttcatcttgaaacatatgtgatttgatctcacttgagcatcaataccatttttatttcttgggatttatttgtttaactcaacttaatgaaattgttggtcccaatgatcccgctatcaacctctacatgttgaccaaccaatcgcatgtaaaatgatatgaataaattgattaacttggattaaacatgtgctgatgtgcataacaagatatatgatatactcccccaacgtgttgcttctaccgtaccctcaattaggaaaatccccttctcttcacccccccctcccggaaccccaacccaaagtgctaacttgaagggcctaccagagttccctggagctagatgctcactaacgatgaatcatggagttcatcggagttgcataagaagatcacctaagtttggatgaggagtgggctcaccgggatgggaggaggaggagaggagagctcatggatctaggtactcagtatcattgcttgtgatggtgggggatcaagttgggacatagctacatagactagctggttccagtggcatcaaatctgataacaaatgaaaactggtagtgatggggcagttcggatggcccatcttgtaatagttgtgggcatccaatgtggtccaaatcaagggtggaaagctaagaggtggtaaactaaatggcattgaatgttaaggggtgagtgaatggggtatgttagataagcggaactgttgagatggtaatatgacttctcccaaattactatattttacacatccaaagatcattatagtatcaagaagtaatgtatacaaagtacagattgacttagagtattacacaaccatgagtatgttcttttttccgaccttagatacataatatacatcacattgctacttggttgatgagcaataaataagcaaaacttcttacacccaatcaaaaagcaaatccacatccaaattttgttaaaatgaaatatacaaatacattgtctgaataacatcaacaaaattgatgtatcttgtacaaccaattagttctaaataactcctaccagcgaagtggaaaactcttatagaagagaaaggacaattcatacatttcttacgtatttctccctacagcttgaggctcttgaggatcatagggagcccgtacttgggacgcagcgtgataacatcagtgggtgcatggacgtacttgggggacaaagtgaaggagaacctctgtaggatcatggcaatgacagccttggcctcgatcattgcaaagttctgcccaatgcatgacctcggtccgctggagaaggagagtagcgcgttggggtgcttcgctgccctcgtcaccccattctcgaacctctccggcctaaactcatccgcatcctccccccacacttccttgtcacggtgaattgttgcgatcgggatcatcaatagtgcaccctcaggcatcttgatgccgccgagctcaatatcagtgccaaccttcctccgtatgagtaagacagggctgtacagccttagggtctctaggaggaacatgttgaccatctttagcttgttgagcatgtcaccagtgggcatctcgtcaccacactccattgcaatctcctcccttagtttctcctaccaatctgggtgcgtgctcagtaggaacatggtctaggtgagcaagtgtgaggtggtgtcatgccctgcaaaaaagaaggtcttgcactcgtcgatgatctcatccatgcttagttgtgggtggctctccctgtgctccggcgcacacgcctccagcagcaacccaagtaggtcattcccatacccaactacatccttgttggcgtgcctggtcttgatgatgtccatgagcatgcccctcaccttcttgtcgagcgaccatgtcttgaagtttttcatggtcggaaggtagctgattcattttcaaaaaaaagcaccgatatattattttgtgttctttctaaatctatttgtatcgggataagttaataatgtgtgtacctaaaccctggaacttgaacagtgaggaaggtggagaaggcaagaaattggagctccctctgtgccaggaagacctgcttcccctctttgtagctgctaccaaacactgtgtgcgagatcacattggcagtgagctcctcgaaacgcctgcttagctcaatctcagcaagaccacccttcgcccctaactccgattcccactccgacatcatggaccgagagcagtcggacatggtcatcgtcatcatcttgagcttgtccatgttaaaggctgggtgaaccaccttgcggtggcgcttccactcatcgccgtcagtgagcacgagccccttgccaagtagacgcacagagtgagggttcgtcaggttcttggggtatatccccgttcgatctgacaatacgccatgtcacctaacaagaccaagtcaaactgccacgtaggcgctaaaccactctcaatactgccttaagaacaaatatgatctggttttgtaagttaagggacgtgctatatctggttctgcggttcaatgacgaatttctaacttggtgacaaattgagggatgtaaagtgcactttttatgcaaatgaaaccgccatcgttcttagcaggccgagctcatttagcccgtaaagcccaagatgctctcgttctcaccaacaagtctctctaggctctcagccaagtcaaccaaaccccgcagctcccaaagttttccaatggcctcctccgtcgtcaccctcaacgtcggcggcgaggtcttccagacaaccgtcgccacgctctcccgcgccggcgcctcctcccctctcgcctcgctcgccccgaccccggcctccgcgccgcacttcctcgaccgcgacccgcgcctcttcgcgaccctcctctccttcctccgccgcggccgcctcgcgccgacgtcgccggactcggatcccccctccccggcgctcctggccgaggcacgccacttcggggtcgagggcgcgctcctcgcctcgctgtcccccgcctccgccttctccccgctggccctgcggccctccgcgctgctcccgctcgccggccgcgtgcccccgtccgcggtggccgtgccgccctccccgcatccggcctctgtcttcgccgcgcatggcggggtcgtcactcggttcgacgccgcgctcgcctcgcgcggcagcgtgctcacgccgctccccgccgtggattccctcgtcgcggtgtcccctacactcgccctcgccggcgcacgcgatttcgcaggggtgcacctctgcctgtacccggatgatgcccccgccacggctcgcgaggtgctttcctggccaggatccccctccgccaccgtgctgtcgatggcagccacttctgccaccgaagtgtcatccccttggctgttcaccagcttcgagtcggcacggcggaactcgagcgctgtagtgacgtttgacatgaattccctctcacctgtggcagaaattggccggaaggaggtgtatggtgcggacgtggaggcagccatcccggcttccaggctcagctggcttggcaggcacaatctcctgctcgccgctgggtcgcactctggtcctgccggagtggtgggggacatttgcctctgggatgttcgggcgagcgcgactgtgccagtgtgggagttaagggagaaggaggactgcttcgcagacattgccgcatcagaggcactgtcatcgttgttcaaggtgggggcagcatccggtgaagtgttcatggctgacttgagaatgctcggtggtggtggcattagcattgaaccgtgggtgtgcattggagatgggcagagagcagcagctgcggcatctgcaggcagaaaggaggggaatggttgcaggattgagtgctatctcaattgggtatttgtggcgcgcggtggagaggttgaggtgtggacacaggtggaattggctcaagaagctggtgggaagaagttgatgaggaggaattgggtggggaatggaccatcctttgtgattgcaggcggaagtggccacgagagtgtgaaggagaagaccaagattgtgagctgggcctttggaggcagcaggatggcattggcgagggatgataagcggtccattgaggtgtgggatagtgcaccggcggctatatctttcaacccctaaccctgaatagaggaagaagactacaaatgtgcaatagtgtacgtcaatttccatttgctggtcttgttcatctataaatgttgccctgtgtcattatgtgttgtttctactagatactttgatccttaaatgcaattcaagaatatcattccattttagttgaacagagtctatggtttgtgaattgtgcctttgctccatgcataccaccagcagctgcaagccacctgcttctgctttactgcatctttaactgattctgattctcagagctgtggagaatttagtagttttggggggtttgggaacagtttttctaggcagaagctgcctgtaatctgtccaaaatgacttttatggactaaattgaccataaacaatgaattattgacactgttttaagtagctctcttccttcgtgtaactgaggtattgaaccagttttaagtagcttctaaaaaccagcactagattcatctagcatcatatatggtcatttgatttaggatctctagaagctcatcacatttgtagcatgacttgagaatctgttacaacacgcattgcagttttctgttttcagaagaggacttgatacatgcttaatcctctgcacagtggtgtccttttagattgttaaatgagcgcatgctatgtagtgcgaatgtacctacatggcatcataagaacaatttaatcataaaacattccatttctagtttttttttattggtatttggttcgtgaattaacagatcccaagatttgatatttgcaaccagctccaacaaaagctatcgaaattgacctcttaagtaaaaataaagatctggagttccatatatagaatattatgtttgttgactgcttgtaatttatatcaaaacctactttaccatcaaatcatttgattgtttaaatatttagtattttgctttctcttgtacatattcagtatgatgtttttctgcccttttcttcactaaccattaccttaaggccctattcggagcaaagaattatggaaaaattattccaacggaaaattcatgtagagaacctttggattgtttcaggtatgttataatatacaaaattttcatttgaatcttttagggactcttggaatatgagctttaaaagatgtaggactaaaataccagtatgccatgccatttcaaagtatatgaatattagtggattgttcatgggaaataaaacatcagaatactggtcgagaacgtttattaacagtatggagagagaaagaaggtctgtgtattgggcttcctaaaaaaaatggcatatataaagagaactctaattagagtaacactaagttaatggcatagcaggaattaattttgatttaattagataaacacagtcacatatctagcttgtgcttgccacctcgattctcggttgactggccactcatgctgaagtagcctgggtagctccgcaaccacttgttcgctgcacacccaatgtctctacatcaggagaagattttcttgtgttagttcgtgcgagcttgttaggtttttgaattatgcatttgtcagtaagttcaattcatggcatcttctgaagtttatgaattcttcattttagctcaatttcaccttggatggagcaagttgggatcttcaggtggtatcataggttactgcccctctacgcaccgccaccgcgaaaccatgacaaagttcccgtcacccattagtcctagtgggatctcgtgtcattctagaactgaagttcgcaagggcgatactttggtcagatatctaaacgactgaaccagaaacctccagtgcagatctgaattttgaagccgaaacttcttacctgaacaacagcacattgtaggcccattagatgttgctttgcaaagttctacaagttgcaaaatgattattttgagtaatagcatatgcactactgaaataatgatagtagagcaatatatgaattggcattaacactccagatattatgcagtaaatcaggcaacaggatcagccgattttaatgttaagaaatattatataccttatgaattcagatgcgattttgagattctttgagagattgctccatcactcttatatggttaatattcttaaccttcttgggatcgctcctatacccgaagaacatggtacattgttatatgtgttccttaatccctttttatgcctttacccttgagaatcgcattttaattttatccaatgcgagtagataatttgtggcacagcccaagttattagaagaatcggaggtatttacccgagacttttggacatctgccatttgacattgcaaagcaccaaggtgacttgatcattcctgctaaacattgactgaatcagcattagacaggaagcgataaacaagaaatttcataagctgttatatcatccttgttgaattgttgaggtttaccttgatagcctgacccctgcaatagatttaatgtcaaatgtataataatataagcaaaagaattctacttaagctcaccaattctttgctctactgaatccatcaagaacaaattggaatcagggaccaaagaaaggatttaccaaatcaagctggtgaaagaaaggagcaattaattaggatggacaaccgatttctactttatatttaccctatttacagcatccaatatggtaaagaaaaaaatttgaatcagctttaacttttttcgatccccattatttttaccggaacaacattatgctgatgatctatccaatctttcgattttcgttacacgattacataaggattgtgtgcatgcttacacgtatacgctaacagaatgggatcctatttatgtgtatatatagcaagctggaagaccgcccgggagcgtatataagctgtggcaactatcacaggaaacagaacaactccattcaggttgcaggagaagccaggacgagaatccatggccatgggcgacttcctaccggcctccaccgccgctgccttcttcgtcctcttgctcggtgtcaatggtaatcctatctaccagaaaatctatctgcaaatagtccttttcagtctgatggatctactggtcacttgtgtttctatagtagtaatatatatagttgaatggtttgccgaatcgccgtgaaatatgtgtccaaatgggccatgtatgtagaaatcctgataccggcatgggcgtgagatgcggtcctggacaacttgcttccgtgcttgcgcatggctgccctgttcattcgcatctcaggaacttcatacttggaaacggtccgttttttgtgtttgcctcttcttgatgccagaaagattctgagtaggttttgaaaacaaagtgtttctcaaaacttaaggctggttctcaaaacgacatcctgtcttttagttactcgtaatgattagagcaagtttaatagtagagctaactattgactattaggctgtgttctttcctcaaggttcccaacctcacatctctcgtttttcgcacacatacttcacaaactgttaaatggtgcgttttttgcaataaaaattccatacaaaaattgttgtaaaaaaatcatataaatcattttttaattttttaagctaatacttaattaatcattcgttaatttgtcgctatctttttgctcaaagaaatacagtcttagcctatgttagagttaacttgtataataggctaactatgaggttggctctatttttcctctcatatctctttctttcaatatgagtttaatataaatatcttgaagaatgtgtagaactaactcttgtatgagagtaaacactcctcgcttttctttctctttctttcacataagcttataattagcttatagcccactattatccttgctttcacaggtcgatgaacctacaatgattccctttattgttgactcgctgagtgttattcgcataatttttatttttcagttatcgagtgtataagcgcatgaattttttagttctttaatattgcatccaatctactcataattgacatgattataagacgtatggacgctctactcctgttttttttttttggacttccatggttcatgcttttcatgcacgtccaaaatccaaacgtgcacacacagtgatcgcactcgttccaaaacatacacgcacagtgatcactgtccctgcctctcttgatttgtttgttttcgtgctctttgctacgagtatgagataatctttgttgtacataagcgggcagccatatgtgtttcttcttcttgagatgatttgcttcttccctctgttttgcttccgatgactgtcaacccttttagtgcctatcaaaaccaatagtcacattgtaaaatcgtaactcatgcgtgaccatatacaagcatctataaaagggtattattttattcaagaaaatgaaatatgtaagtttgataaaagagcaaaatgaaatataagtatgcttgcataatcagcattcacaccatacgcatgcccgggagcatatcacgtgcagttgtgcactaacaaatgtcataaaaagatcttaaaaaaactatatatgtgtacttctaatattaccccacctatatatgaaattccaacttcaaattcgtaacgcatagggaacagaaaagagagaaatctaacaaatatatttactcttgaaattatcagattttttattgctgaaataaaataaatttgaaattgggattttatatataggttaagtaagattagaagtatatgtacatatttttaagtttttttggcatttgttttttttaggggactgctaataactctattcaagccacgttaagattcttacaatcatcctcaagaaaagataaaatgaaaaccggagcgcaggttaacaactgcaccttcctttttggcatttgttagttggtgtgatttgtgcaacgagtgtatccaaaacttttttgcgcatagtatatgttcctcgcgtgccgacactggctgtagctaggtagcatgtaccacaagcatgtgctgttccccttccagccaggataggtaattaaggtaagaaattcagctggagcccaggatcatgcaaataaccagtagtggttcatgacaaccaaactcaccatttttttaaaaaaaaatcacttgttaagtcctaaaaattgatgtatcaagatttccaacagtggattgattggaatttcgacacattattgcgaatgacttcatcaggtgcagcggccgtcaacttcacgttccatttccataacaactgcccggagaccgtctggccagcggcgctgtcctcggcgggccgcccgccgttcccgacgaccggcttcgcgctgccgccgggcgcctccctctccgtcgccggcgtcacagccacgtggtcgggccgggtgtggggacgccaccggtgcgccacgggcggcggccgcttctcctgcgagtccggcgactgcgggacggggcaggtcgcgtgcaacggcgccggcggggcgccgccggccaccctcgccgagttcaccctcggcggcggcggaggcggcgccggcgccctcagcgacttctacgacgtcagcaacgtcgacggcttcaacctgccggtcgaggtgcgcccggagctgttggagcggcggcaggagggcgccgccgccgcgctgtgccggacgacggcgtgccctgcggacatcaaccgcgtgtgcccgagcgagctggcggtgcgagcggcagatcgcggcggtgcggcggcgtcggcggtggtggcgtgcaagagcgcgtgcctggcgttcgggacggacgagcagtgctgccgcgggcggttcgcgtcgccggacaagtgcgctccgagcgagtactcgaggctgttcaaggcgcagtgcccgcaggcgtacagctacgcgttcgacgaccggagcagcaccttcacctgcgccaacgccaccggctaccgcatcaccttttgccccgccgccgccgccaaaaactaactaatttagcagcctgcactgcaggccggcgatcgatcactcaaccgattgattagtactggaaggaacttgaattcttagaaagacggtgtagtcatgacgtatacatgtatgtttcggagcatctctcaagtttcgatcattatttggaaccttccatgggaataaaatgaatacaattttagcatctgattatgtagaatgcaaatgcgtggcataatcaattgcctaggtggtctctgacgtcctctaacgcggtaacacctgaagagaagggatgcaggtcctctgcagtactgctcactgacatgtgggccccaccccctcgggcccacatgtcagctgcacatgcagtactgcagaggatctcaattggaagagaagtggtagaagcgaggatcaaggatcttcattcttgctaacccgagttcgaaccagcaaggaaaccaaactcactagaggaggaagaatagggggaccgggcctaatcggcgcctgggcacacgcccttgccccttctactcctctagtcctgtcccaaaactgaaaataaaaaaccgaccaaaagaaaaaaaaagatccaccccacccggcgcctctccctctttctcttcctcacgcgccgcccttccccaccgctttaagtggcgacggcgccggtccccttctcggcgctccctcggcgctccccccaccccccccccccccgcggctccctcccttcctttcttctattggctaatccctaacattattttcctgatttttggttttttttaataaatcacaaattcaacaatgttgaattcaaatttacttttgtgtttgccccatgtgccggaccaatattgagatgaaaattggtttcacctaaggatagaaatgctattaatttttctctgggtaagaatttgttggttcaccacctagagtactttgacctatttgtcatgacatgtaggacacgtataatccacatatttagtgatggtgtgtacatgtatatatcactagctctcccactgttggcaaatgcacaatgacaataggtacaatccggtaatatatgttattattttagcagtaatcatttttcatgcattaattggttgatgtatgcattgcccatgtgccggaccaaaattattgagatgaaaattcgttttcaccttgcacaatgcattttccttgtaggttcttattggtcacacggtgacatattttttgggggcaactttctatgtgttgctagtggtaacggtactctatttggcacctcttctctagaaaatccacttcttgcaacaagagaggatcaacaatgaaatgtgagtgttgataaactaaccatgttttttttacaggatagtaatgcctttttattaaagttgtgtagtacaatttcttttagaaacaaatgtttcttgataactatgaactttggtgtaagttttaatagctatgggtatggatgtcatcatatttggtatagaggtcacaatattttgttatttttgtacatgaagttatgcatggtgcctgacttatgttttctataacatggttactcagttacaattacatgtgtctttgcccctgcattaacacaacctatacgtagtttagatgtttttgcaataacacaaaccttactttgtagtaacatattttattttttgcagcaactcatctatgtgcttatctatttttcatgcaatgggttcagttgttaaagatggcaagcccttgaagttagtaaaggttgtgaacagagatggtgataacttggaggtttcttttgacccaacccaaactcggcctactgtgcttgcaacggaatgggagaggagggtgagccagtagcagtagcgatgggagggggagaggagagtgacgcagtgacagtggtgatggaagggaaagaggagaggcaaccacctgcataagtaaaaggtcaaaagaaatcacagcatccattgcgttatagaaacaagcaaacttgtaaaagaggaagggtcaagctcaagaagaagacaataactttatggaaacagcttgtcaggtgcctataagtttcttttttttcagcatacgatttgttttctgcaataactacaccatatttttgctaaaggaaaaagtacgaattaccccctcgaactatcgcggtcatctgaattacccccctgaaccacaaaaccggacattcttcacccccaactatgtaaaccggacgaattaccccctcgacccaatccacggtggttttggtctacgtggcgtacacgtggcagtccagtcactaatagtagcaaccttccccttcccctttgaaacaaagtagcatgtgatttccctacacctcagctacatgaaagtatagataaaaaaaaagattagtgtcacagccagccactatccaaccaaaagaaaaggagagtgtaaaaaaaacaaagttacatttaatttccgaaaagagatagagccatcttatttttgttgatttcgtcagattctcaattttgtcaataagattggagttgaaaaattgtgagcgtggtgtctcggtgttcgtgatcatagacttgcacaacaggttgtcaaggtaatacacctacaaacaaaaaaaagcacaaaatgtttgttactacaaagtaaactacattgttactacataacatatctaagtattgctacagtgttacttcaagcaagcaagcaaaaatattagaatgtgataacaaattgaccgtacacaagaaagaaatgaatgttttaagttactgcaaattaaggtggatgttactgcaagctaatagatgtgatactgcaaataaataagcattaaggttgccatgaaaagatgatgaaaattaccacaaggaaagcagtgcagccgtaaacaatactcctcttgccactcttccgcctttgtagagggttatgtctttgtactgctctaagtctttgctcaccatgttgactacatttcctgtgatgtctgtgctctagtctagagccaacaacttgctaaacaggatcatcataatacactgcattgtgaaattgtcagtccccccccccttcgttaatcctatccagaatggataaactagaaattttctctttccttccaagacaaaattcttccttgataggacccaatggagtagtgtcagacgctattggtagatcaaagtgaccattctgtagccccatcacacaatgcacaacataaggagtcactggtaacttcccacaaccaccatgatcaagacacatagagtagggtcaagacaattcattagatattcaatgagttccctggatcaaataccattcatccgaaacttgaaaacccaatcaaaacccaaatcatgcaatctatccctctgaggtggcttcaacaaactaaccttttcaaggatggaattagactgtcatctagtggtcacagaaaaatgataacgcttcttgactgcttgcacctccttagtcaacttatgctttgaagcaaccttctttttaggaccttgcattgcttctgtcttcctagtctgagctacctttcgcttgatctatagcaaaaggacaagagaaaaacaacaagttaacatgatgtgcatatcatgcaaaaaaacataatgccctgttcttttctccaacaaaagttggttaaacttttggatactcgtggtacgcttttcaaactgctaaacggtatatatttcgtgcgaaaactttctatatgaatatagaaatttgttttaaaatataagattaatccattttttaagtttgtaataattaaaacttaattaatcacatgttattaccaccccgttttgtgtgaaacacttaatctttatcttcatcttcatcttcaggagattcaaaagaccacctctttttaggaccttgcattgaatatgtcttagcaaaaggacaagagaaaaacaacaagtcaacatgatgtgcatgtcatgctaaaaaacatgatgtgctaaagaggaccgcttgcataatattatcaccataatataaatcgatgatgtggcctaccaccacccacacgccccttcctccctctctctctctccaccgccccaacctctctccctcctcccacctcatctccaccgccctaggctcttctctccgcctctctcacacctactccctcctctcggccgccggctaccgtcgcctcctccactgctcccctacctactcctgcgtttctcggctctgccattcccccacccacccatgcgcctctccctcctcttcctcagcaggcacatgaggaggagactgtgacggtgacgatggccacggtaatgactatgacggtgacgcgaggtgcgcaggcggcggttccatccgccggaggtccacgggcagcagatccggctgcgggaggggtagcggtccttggcgatggcggctgtcggtacgatgctcaatctgcttcggactcggactctgtcggtctgaccgggcacatgcctgtggtcagaccagccctactagccgatcagactagccacacaactgtggtctgaccggccccatgcagaaaaacccaacgcttttcaaactttgatagtttttccctatttcgttcaaaggtgtcaattttggtgtaaacatttggtgatgtccgcaaaggtgagaacaaccacggctcggtgatggctaccacgacctcgaccacgcgtagctgtgacgaggatgtgctgcttcctgttgcttagtgatgaccgcgacggtgttttgctgtttcccattgatgcttgctactgctgtgttgattcttgtgttcatgtacttcgatgtttgctgctgttgtgttgatggagtattgctgatgctaatgcttgctactactgtggaagtacattttcttcttttttttttgtgaaaatacatcttaactggcaggtgacttaggggcccgctggcaggtctcttaatacctccatcggtgaaaattggtctttgcaagcagttgcgagtccgctagcgaaaattgacgattttctaaggcctttagttgcacgcggctaactaagccgccactgagaaccagttttggtcgccaacaaaaccaattttgtagtagtgtctcttgttgatagacttctagcaatacctaaaaatttgttgtgtgtattcgttgccaccataatttaaataatgttacgtgaagatatatatcaaccactccacgcatgtgattcgatgtcgatgacatgcgcaatgcctgtataaacttcaaaacgttaattttctctccttttttttttctgaaaccgaccttttcccttttccgttattaaacaaatccatgttttggggattccttttctttttctttttttccctttttttgcaaaatgctactgatctatcaaaagaaccatgatgccatatgcgatataaattttttaactaacggaaaaccactttgcacagccgaacgacacgcactttggcatgtgtggaatggggattatgaaagttttctttttattttttttggaaggaaggggattatgaaagctagtagtatcattcttaccatttgcatttgcacagagattttgtcgttttccgttatcatatttttaaactgttaaatggtgtattcattaaaattttttctataaaatattgttttaaaaaaaatcaaacgaacctttagtaaagtttgtaataattaacacataattatttatatgctaatcttatcttattttacatgccgccgaaaagcttaaccaccatgaacatttaaactagcccttaatcaagtcatatatccaacttctgaattacgtcctgtggaaaagggacaatagctcatttgaccctactttagagtttaactattaatttgaccctacctttttaagtttactcatttggtcctgtttttcaatatcgaagttgtcatttgatcctatttttgctacatcgtgagtgtttcatttaaaaaaaaaggaaaaaacatacaagcccaagtgactaaaatgcccttgaatacatcaaccctatcctctactactcatttgttcattccttatcctctctctctcctctctctctcagcagagcacaaagggcaggaggggagcgacggctcaacgacgactacggaggggcggcggcaacggggcagcgtcggcttggcgatgaggagggccgccgctagcggctgcggcagcagctcagcggtggctgtgagaggcggcgttggcacagtgacgaggaggaccaccgatgcctgctgtggaggggcggcgttggctcagtgatgaggaccatcggtgccctgtgaacttgccacccatggtgtctaactcgagctcgctcgaagctgcccgtgccgtctccgccacaacccacgagctcgcttttcacccacaatgaggaggaaggtgcagcatctcgccgatttgtagcgcggtgagaagagaggtgcggcgattcgcccggcgctcgacgcgaagaagaaagggtacggttcatttcttctgcacaaaattggaccaaaggagaaaaataactttgggataataaggtcaaataagtaagggtaaaaatggtattttaggcttttttttaacatcgttaaatgtccttaacagaaaaagggtcggaatgtagttttgattttgaaagggagggtcaagtgagcaaagtaacgagtaacgagaacagggttgttaaatcgatagttagatctccaaatagggctaatgtgcaattctccctagggaaaaatagggtgctaaacacgctgtcacacctcatatacagtacatatcgtaacggtaatgcatgcttgaatagctgacgttcggcttgtgtttcaattaagaataccgacagctgacgtgccagggttcaagtcttcgttttgagctggcaggagtagcaaagaacctagcaaccataccgccgcgctggccggaccagccgtacgccgccaccggctgcggctcatgcgcggttccgctctctgctcttggtctcgagtctcgacagcgacccggttggtcaaccacttccacgccaagtcgaaaccaccccccacccgcaccatcctcaccgcccgtccgcgccgtgcacgctcccagatcatgccacgtgggtgggccccacccccacccgcgccgcacccaatggccgcctccctcttccccgacaagccttccgcctctctcctgcctcctccccacttcccttcccgcaccgtggtctcctcctcctcctcctctccacccgcatccgtggctccggttgcgctgctcgggagggagggagggttactaggaggttgctggagcggccgatgagaggggccagcggcggcggcgagggattcgtcggcgcctcttccggtgattcccctctccccttccccttgtttatcgcttctccgtgccgttgcccaggtgcgaaggcttctgggaacttttactgctgtgttcgtgctgcttcgtttgtttcggacagtttcatagtctcattctctgctgtttcgtcctgcgccgtgtcggtgcgcttgcgctgcggtatggtccctgcggcctggttagggtttggtgtcgaggtggtcgggggagtcttagggagggcggcattgttgtatggaaagctgggggttcggcgatgattccggagcgcccgttagggtttatgcgagcttggtgcttctttttcgcgaatttttgttctactgtattaataattctgtcagtaagagaaacttagcaacctttgttttgctttcttgtgtttgggtgtaattccattttttgggaggaaagagacagggagaactgggcatatttggggaagtatggtgtttcctgccggtccccactcttttgactgaatagttgtggactttgacattcagttctcaggcttgaaagctcgtccattttattgattttctcttcttatattttctagtgctacaaaatgtggcacctgtaacctgttagttgtgataatggaatgaactagggaggttcctgctagtatttgtcgccaccgagtgtttgttctcttcaaattagttccttgtacacaaaatgtccttttgattatcatatgtgattccttgtacatttgattgcactacatgttttgcgacatgattttcatcctatcttgagtaatacacaaaaatgttggccagcaagattattataatgtgactattagaacttagaagcttgataagaaaaatggagatcaattgtaaagctataaaggacatgctgggttccactgatgttctggacttctggtgttatcaaaaagtgctccctgtgacctttgaagctgcattatttagtcaagtatttcttggatggtggaattttaattcattatgtaacttttttgataatggagacaatcctagtccctacattgagatgcatacggcttattgctttacgtaactgtgcaatactttgttgtagtttcaaacaatattagcctaccaaatgagggtactagccctagaggaacagataatgctgaatgttctgagacatcttcagacaggtcgaattcggaaagcataaaacctgaagaatgtgcaatgccatcttcaatatttgataagaagatttccataaaaaagaaggtaagtttatcttcacctgtgttagataattctattggggtctctttgctggtgcttgcatgatgacaacatgcaatttatgtggcgcttggcacaaatatcgcattttttctgttcgctgtacagatgacataatgaattattaattctcataattattgctattaagtcaactgtacaccgccatggagtcatggatatgcaatgtgatattcattttactgaaaaactggatcaccatggataagaatagtgcaatgtttcttattctgtgaacgatgttaatcaatactgcagtacagtattttggactgatatgccagtataaaaaaagctacaaaatatactctctccgtttcaggttataaaacgttttgactttggttaaagtccaactgctttaactttgaccaaatttatagagaaaagtagtaacattttcaacccaagacatatttattatgaaaatatatccaattattgatttgatgaatctaatttagtattataaatattactatatttgtctataaactgttcacatcaactggaagacaaggccttgcgagcttctgtttgtaatttctatctgtaatattgacatgtttcccaaattagccatgtacacctaatattcattcttttctgaaacgtgatgatgacatggaatgcttagagttatgataacattaactctgttgatttttaaggcataattttattttaaaaagtcttctagatcaaatttcgaccgttggtttgtctaaagtatttctttaatagctataaaaccaattttgtgtgaaagcattttcgaatacaaatctatatgtataacattcatacaataaaatatctcttcttaatgaaatagaaagcacagttctccttcgttttcgagaaaaaaaatacttctaaggtgatacttttcgatcttgtaaaattcaacagagggagtacatagttctcctgcatttttgagaaaaaaaaaacttctttggtgatacttttcgatcttgtaaaattcaacagagggagtacattacgacatcatgccctcttgtcaccaatgttctaaaaattggcattagtcggggctaggcagcgattcggtactagagacgtgcagtgattcggtacaagtctggacttttgtggtttatttatggaagcatggctataatggtttagttatgcgaaatcaggaaacatttctaagttaggtaggctagttaaccttggtatgcatttttgttgggccaattatctattatgagtttgctccatcttgattatgcaagacttggagccttcgtgtgaccatactagtcagaaacaacatctgaagttcatgctagatgccatagatcttccctgcttttatttggaacaataaaatgacacaaaacattttaccagtacaaactaatagctaaaatttatgccaagcaatgtaacttttgaatgtttaaactttctaattataattacagagatttagtgtttttagtattagttatctcaactgtttggttaacattcatagtgtcaaactccttgtttaacattcactcctttatgcactttaacaaatggcatattttctattcttctgatccttatgtcttcactgcagctcagattgttaagtcgaatggctatactgaaagatgatggaactgtagaagttgatatccccactaatgctgaggctgcatctcttgacctttcttcaaatgattactgtaatgaagcctttagtggggaaccattggcatcttcagatttccagcacagacctcctatgcaaattgttatgctcattgttggtactagaggagatgtgcagccttttatagctataggaaaacgattgcaggttggcatgctattcaatcctttttgataatctgtggctactgcttctattgactgttgcttttgcagtggtaccgtcaatacttggttttgattctagtccttacacagtagtgtgttgaactgtcagtagatttcctgctttcccagattagatgaaatgtttgatacatggaagtagataccatgtcagctcagagtttaaaattttcgttgacctgcttggtgcatgaaactgtgtggctaagttatgcaaacatgcaaggtagttattaagttcttgtattgtttatttttactaacaatttctgcttcatgtgaagtataattaataaattctattttaaaagctctatttggtgcattttcctctatattagcacaaacatgttgtcatggtttatgatttaacgtcaaaaatgcataataagtgagctatcacaaattgatgattttcataatgcattttattaattgtttatcggagttaagattttactcctgtggctaggtcctcttaagaatcttgtagaatattcttattgagctgccataattcttaggaataagtctgaacttgactcgagttccaaagacatcattaaccctcaaacatcaattgcacccctgaactttctcatgccagactcctaactcctgctgaaaccatctaattttcttccaacatggccatcttctcagcaatgctatatgtgcaggtgtaagaagtgggtcattttctcagttcatctgtagaagttatattgttttgtttctatcaatgttatttgaaactggtttcttttttcaagaaatccagaattcttgattcattcaaccaaagctaacaaaaacattctttccttttccagtttagcaacctcgacattaatttatcaaatgcagtctcctctcacaacttgtttcgtatgagcttcagctatcttgactctatgtgctatcaagcgagctcgttctttgttccccatcctcaaatttctgagtcatgttagtcaagaaaagttgattcaagaaggggtgtttctctttactttataccacatccaaagtgcaacccccagcctacaagttcagtcaaaacttcatatccagatatgcaaaaatcaaccatgaaattagtccatcactgcatcttaactcaaataccaaatcaaaaggaaaatttctgaacaaccctgcttacccctgacctcatgcatgttagacatctccagggatttaaattgctccatgagatccatattgatgtcttacatgctgcccttgccccatatgcagccgatgaaggcctgaggtccttgacctgccagagcttacgacttgctttgcctgattgaatctgttgaaacctcaacagttcgatgaatggtggctaggttttttggagcaatgtactttcccaactaagcttcacaactagccaccgccccctctcatgcctgcacgttttattcccatgccaatgtgaactttgcatcaaagtggatgaacagggtggccaggttgacagagtacctgattacgagatggttttaatgttcagtttatcagttattcatttggtatgaccatatgacagagttcagggggtggata

SEQ ID NO: 21536 - DNA, 1262 bp, Oryza sativa
  unsure (1)..(1262): unsure at all n locations
cttttttagaagagtatagattagaaaaaatataactcccatcttttattatgtttggtaatataagtagtatttacacttcttctctttataggatccagtaaagctaagacctctctgtgtcttgatgcataatgtaagaactcatgcttattgcaatctggttgaataaacaagcaattgcacttattttcacacttaaattaacaaaatgcataaatagcaaaacacaaaaacagaaataattttctgagattttagttacaaatttaactcatctttaatcttttatcatgctgagcatgaaacaagcaaagatttttctgatataaaacatattatcgtttctacagacagtttttttgtatgtaggaagtgcctccagtaaaaataataatttttttgaattcagataaaatttgttcaaattcaaatttgtcagaaaaaatcattcaatattttttcatttcgaaatgtaaaacctgtatctatctatgtcttcttgattatactggttgtagacaggtaaattgcataatgctaagtgctaattgttcacttccagttaaatgaaaagtttatcattcttctatgcacatcccataacaattacttctattgcagatctatggccatcgtgttagactggcaactcatgccaacttcaaggattttgttgtgacggctggcctggagttttatcccctaagcggagacccaaaacttcttgcaggatgtatgttaaatatcgtgctcaaatccatttttcagtttatagaacctgtttagtattggatctcgcataacagtacagattggtaatatgagcagacatggtgaagaataaagggttcttgcctgcaactccatcagaaatccctatccagcggaaggagattaaagagattatattctccttgcttcctgcttgcaaagatcccgatactgatantggtgctcctttcaatgtaaatgctataatagctaatcctgcagcgtacggtaatagttatttttacaatgtggtttgtcaattatttactttcgttgaatttgtgcttatattatgtctttaggataggacattcatcattgaccagtcagccagtggctattctctcatgctattggcgaaagctctgtggccagctggagaaattgaggaaactagattcttgtttcttcttgtatacctcctgtcatgacatgaaggagagtcctaccatttcattctacgagatgagctgaacaaactaactggc

SEQ ID NO: 21537 - DNA, 820 bp, Oryza sativa
agtatgaaaagaaagacaatatctagacaatcaagccgttggatgtttcatagagtggtggatatcctatataatatatgtcaacgtcactacttaacctaatcggctgccttctagtaacagatgttagccgattggaggttagataacgatattgccggagattatatgagatatatgataactcgacgaattacataaataagattagagtatcataaagatggaagcactaatcctgagaacgcaggccgccataacaagttttacctctagttgaagatcgaaaccgatgcagctcaacccgaaagcaagaactcgtcgaaacgaaacgaaagtaaaagggtggcgatgcgccgagattgtattgaacatgtgttaaattgattacatggggctcggggtctatttatacccgagattacaaaatatgcccgtgtcggacacgacttttatctctaacaaactctaagataccataagtctttgcggcagacttttgtccaaacatatctctaagggaattacatgaaatatcctaattaatagatacaattgccttctcaggactctatccatacgtggcaatcatcatgaagcacattaacccaacccaacaacgcatgccgtgtcatattgtcggattcggcttgatcggctaaccctgtccaactcggactctaccgatcctgatcgtagccgattcgaacttcagccgatccttactctgtttccgaaacgatcttggacttggattccgcttcgatctgatcttcatcttcgatactcagattaccaaatttggtcgttaacaactatg

SEQ ID NO: 21538 - DNA, 1993 bp, Oryza sativa
ccaataaaccatggtatagctgacaaggaagagtcaaccacattgttcatcacccatttgttcctgcaactgaaagggaggattctggagaaggagattgtactccagtgcctcatcccaccagcaacggtgaaaaactctctgataaaagtagcacctcgctggcaagtatggcgaagaaggtctgacatactctatttcacattgtatcatatatgttttatctgctttgttgttgcacaatcgcctgaatactatttaattttggaataaatgtcatgatgcatcattttgttggtattatctcagtaaatttctgtattcttttagctttaaccttcaggtatgggtcatctatcacttgaaatggtgcaacatatgctttgatttggcaattgggatgatatttggaagatcctacacagttatctaaataagccacaatttgttgcatcaacctgaaccccctatgtacacaagaaaatttttattagtttcttttctgtttacttgagtatgcctgtgactgcagttctgtttggctggcataaactgtagtaagctctcttgagatgaaataagccagttctattgacaatattttccatggttatggattgcagagtccatcagtgacacccaggaagcctctgcaagctgacagtacttcccatagtcacgaagatgattcatattcggttacttcgtatcctttcagatattgacttgatttctcatgtgtgccttattcttcgcagccacacctacactattcataatagctacaattgggatatagctacatgctttgaacattttgttccttgaattactaaaacacagaaaatttgtctaactttttctttaatgtcttcaactcttcataactggtggaaaactagaaatatatcatgttctctttatttctattgggctttcctgagcttcattcatccagaactgtaacttcagcaaggactggaaaaattaagaagacaacagttcctgtcgcacctacttttatatgtggtaatcgtcttgagaagaggggagaggtacgtatttaatttcatcatactgtagagaaatggctttgtaagttaaaggggacagcattgtaataattattctagtaccgttcagttttacacaaaattggaagaaaaacgcaaggccttggaagaggagaaactagaagctgaggcaagaaaaaaggtaggttttgtttcttttgtcatttgattcttttagagccattgtgatagtggcatacagagcaacacaattattcatgctcggtttttcctatataatgtaaatctgtaaagtagcctttctgatgtcatgtctgaattgtgttttgcttcagacattttttacctcctcatgaatcatgtcttatcttttgaaattttgttatttgaaattcaaaaatctacagttcaaatgtttaattcacaccattctatctagtttcacttttatgtaaatggaatctcaaagcgtttttcggactttgcaaaaaagatgaaataactggaattgctttcagtagaccatcccaatttggtagtctagtaaatgatccccaagaccccaactatcatggctttcaatcaccgttaacgttgaacttgagaaccctgccagatgacacaacaaaacatgctgaaaattctagtctcccattgtgatatggagctgtttagtagttcaattgtttctgcttttttaaatagaataaagtacatgggcggtccttaaacttgtatgggtgtgtcatctaggtccctaaagtctcaaaatgcagatccaggtcctagaacttattaaagtgtcaaataggtcccaaatcaccacagcccctctaggatcgtacgtaccgctgatgtggcatgccacacggatatgacatggcataatcttaactgagaaatgggactcacttaaaaaattttctttttttcttcttttcttttctttttctttttct

SEQ ID NO: 21539 - DNA, 41581 bp, Oryza sativa
aacctagatgacacactttgacaacttctgggacttagatatgcattttgagagtttagggatctaaatgacacacctctataagtttaaggaccgcctgtgcactttactcttttaaatatataagcacccataccagattttgctcttgttcagcaaattagtttgcctttaatcatgaaatgtccatcttgatttgttttggaaaaactgatggtcagaaatcagttagtgtaacttgacttgtggaggaaacaagtatcatatgtaggtatcatccctttacaagacaccgacagctgacagcccaagttttttctctctctctaatagacagccctaatgatatttcttaccatgatcagggtagccctacagagtatttgacattgattatggcctgttacctgttattagacaccacatgtataatttggattcactgaatggtttgtgctacgtcttgttactgatgactgttaatcattatgttgctttttctacactgttagaaattttatgacatggcagttagcgtagtagacaagttggatcaatttattaatttaactttgcattagcagggtcattttcccttttgctaattattgttgccataccttctcactgtccaagtatcaacttttataggaagagcaagaagaagctctgaaacaactaaggaagaatctggttattagagcaaaacccatgccaagcttctatcaagagggtcccccacctaaggttgaacttaagaaggtgatgcaccgatctcctgctatatgtgcttgagctaaaatgattatttctgtttttcgatgtgtgctcattattgttcatgttgttgaatgcaattttaattcaagtgataatatctcaacccattactgtttagatcttttccctttaattgaactgattgcgtatctgtaaaaacatactcgactacatgcttgttcctattgttatctacataggccctgttcaactgcacttgtttcaactgtagtgcagccaatccaaacagtactatgtgtctgtagctgctgcagcaagggctgcattgcagtgcagccgaacagagccataattaaattgggaataccctgaatgaacaataagagtacgagagatgtcccaggcttttacattacttaaaagtagttaatgttttttctcgaacacgcagggaaaaagaatagctaatgtaaatgcagtatttatgttttcctgtatgataataatagaagtgcacaatgttgcatgaagcattggtatgcaagctgctggttcaactggcgaccattaacttgccaacttttagtatgtgctaaacttgccagcttttagcatgtgcaatgttggtattcactttgtcttttatttataggtgcctccaactcgtgccaaatcaccaaaattgacacggagaaagagctgcagcgatacccctcatacaccagagggtaaaaatggaagtgcagcatgttgccggttacatcgtcacagtattgggaactccaaagaagttaacagcaggacccaatgttctccgaagagtgctccaaagactggagtagccgcaaaacccagagcgaccaagggcgtcatgaagaatgtgggaaagccaggtgctgcgaatgttgctgtacaaacctaactcatgatccattcccattcccgtgcaatttttcgatttaatttatacctcacatcgccgatgacggcatcatgtcccgacaacagtgtgtttggtgctggatattttttttgcattcttcttgtaagaaccttggtacagagaccatgtggtattccgtgttgtaaatttgtcgaggttttgtaagggggtaaccgagtcagtgctgtaagaactaatctggcagccgataggctgttggtgtgacattgttgttgatgtatggcggcgttcgcagatcctatggtattgtatttaagcatcaacttgttattgttgatattgttgcaaaatctgcgaagaatgtctgcatatttgaattcgggatcgccaaaattctgggaaaaagtacagagaagtactgaaatggcaaatacctccctcatgcattggatgtctctctctacgttctgctgctgccatttggttcaaccccattatcacatggaagtacaaaactttgaggagaaaataacttcgaaatgttggatgcacacttttctttgcaccaaaaataagttgtcaaaagacttgaggtccacatttgtacgatttggttgataagatctgactttgagcaaaatcgactctctgcaaaatctttcttgcagtgagccagctgaggaagccatgcgaaaggcaagcaatgcatgcacgccaccgaccggctatatctctatatatcagcatgtgcatattggttagtgtcatgactcatgagcagttgtcaacatgtcaggcgcttctagtacagcgacctgacgaaacaaaaaaaagttggaaaagcggcaaaaacacacttttgagtcatcaagaattgtctttaaagccatttaatttccaaggagacttttgagccatatcatttttttaaaaaagaaacacgttataaaaacaggtgctcatatacgtgtgtacatacggggtacggcatctacccaaaaaagaatactagatttaaaccactcatgacggaggaagtaactagttgcatagctcaacttcacacttttgagccattttctagaacaacttatttgaaatgaagtttccttttctcttgaaaacgtttgcaaaagcctagagcccaacaattaactgaactaaacatgcagctctcatagaacaaggggtggcgatcgagctcagggttcactatctgggattgccgaatcatttcaggacaccaaaaaatttaaatttcggatgttgaaaaaaaatctgaagtttaaaatggtttactaaatctaaagatgattttttttccatggaaaaacgtcctacatgaacccatcggtacatccaaaattgggaaggactggggaggattatgtttgaatggaaaaacatcctaaaggaatccaccaataaacttgaaatttcaaaaaattaggtcagaaattgtgaatttttacgtgttacccctgtttcaaattataaggcctataattttttacacgatttttaataacatattttgattattaatttatttcgtattatatcatcaacaattataaaactagtatcacatgaaagtattttaaaatacgaatctaataacaataatataacatacataatacttggtgtagatatcattaatgtaattattaataaaaactatcgagtttgatttttttcttaaaaataagaacatcctataatttgagacagggagtactaatcatttttcttggtaaatgtgtcaaattaggcctctaaaatcacaacccttttaattgaattctatgctccgattactgacaactcggacaacatacagctgacctttgaaaaagggtatattgtgatcgagttaggcccgtgccatgatgggtggttatccaatcatccaggttttgattcaggtcgtggcctgcaggacaatactatagttaagagagaattaggccctggtttgacatttctgatagccggcacacattttcttccatcggtttttcttttgccacgcgtacgtgcatgctgccggttaaaggcccgtttgcttctaagtttagggttccttttatttaataattttggttttttaatatataacatcattaactttttaagatatgtctcatcattcttttttattttataacttaatttatctttaaaacttctttaaaatgtttgcataaaagaattatataagacgcatagtcaaatgtaaatctaaaaatcaacgatgtcatatattaaacaatgcattggctccatctttttcattaatcattttgcaattcaccgagcctgttcaataatatggattttacagtaatttcatagaaaatagtttaacctgtatatgattgtagcattctagaggaagtaaaataacttggtggcactatgaggatgtgctacttcaaaaatcctctttccaagtcctataataatcaatggattgacgggctgatagtggtagagctatgaattttgtaaagccatgacaaaccttataacccaaattaactaagactatatatgttacaaatctttagttaatttgggttaagactatatatgttacaaagtaaccttataacctcattattttgtgtttctagctgggatgtcgctcggcaatagccattgcatgttcttccacctgtgggccgggccagctgattccacaagtttttgcacatagttatggtatatatataccattgatacttgaatcaaaattcatgaaattttaaaggttattgaggaattgactcccttgcatagggcgtgaaacattggcaatcatccattcagcccaaaaggtggatcctcctagtagatgatagtcgattcgactagtgttatcctagagattctaggatcgggagttagaaacagagtacctattagtaatgagtatgtgcataactttctagtatgatttcacagttaaacgttaggtactataaatcattaatatttgaattaaaaatcatgaaattttaaaggttattagggagttgaccatcttgcagggcttcggttctaactctgtcattgtcgctcgaccttaatggtttgagggcataaactcctagccatccatcccgcctagaaggtggatccgcccttagatgatgaaagtcgaatctaatcagtgtttatactgctaaagattctaggatctggggttagaaatagagtacgtgtattaaggaatatccgcatgcacatagctaacttttctaatatcaagccacaatcgtgcaacatacatacatgcacctaaaagttgacaaaaactcctaaccatccactgttgctaaattagatcgtgcagacaacattctccttcttttgacacatgagcagggaaaaggtcaccctgcgcacccatgcatttccatgttgcttcccctggaaaaatgcatgcacgtacggcagtctgaaaatgacaccaccgatcactgatgagtcgcacaccgtggtcgctctgtgaattgatgatatatatccattgacaacctcgtcaactctgctcgacagcttatctagcaaaatttcaatttgaaagttatttttttactgatcgatctaggtatttttacatcatatatagtctatatattttctaactcttgcttataaaatattaagggcccctttgaatcgtaggattgaaaaatcataggaatatgaaaaacacaggaagtattatgataggaatacaagtataaaacagagaattgtaaaacataggaaaaataaaggaatgaacatttgattggaccgcaggaatcagatgagagagatagactcaagtgaagttttacaagaggttagagtggatgttaaatttcctacgtttttcctctagaatcgtaagaataggaaagtttcctacgtttttccttttctcatttctacgaatcaaaggcatggataacataggatttcaattcctttatttttccttcatttatcctcgaattcaaagaacgcctatgtttatattgtgtttcttaaaaaacagtggaagtgcaaaatattgttttaaattatttttggatgcttcgtttatcctttttatgatttaccagccgtggctcaaccaatcagtcacttcgtctcccctttgcgacaaattattaacgttgtttctaagtcaaattccaacgcaaaacgtctctctctccccatactccagtaactccactagtgatgacactgcacacaggcgatcgacaatatgtattcatgcatgcatatgcatccgtgtgactataaatatgtgcagagagtgcaaggacctactgcaagattgggcaccgatagaattaagcatttgatccccagtcaaaaaaaataaaaaataagcatttgatcgatcgatcgatcatgaggtttaccgcagtggtagcagctattgttgccgtcattcttctcgtcttcctggtctccggcggcatggcggcgcggccgatggtcaatatggagaagaccacggccgtgccggttgtgaggaaaagtggtgtggtggtagagtcgtggacgatggagagctcgtcgctgccgtccggctgcaccaacgggaatggcgccggtggctactgccgccctcctgctcctgccggtcactaattaattaggttgccgtcaaccatcataccatatggttctatataaggtttaccgatcacaaatttgatcatgcatatagttaagatttagcagatgaagcttgatcgtattcttatagcagtatataggatgaatgggaaataaaatgtatgaacatgattgtaaattcttggtacaccacgcctccagatatgtaaccccaattaaagattatatatttatatgatattgataatatttgttgttatctttatcctaaactagcatggtggcccgcgcagattgtgcggctagcatcattatattttctctcatataatagcatatatgttttctcattatattattcaaatatattaaaatgacaacataattttaaattttgcaataactttacaaaactactaatgtttaatattcatattatattttatatatgtgttagttattaattatttttaatattaaattttagttatttgtaaattatatatattcctatatggactccagactcgttttttaatatttctttttttttattccgaattttctgtaaattgtatttctatatagaccctatgctcttcttccaatattatttatttttatttctgaatttttattatttctaattgtatttctatgtggactctaaattcatctttcaatattctttaatttttaatttcgaatttcagttacttctaaattgtattcctatattgaccttaaactcttcttcccatgtttttcttaatttcgaatttcagttatttataaattgtatttttatacggactctaaactctacttttaattttattatatttattccaaattttagttagttttaaattcctatatggactctattctctacttctaatattccttaattttttaattccgaatttctattttttttcttaattgcatttctatatggactctatactctacttctaatattccttatttttaatttcaaatttctattatttcctaattgtatttctatatggactctatactctacttctaatattccttatttttaattccgaatttcagttatttcctaattgtatttctatattgactctatactctacttctaatattccttatttttaatttcgaatttcagttatttcataattgtatttctatattgactctatactcgacttctaatattccttatttttaattccgaatttcaactatttcctaattgtatttctatatggactctagtctcctcttctaatattccttattttttaattccgaatttcatttatttcctaattgtatttctatatggactctagtctcctcttttaatattccttattttttaattccgaattttaactatttctaaattatatttctatatggactctagtctcctcttctaatattccttattttttaattccgaatttcagctattttctaattgtatttctatatggactttgccttttctttttctccgattaatgtgagaatttctaaaccatgagagcgaacatggaggctaccttttctattcctttaataatataatagattatagtaatttttaactatatgtccgaacatactcttgttcagatagatacatagtcaaaaattgttatattctgatacacggacggagtatctggtaccatcatcggtaataagtattgggtgtttataagatttcaagtacaagattaatttgatcctaattttcattatatgatcgtcctggcggctgtacaagctgatcgagttctttgatctcaatggataatcaactaaccgtgcgtgtggtagttgcaattagttattggattctttgctatctgaactatgattaatgccgatgctgaaacagtagaaaaataataggaatgcatatataggccgcatataaccctcttaaaactttgatattttcctgacaaaattaaatgtttatatggtaaatagaggccgatacaggtttggtccaggcccaaaccagcccacggtatattgtgtgacatcccggcgcagggcttaatagaatactcatatcaacaagttaatctataaaagttgcgcacgaggcgggtagttacatattagatcaaggcatgcctctgcatggtgaaaataaatgcctctaaaggggtagcttaagacttggcgctgatgataattaattagatttattttttcacgaacgcgtaaaagattgctcgtaaatatatggtaagtagatttagatgtaactacaaggtgcctttgatatctcaagggatttgaccaatcaaaagcagataattataaatatttgatctgtagtcatcttagataaactaatctagttatgtgttggctaaaattgagacaccacactttttcacttaatttcggtcatttttttcctatttgattgcttcctctcctatatgtaaacatgcttatttctcctatctcttcttccaaatggataataaattatttttaatcctaattctcttatacatcgtgtattagaaaaatcacaatgaaaattacaatataattactctttaaatttgaaaaggcacaatataattataaatgcaagaatatatagtttatacaatataaaaaacaatttgattgttcttttgtgaaaatatgacgctataagtataactactctcccttttgagataacgtgactctacaacagacgagagaattattgccatctatatttggtgagtcccagccgtatctatagattcaatgaatatggccacatgcccacatatagctagcactaatatataccatatccagagacatttacagtatataccaggccccgggtcgcccgggccactaagatagactttatgctccttcggttaaaaaaattattttaacttttagacaagtttttatcatacttttagactttggccatcataataatttctcaaatgcttaatgtaaaaacaatgaagtgatatgcatagatatatcttgaaagatataatgatatcacagatttattagattttttactcttttttaaattattctaatagtattggtttcaaaagtcaagagaatattatcttataaatgtcaaatatttacaacatgaggaatagcattagttttcatcatggtagcaacaatgtgtcctaaagggactggcccaagccgtggcccattttggttttctcctgacccacaatgctaatcactctagaatgcagttattcactttttttcttaaggggctaataatactcatacttttccataattccattggtttgttttgtgctacaaattcaaaaagtaatagcacaaaacgccatgttagaactataactactactccatccgtttcatagtataaaacgctttgacttcttcactaatctaattttttaagtttaactaagaaaaacatagcaacaatttcaacaaacatactatagaagtattttcaatgtgggattcaataaaactaatttagtgctatagacgttgctaaatatttttataaattaatcaaacttaaagatgtttgcttgaaaaaatattttataatataaaacggagggagtacaaatctacgacgatgatcagaatatcagatcacactgtgcagtgtggccaaaatgtccatgggagaaaaaccagccactcctgggccgatagcccggcccatatctggtcaagcccaccaccagggcccacgggcccatcgtccctcctactcctcctccccctcgcgaaaaatatattttccttttccaccattcccaccgccgcttcgttcgccggcgatcgatgagcgcggcggagctgtgcgacgccctcgccgccgccgggttcgacggcgacggcccactcgatctggacagcctcgagtggccgttcctccagggggacgacgcccgccgccttctcgcctgggtctcctccaggctccgccccgccaacgtcctctccgccaccgacctcgccctgtaccactccccatcgctcgatccccttcccccccccccccccacgaaattctctctgatcgtcgcgttctagatgttttgggggggcgttttttcggaattacgcttggttttgggggggttgattgattcgaacgggatggagagggtatggtatgggtgtaattgtttggaggtttgaggggttggatgaactctggtgtgtgctgggatgcgaaatggtgatgggcaaatcggagttgtttttgaaacttgaggaggagaagggctttgatgagaaaaggcgcagcactgcacatgctttctgaagtttgatggacaaatgtgtagtataaagtactataacccatagaagtcagaagttgcatgacactatctagttaaggttgtaggtgtagttatactatgagagctggtttagttggatcaattgcacgttaccaacttatgataatatgaattgtagtattacacaatgtttttttgttactgtgtaacgatttctgatgatgcttataaagcttaattataaattggtgatcttttttttttaaatgcaggtatgagcagcttgaactagaagggaaacttttggaggtatagagctttttggtttctttgtttgataaacttaaatacttggactgtgagttacatgtgatggttattagttaggcgaaaaccatgttggttaacaaaatttactggtatgattagtcttgttttcacttatcgcaatgtattagctctatctagtgagtggcatgctgctaattgagcaccgacttttagggggaggacttagactttgcgtttgacagtatttcggccttctcagagactggagaaaaccaggaagacacatttctgacagaagaaagtcttgagcacatccggtatgtcatatctcgtcttacacaggaaaagcattcgatgctcctcttgtttggatctgcatatgtagttgtccaccttctgttgtgatgtttacagattacaagtataaatatttatttggtttaacacgtgttataaaatggcatcattccctaatttatttggtctagatgctttggtaaaactgaactcctacattgagagtgattgacagatggttctgtcagtggtagcgcagccccacatgattcgctccatgtcaacacctagtcttatctcgttaccctgctgttttgatctcttcattgacataggattttctgattatttgttacagtgactcaaagcttacactcagagctgaagtttctgatttggaaaggcagcttgcttctcttgaatggcagcttgatatgcttacagcacaagctaccaccattactcagggaaagaagtcacgtgtatctgctaaaactaatcctaatatacaaatttcaagattagatgagaaacttgctaagagaagtttagaggtaaaatgttcctttgttttatcatccaaatcagaggccacattactgtattctactgttcttggctgtattttcatgagatagatggaactgaaatatgcttttcatattacaccatgatactcatgtctggctttagaacctgtcacctatctagcctataatcggttggaacatgatagtgtttgataactaaccagaccagtagactttatgatctaatggcctagggctatcagtgttatctgatcgtccgattaatcgtgattaattgtcctgatcggtcccctaactctgatcagggacattcatttgatcagctcgatcagaaatctgatcgtccgattaatcgtccgatcagagcacctatcaatcacttttagaactagtcttaaggtttagcacatgtgaatatgtgctactactgctagttgctttatactagggcaagtgagtgaccatcttgccatcaattattagtactgtgattggtttatactatgcactatatagaatataggttctggtatacatagtaccgatcaggtcgattaatcaaggctgatctatgatcaatcgtcctgatcggtcccttggcgatcaggatctatcagcgatcagatattgaaggctataaccgtagatgcgaaaaaaggaaagcgttcactgggctgtttgttttcacagatttttatgcatgttgatgttctgttttatggcataatcaacactccatgactaatgtgaattaaaatatatggtactctctagcctgtttgttcagtgttgtgcatcataaagaaggttgtccctcagatattttatttttccttttgtttttgtaatcctagcagatgaattcattacttggaaaacttgctgctaccacccaggagttgtcttattatcattcagaagctggtattcctgctgtctttcacatgcagttatataaagattacattcatcttatcagactgcattactgatattaaaatgtgcagaaagcctgataactccattttgacttgcatctatgcacatagagatactgaaataaagctcatcatatgaatccgatgcttgtttttatttcttattattcttctgaatacattttgtcttccacctttcctcacagatattggaatttacctatcatacagtgacttccagtcttacataatccaaaatttggcttgtatcaaggaactaaacagatggttctccaagaagtttgagaaggtattaacttattttatgcctaaagggacaaacatagtgttggactgttgggacgtatcttgatacttgaacatgcaaaggcgagcttatttgatcctacacaagaattattaaagtgaactcaaggtcattgtcccttatttttctatttgatgtgattcatatctcatatgttgataaatactataaaagactgtagtatgttaatttgttttcttatacagtaaattaaatgtggaattatgataaattgccaaagtaaattaatcttaaattcacaatttagctataacctttatttatcatctgctgatttttttttgggtggggatttgtcaaccagggacctctccaatttgttgccaaagaagacatgtcaagaggtgagggtttaattgtttagtagtcatcatgcatgtagtttctccataccatacatttcacattcaatacttgttcttgtgtctgcataatgtttttggagaaagataccttgattctcagcaatatattactttttatgtgaaatgttagaagttcaaattttgcatggacacatgttattaaacaaatgcgaacaggtcctgttattttattcgataactcaagcttcctggtaaaaggatcatgattaggtaaccatatagatttcctatttttgtgcctgaagaatttgtgccgttcaattttaccataaaaattctgtcttcttcactgagtaagctaaactggcttaaattgaccttgaaccatgataggagatattatgcatgtccttaaattgatgttagtatacatatttgtccaactgcttctcttaaaaaattgaaaatataagagtggtctttctcccttagagggtgcaggagggtcattgtaaacgaagggtttgatatcgttcttctccactggtttcatggttcactttgctgctatgtactatgcactgttgatatgtttattaatatgtatacttgggttaggtattcaatatgaggtttaacaactttaggcagagatgaattagaaaacagccaattttccattcatcttgtttgcgcaggagattatgaagggtcacaccatctttctgttgaactgaagcgaattaattccatgtaagtatttattagtctttggatgtcaccgttctacccttttttgtctttctattgcatatcacttcttcatgttacaggactatcccatttgtctttccattagggaaaaaaaaactacaaaaaaaactgtgccatgggtcgtcacctgtcctgcctctagagattcaagtggcccacctaatgtcttatacgtgggtcagtgggccagcccacctgcaggccacaaccctactctttgtgttaggacttctttttttgaatattagttctgcaaaagtgatgcaaattcattatgaaattcaatgaactctgccttctaatgaatacaccttgtgttgttgtagttctataaggtatttctttagctcatttattagttagttcttcttcaaatggatcaaccttttgtttttgacaaaaacaaatggatcaaccttccaaacacccacttcccaaactttgttaacaatatgcttaaggtagaaaacttctgacctgattacccctattaaatctgttttatctctaatttagcctccaagtctccaacttcctcagtcattcaggtgttttggcatggcaggcagcttcatacgaggtggtcaagctcaagggcattcatatctattagcatttaataagggtaattaggaaaaaaagtacctagaaaacctaaaaacaaaatctattttaggaaaaaatcaacatcgtaaaaagtcataaaaaacggaaggagtatttaggcatagcaatcccccctatcattatgagagttgtcttgttcatttatctttcctactttgttgtaaagttcataaaagagttaacataacaatgcatagaattacttaatatgcttcatatagtcacataacatcatttttttacattttatttgatattttaagatgcatgattattgttatgctgatgcttggttatttgttaacagattcgctagaagcaaaagacagtacatagaagcacaagcagaatatgctaaggaggaggccatactctcaacgcttagaacccaattggcatcccagcagtcacttgttcatcaggatgttcattctctaaggtatgcaagacatggataatcatagctactttattattttctaaaaaaaaaagctgtactgaaatagcacagcatcattattttgagctgaaacttttgagaacatggtactatccttatgggacatctctaaatgaaacagcttggttccattgtattataatgacatatatttttttaaaaaaagtagattgaacgaaatctaccagaaagcgcttcatctttttatgagaacatttaggttgtatggattgtttatttattgtatggtagtacttgaacaaacctttgtacatgtgatgtttcggaaaattttcacatttcattaattaagtatctgcttttatttttcttttttttttttggatttgccatgtcatcctcaggaggagaaactctgagtttgctgaagagcttagggatctttcacttcaagtgaagagatgcctatctgaggtaaattattatgtacatgaaatttggtttttaatgtaccatggataagcaaatggtttatctcagacgcttcagagttctttaattaattgcattctgtgataccttgggtcaatgatgtattcctatgaagcacactttatcaacatggtgtcacagccccggcaaaataataaaaagaatgtacagttacgctaaagattgctccaaaaatgcaaactacagaaaactgacatgttcactggtttgtctttgcaattatgtatctgtcaccccttcttcaatttactctgttcctgctgcttatagccaattttaatgtcattttcatccgtttggctatcttatgcattaactgtgacatattattttctttgtgagtgacataaaaaaataatgttttttttaactttagattattacaagcctgtgtgctgaccttgctcaacttgagggtgcaaatattttgcaaggtgtgatcttctcatgaatcatcatttgaaaatgctttgctctgttgcggcaatataattgcatgttccttactgtgaccttccaggggatcataatttgaaggttctgcgtcaggaatgctacataagccagcagaaaagggtatcttttgaacagtcagttgttttggtgcaaaccaatttcctacataaataggtagtcactgaggcatttcttcattcttgcagttcatcaattatctggttaatcaacttgctgctcatcagtttctaaagatagcttgccagattgaaggacgggcaaaaatgtcaagtgcctattcactgctaaaagcagcagcaatggagctgcagggttacttctcagttgttgatggccgtctggtattgctttctgatgttatatttttatttgagagtacattttgttggttagcctcttattattatccactttgtgtacattcttacaaaatatagtctgtactgcacaaatgcataggaccgatatcatttaattggtcaagctgcatctgtaatgcttgaagaaggatctattgatgatcgtgatacttttcttcatgctgtgagggatattcttagtactcactcaggtgagcacacataggttgtaaattgtatccacattctgtaccagaagttgaacaattcattccccttccaattttctgcaggtgctcaagcaatgactccatcatatgtttcagcatatggtttagttgagcagatctcagatctgcaaaatgagctcgagtatcttcatcatgagcttgaaaatgttcttccacgtgaacgcaaaagatgtatcgatgaactgtgagtaatattcgcatattgtttcctgaaacttttccccttgataaatttgaccattttctgggcactgtgtagttgaactgttgaatctcctttactgtgaattatcaacaggagaaatgtgttaacgttgaactttgcattcatcaacacctattgataggactgttagatctttggttcaatcattacccatgctttctccattcctttgcagatgcaggatgatccaaacactcgagcaaattctgtctgtaccatttacatatgtgcaaccaacattgacaccatgggtacattccttctcatatgtccctactcttccatgccacttcgtagtttgttctgatgtactactttacttgtgcatgatttatcacagcctgtagcacaatcgcttgaagaattgaaataatcaaccagcaagtctctgcttgtgttaacgaagtaacgatggctcgagataaaaaggccaaggtacttttcatctgttacttcctcacattggtagtgttcaacagctttaggtagtttctgcatgttgattgagaagtcatgctctcaaatttacaaatggtttgcagatgttacaacaaccttcgcgcaatgtgcagcaggaaagacgagtatttgtcgatttcttctgccacccaggacggcttgagaatcaagtcagagagatgagttcccatgttagagcactccaagagtgatcttcgattttgctgtgaagaagggcccaataaataattcttttgattcttaaaaaatcagcatcgtgcaccctgtcttctgttggcagaatgcaggctttttgcagttgtatatcctcagcataaaaaaatttagagttatggtacagattttcttctatatcgtccataaaaatatacgcagcctagtgcttcaagaataactgatgccgtgtttaagatgttcggccaaaattttacatatttcgcctgtaaagatgctaataacaaaacaaattatagattctacctgtaaactgcgagacgagtttattaagcctaattaattcgtcattagcaaatgtttactgtagcaccacattgtcaaatcacggcgcaattaggctcaaaagattcgtctcgcaatttacatgcaaactgtacaattgattttttttcgtccacatttaatgctatatgcatgtgtccaaatatttgatgtgacatttttggccaaatttttttggaatctaaacacaccatgaataacaaactaaaaagttgtatataattactagttttctcaaaactctgttcgttagtacttttgtggtaactaacagtgtagccttttttttttagggaatggcattcggttaggtttattgatccgaaaacatagttaaatcattattgctattgccattctgagcttggattttgtcttaccccgtgtgacaaactgacaatgtatcatcttttctggctattcgaatttaaacacatgatgcaataataacttaacaaaaataaatcaatgtggttgcaactgaagttactatgtcacgtcacattgcgttgcatatttgcatatccttcctatgcaatgtatatttgcatatccttcctagcacctcttcatagcgaactttaagtttttgttcttagtttgtgctaaattgctaattcgttgatctttatacgcagaagttttgcaggagttagatccaattcaaaaaattccattttccagatttggccaaatggttctatttttcttgatttctgttcgaatttgactgtgccaaatgattctgggaaattttgctacgctctacggttaaaaaaaatactagaagtttaaaaaggaaataacatttttatactctctagttcttcttagaaaataatttgaataatttcatgcaatacagaaaaaaaattagtagtagtattttattttattttcttcgaattcagaccgagtcatgacagttttcttgagaagatagcagctccacattccctttagctggtttaggctgtgttctgcactacgaaattgtttggttcacaataataatttacctcaccataccataacttaagttaggcatgttttactaagttaggcgtctgtttagtttgtgccatacttaaggcaaaattcattcactgtgatatgagtttcacatgtcattggcatataaaagtatgtcaaatttgctctcttatagctaaagtgtggcttcaaatttgttaagcacatgttaggcgtgttagctaacggaattatggcaaactttggcaatagtgtatcccaaccaaacatctctacatttcacaacttctgctcttttattttctatacagaagctttccaaactgcgaaatttgatgtatttttttagaaaatatgtaaaatagttgttttaataaattatattaatctatcttctaggttttttatctaactagaaaaaatgcccgtacgttgcaacgggtaaatgctattttaattttattattattatacggtttagttatggtaaaattcattagaagatcgtgagctatatttcatctttaacttagcatgagtttttttaaagagatttcttatatgactccttttgtattttcaaaagcaaacgagtttaaaatccaactcaaacacagatctgtatttttaaaagtaaacaaacttaaaaactaactcaaacacagataacatattaaaataccaataaaaacatcttcaattctattctatttataatagtagagatagagatattaatctaacgcttatctagcaagtggaggggaaaaaaagtttccaacccagccaactggggaattaatgtggatccggtccaccgaaagcggccatcgaccactggtccaccgtacaacggcttcacgcaaacgcatcctccttctcctccacggctctgagattcgccagcatcagttgaaggcggcagatccagccgatagctcgcccgcgccatttctcctcctcctccaacctccaaatccgttgggagtaacattatatgattatatatgattatatagcattcaacattattaatctttatagcattctagattatgtttaacaaaaatatttttccacttcttagaaaactagttaggtaccttatataattacaatattattaacaaatataataattattgtttactcatgtaaaacatagataatatatattacggagcacacacatatgagttagatgctagtattcatgtgcaagtatgagtgctgattgtagcaatattattatcaaaaccatgtgtgtttgagctaatgactaaacctcttttttttattaccttcttttgaagttctcctaacgcgtttggtaaaaaaatgttttgttttgaataaaataaataaacttttttgactagattattttttaagagaatccactgtgtgccgctgactttgtccttgttctataatatggcactgagtttgttaagttatacaatataccatcgtattttgcttaacctctataatataccgttgtcgtccatttagacttcgttagcactgtataattttgttttaatgaccgaaatatccccgggatagaaattcgaaaatttggccgaatattccgaaatatcatattataaacaaggcagagaagatatccatctcaaactttggaaattttacaatctggtatttggaatttttcgtcccatggctatttcggtcattatgataaaattatataatactaacggaagctaactagacgacgatggtatgttatagatgttaagcaaagtgctatagcatattagaacttgacaaacctagtgacatattgtagaataaggacaacatcaataacacacgatagattctctatatattttatggttgtttagttcattacctatctactatcgtgcgacatttttataaaaagttaaatcttatactataagttcatatcttacacattaaattacatacacttataatataattttgaaattatacaatgccctcttcacattttataggagaaatatgaaaaatgatttattatctatctaattatgagaaaaaatattagtccaaattaatgtatatgtagaaaaaaataatatgaaagaattacggaaatatctacaatcgtatatcatgcagtgagaaaaggagaccataatcgaatgctttattgctgagcaaaattgatggcattaattttatctttttttagctgaatctatcttgccataattaatcagcctgtgttaatagaagtctacatcttcatgcgtcaacatatcatgagactattagtaatagccaagtacactgacccaacaatacttaatatatcacaagactatcgggtaatagataactcatctttagttgtgcttaagacttagtatatcacagaagtatcgggtaatagacaactcatctttaattgtgctaaagaaaaaaaagtaaattacagttcgtacaatgtattcttaaaaattttcatattatgtcatcctttaaccattctttttatttacagaacaactaactgtacatttcaatttggaccaccttatttcatccatctccaagtccagtgactcagcaaccacacactaactctctctctccattttctttttccctctgacagggaaccgctagctccagcaagaaggagcctgaatctagcgtctccgcttttcatcgggtcgactcctgcctccgtgagtccctacaatagtgtgcatgatgagagggagagggaaaaaaagtggctcatgcagtgtaactagagggggcggttgcacatgcaaagacagtgatgaggaacgatggtggctcatgaagaaagagcagtagtggcggtgcgtggaataacagttagtggttgctggtagtatgaggagtttgctgttaacacaaatcgctaaccgatcgctaaccgagtttgttaatttttagaatgtgggccactagtcattataaagaaatagctagtcttaaagtagtaaaatattgagataaaagtgagagtactcgtctgaggcttttaaatttttgccacttttaaaatggtactccctccgtcctgtaatataagggattttgagtttttgtttgcactgtttgaccacttgtcttattaaaaaaattttggcattattattcttttttgacttactttattatttaaagtactttaaacacaacttttcgtttttttatatttgcacaaattttttaaataagacgagtgatcaaacaatacaaacaaaaactcaaaatcatttatattataggacggaggtagtaattaagaatttactactcaccgtctataatatgaattgtgtcctacgtgtgtccttattagtatatgacatgtgtgacagtggcaaattcttaattctcagtagttagagtctcgagtgtcttcccttccctttgtgacgtaaaagaaagaaaatctcccgtctcctgccgccaagacgagtcgcggctgaacaggggaggggcggcgatctccatctggcgagcagagcaggggagaggattatggtgagcatccgcatcctcttttctgattcatctctctctcccatcgggtctggaatttgcttgcttgcgttcgttcgttcgttaaccctagcttctcttctagatctggaagaagctcttcccttaatttcagagccttaaccttaatacaactatacaagtaacagtttgtttgttggatccgcccctggtgagagagatgtttgattctgcggtgagattagtatagctagcatatgcatggagatgaaggtcagcgagtcaatgtcaaaggtcaaatgcggtatttattgtggtaaagagtactggtttagttggttgaatctgtagggtgcagtatagtacagtagtgtgcaatttgtgaggaagaattgatcaatcttcctccaatttgccatttgccgcgagcattttgcttcgcagctttggtaatttcagcttagtgtcctgggtcctggaatggaaaagcttcagttctctcaagctggtagcatagaaagaacacatgctagcatactagtatactaccgtactgccatacacataaataaaaacccgtactacaacgagtaaaccaaattcaaactcatctccatacggtgcagctatgtgtgctacaatttgtttttccaaactgatgatcatggccttgtgatggtctttgtaggatagagaagccaagaaagaggcgttcagaaagtacctcgagtccagtggtgtgcttgatactctcacgaaaggtttgcattatgttccttatgtgtttatatcaacaaattctagttatgccactggctagatacattatgattaagtccaccttatcatcttgcagttcttgttgcattatatgaggagaatgacaagccttcatctgcggtcgagtgagttgatttgactataagatggcatgaataattgattgtcctggaagaagccaacaactaaacatgctggtatatcccaggtttgttcagcagaagctgggtggtccatcaatatccgactatgaaaagctcaaagctgagaagttggatttgcaattgaagtataatgagcttttagagacacacaaggaaacatgcagacaggtatatatatagcattttaatgtgtttgcgtaaatgcattgctactcgatctattcatatggacagtagcattttgtgttacaaccttaatgccatgttagagatggagatctctatggaaatctaacatttacttgtctatcaagattggtgcttatgtgtggtcacttcactgcagttagttggctcttgcactttggtattgcacgtgtttaggatctccaccactcagataatacttcagtggtgtacttttcagtccgattaaactgtatgaatttaggtgcaaatacacaaatgaattccttgactgtattttgttagttctgtatatagcattctgtcctcagcgatgtttccttcttcatggttgtgcctttcttattgtcttggagttttccatcagcccataggatagctatagcatctgctgagtaatcggctggcacacagcaagctagatggtattcctgaatcctgatggacccaatttagatttctcattatgacagttaacatcttaagcacagttctgtactttcaggaaaaaaataacttatgaaaatctgataacatcatcatatctgtctgggttcagaactgtctctttttgttcctttttcagtttcatttggatagcttactttgaagtccaaataaaaagattgttttgtatagaaagagctgggcatttgatcacttactctgcatttctcatcgcagctggatgagcttaagaattcgaagaacgggagcggaaataacacgtgttgatattgtgaatgtgttgtcaagcatacttatgcatctgcatccatcatcaagtcgtatgaaatcgaaacaattgctggtttgaaccttgccatttgccaggttcacatccaccctccaatgtatcatatttttgctcgtcgcccttggcataccagagcacccatgagtctttcccatattcgtccagaagatcaaactccacactacctttcatgagcaaaagatgatcccacgcaacacgatttgaagagttgatcgacttgtggaaaacctgttgtgtggtaaatcaatagtatcatgtaaaatttgtcttatctcttcttttcttggaacaacgagggtggaatttcttctcttatttaatatagtataatctaccctgtctcagagaaaaaaaatatcatgccaattttgtggcctaataaaacaattggtttactgtggaagcattttcatgcagaatcttgtttgcctctcagtttataagccgctactaaaatttgaattgcagaacttaattttaaggtttttccatcgtaattcttttttttagcattacctttaaaatcacggataacacatatataaatatatgtttaaaatttttatctataaattattatttaagtttattctacattgtttttacgattggtcagctgtaggccaaatctgttcttgattgtcctttcgccactcaatttgactcgcggacttctgcttggatagctttgagcctttggctcttggtgctgaactgctgaacacagctccgctcgtacaaaaagggctcgcaagtcgctcctattttccgtttcttcgttttgcttttcccgttttttttgcttgctgcctcaagtttgctctactgtactgtacgggagtatatactacatctgtaccatattagttatcgttttgggttatttagggtctatttggatggctactccaatttaccacgtaacaactcacaagctagcccatgccacaagtcggacgaatgatttgagcaccacaacattagcgaagaaacaagtggcgaagtggttcatgagcatctatcttcttacggtagactaatgtgcgttaagcaaccaaactatacgctaactacagcacctatccaaacaggcctgcagtattgattaggttcgaggaaaaaaatattataatgtctcttattaaatgatttatggttagatatgagaggatgattggaagtaaaaaagaaaaaaaatataaattattaaaagtgattgatgaaacaagtaatactgcgttctgacatctaccgtggcttctgtgccttggttctacagtacttcattttgttttacgttgagtagtgcagtgatgaggccaaactggccaagccatgagctgtgaattgtgatgaacagaacaccaccgagagagatagagagagagagagagaggcctatgcacctaggcgcctacctgactgctaccgaagcgaaaggcacagtgaccttgtgggtttggtgcagtaagagtaggtacaatagcaggctataagccagctataatgatattttaaagagataaatgaagagagagaagagcagcgggctacagatctatagccagttgcagcacaggctccaagacgtaatgtgtgtatgacaggtggaaccagatattaatagtatagcaagcaactattatatgaattagctactacattgactgatttagagctggtagtgggctgtactatcaaacttacctctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaataaaaacagagtggtgtggtgccgtaccaacaggcaacagtatcgaggaccagtggaccacggccatccatccatccaacggtcagtttttcttgcagcaacgccggagccggatgtcaagcgcaaaacccaaaaatgaacaacggaaagcgcacgcgacgactctccgcggcccatccactacccccagcacccccaccacccatcgccacaagtccacaaggaccacaaccccctctctctctctctctctctctgtgtggtgggtgtgtcactgtgtgtaggtgctctgtatctttgggtggagcaccgaccaggaccaagtctctattcggtagtacaagttaccaactcctctgtctgtttttcacgcgcacgttttttaagctgctaaacggtgtgttttttataaaaaaaaaatttatatacgaaagttgcttaaaaaaaatcatattaatcaatttttaaaacaaatagctaaaacttaattaatcacgtactaaaacgctgcttcgttttatgtgccgggaagtctcgctagtagctgacgggaacaaatgcaatgaatttattttcttctttatcccaatttgaaaagatttttgtgatctttttaaatttatcatcatttaaccggtatatactcatttatttgtgtaaaaataaatgacatcgtagtatggtatctaatcatttacataatgagtaatgcatattagtattctaatgattaaattgggatggagagagcaatacaatatttatttagtatgcaaatttatttatgttaataccttataaattattttaaaagttattgataagcaatacagataagcatatgtataagcaaaacaatgaaactgtaaaaagcagaacatgtcgtttggatatatttcgagttacaactaggggtattatatggttaaataaactacatggtcacatggagtacaaacgtttacctgctggctaatggcttgaggcctttcgttagtcatcccaaattaaccactacatagaaaacatgaacacggtggattgaaagataataaaaacttaacgtgataaccacgtacgtaacccaaacgtagtaagctaccactagtagcgctacggatgtgctattttactacggaaaccaagcaacttgatgttgactttgttcacgatgaatagattaacaggctctcttcctgaacttctaaacgtcgtaatattctttaggcaaaactttctgtgctttagttgtttgtaatttcaagtaattaccacaaattatctacttattcatcaccgatatctgatggtgtaacaatagagtcgtgggtatgcgagggttcaaatccaccatttttacccacacataagtaggtatttaatgaaattttaatgagatcagacatgcgtagttggtttccatttcattagacatgtgcttgagggcgttttcgtgaatatgtgagagtgtgatgttgtgtatagtggtgtgtatgtccactgtactatacttaaaaaaattgacctaagtaagaattgaaaactaaagggatagacttttcccggtcgggtaaaaacgctactccctccatccctaatataagggattttgacattttgcttgcactgtttgccattcgttttattaaaaaaaatagaactattatttttttaattactttattatctaaaatactttaagcataactttttgttttttacatttacataatatttttaaataagacgagtggttaaacaatataagtaaaatattatgttaaaatagcttatagtaggggacggaggctactattactaccatgaccatgtaccaacggtcagcttcgcaggcagaaaaataattaaaagccagcggggacgctttcctcctccattgaacgttgaagaaacaaaaggtgcatgcgaatgcgaagcattcggtgaagaaggcactcacacgcgaggacccttcggcgaccgccgcccaacctctcccatagtcccatccccatccttttccacaacgtgaggtgagagaaaaatcgcaaccacgcagaccgacgcccgctttgacatcaccctcctcaaccactctatcagaggtcaggtcatactctatctcgcggctccaaaatttaaaatgtagtcatttttaagcatggtgataaatcaaatttttaactgtaactattaattgcaacaaaaataaaagagtaatcatgtaaaattgatgttactagatttatttttgaacaatctatcataatatacaaatctttttatttaaaacatcttacttttatatatattgttagtcaaaaatagcatcttggagaccatatcagagtccaaacgtacttatattttggcatgaagggagtacggcttttattccaaaatatttaactagtactgatagttactccttccgtcccaaaatatagtaaattagcaacctttgagcgaatgggacatatcctctagatttatagtactgggatgtgtcccatccgctcgaagattgctatattttgggacgaaaggagtacttcatattttagaagaaaaaaaatattgattctttactactcccttcataaaaaaaataacctaagcgaggatttaacaccaaatagaataacgaatctggacaacctcatatccatattaattatcctaaattatgttaaatcaacatcggaattatgtttttcttgaaatggagggagtactctaagcttgccaaattactggttaggtttcttgtggtggaaccaatcctctcgggttcaaatcctagaggttgttcatatttataccatttttaaccatactatttttttaaggctataaaaaatacctacatttagtggccaacttgccaaaataagatttattttggctacaatataaaaaccccctagatttaacatgagtgcttgtatttacgagtaatttttctttcaatggtaagcgacttacccatcgacagtaagacgcttcatgataactcttagagggaggttgtacatgtattgtggacgcttgcgtttgtatcgtattttaagaaaaaaaactaatccagccctcaaaggtactactagttgtaataaacaaattaacaggagttagcacccagctgcaagcaagaatgcaaatggattacgtatgccactagctgctgcgtgagggtatcacgtcatgtgccgtctatgccttgcttgctgaatgcggccatactccaatgtctcacacacagtcatcatgcatgtgtgtttctgtctaggtgctctgtctttttttgcctcacctacagctactaccggccaagcaaccgtagcagcagcagctgtgacggatgggagaaaaaaggtagagcaaaaacaaaagcatattcctcctcccttcctcttgtgctcggcaagtcaggttcacgggcgagcaaacgcagcatacaaatatgcagctggtaataacgttatcatggtccaaacatgctgatctgttctctgttgtgttcatccagaagataagggcatgtctagatcccactctaaaattttacaccatgtcttatcaaacgtttgaacacctacataaagtattaatataggctaaaaaataactaattgcacagattgtgattactttgcgagacgaatgtttaagcctaatttctccatgatttgacaatgtggtgctacagtaaccatatgctaattacggattaattagccttaataaaatcttcttgcggtttattaacgtatattgtaattagttcttttattagtacccgaacaccctatgtatcgaagggtgaactcctcaagcgggggacagtaaggccccctttgttagttcggtcgggggcagcgggtgaaaatcaaggactcggtggaagatgtgatgtagacggggtcggggccccagaaacgatgagacaaaaggggtttatacatgtaataccctactcctgtgcttggttgatcgagtatggaatacacgcacttcaatctctgaaattcaagcgtgagttagccaaagaaccgatctctctccctcaccaagcttggacctcctttttatatcccaatgggttgccacatgggcgtagaagtctacctaagggtgaaggaggacattgcatgtcttgttgcttgacttggaagccacacacagacgccgcggcatggggccgtcatatccaaccagctgacacgggggacacccatgccattcaccattaaatgagtgaagacttctgagtcctcacttgcaccgagaaatggaaaccctacttttgactaggttggatgaactgactccggctgggatgaaaggctaaataacctctcatcatcatgacgtgagggggcatgttaggcggcacgccgcctgacaagtgagcagcacgcaggcgcactactccggtctcatcaatcattcgactggtcacaaaccggtcgggcgcacaacgcaccgcatttaatgcgatgtggcgcgcctgctcatgttgccttaaatgcggttaggtgggtgttgggggcgtccacttaaccccgcacacgcggtgtcatgcggagggggtcagggcagcccgagtgctcgacccccaggcatggaggggcggccgcctccccacctcaggcctaaccccctcggaggagtgccacgtgggtatcgggggcagcctcctccctctggtcctgattccccggcccatatcaccgacactatgcgacaccctacataatagccgatgtgacatgtcaaaactttacgtccctcgatctaaacatccctctaacaacaatacataggtcttgcttggagtaacagagttttttatttgtagtgaatcaaagcgggaagggatgagaacagtcgaaaaccatattgtttgtaagggaataaaggttctgtgttggttaggaaattccatctatcatacagccatttagccttcccgttaattatttagtgattagtgatgattgcaatacggcattggtaaaatatagaagaaaaaagatcttatatatggctagaggcaaaaacaatacaagttttacggaaaccatgctccgtcagttatgaatttccgtcaccgttttcgatcaagaaaactatggagcacagccttgtgttttttttttctttagaacacacagccttgtgttcggtggcatatgcctggttgtactccacaaaagttccgaagaaaatttactggattttgggtggtgaacgctcgagctgtaaacttgatactaaatcctaccatgcggagatgtggtgtaaaccgtccatatgtccaaaatatcaagtgaagaaaaaaaagacgttggtagcagtttcactttaacccaatcgtttgctagagaggatacgatatactatcaatttacccgtactccttttgttaaaaaaaataaataaataatttttcatcttaaaataaataattttaagtaaacaaataattttttatcttaaaataaataaatttaattacggtttattttgagatggatggagtagcaagtaagtactctatatgatgaagtaaattggtgtggcaccgcagaatcgccgccccgccggcctacccctagacgcacaacatatgtgcgacgtgagatcacgaaaattccaaaaatctttccttccccatataccacccgtatcgtatcggcagatcggttggcaaattcatttcatcaccgcgaccacacagctacagctaacccccccgcgccgtgcgcaccaaaacgctcgtgtgtgaagctagagctcagtcaaacagttttaggtccatcgaaacaagttgggtggagctctctccactaaaactgagagtggagctggatagagctctctcacaagataaactacttcagactcaactccttaaattaaatttaggagtcttatagctataccaaacatgctctacagaccagcaactcagctctccgcgatgcttgggctctgctctgcccacccaaacgcgtgccccccacgcacacacgaattcggcgtgaatttaggcacaagcaccaagaaatcgggggaaaaaggtaaagatctgcgcctctggtggtgtcctgcgcgcctctcgtttttttttttcttgtttttatttttggtggagctttcctaggattcggtttggttgagattttgattgcttagcttgtgacgcgtccatcctcagccgtccataccttttcttttttgttgtattttgaaaatatttgtccgcattaaaaaaagatagtagtagtacgaacttaaatgaaaacaaaaagaaaatcacgtaaatatcaaatcattccattcatttcatttcactccatcaataaaccaaccaatctccaagtccactttgttttttttcctctttaaagaaaaacaaaagaaaaatacattcctccatttccgcgtgaagcgtctggatcgagagtctagaggctaactctagacgacggcgtagaggatgatctccgcggtgtcggcggcggcccggggcatcctcttcgcggcgaagcccgcgcagccgccgccgccgccgtcggccgaaccggcggcggcggaggaagacggcgacgaggaggaggacggcggcgggtggtagtacatcctcgccgtctgcgggcagtgggagtggaaccgcgcggcgatgcgcacccccatgtcgagcagctccacgtacttccccatcgatctatattccccttcttcctctcggatctccttccctgccaaataaaatcaacgaatccctccctggcctgctcctcctacgaatcagcagctgtggatgcgagcggtgggtggcgctattgccttgctgtggttgcttcgtggaaggaggtgtcccacgagctgggagctgccatgggaggcggaggcggaagaagaagcgatttctttggggaggagagagttggaggagaggagagggggcttttataggggggaggagtcgcttgaggcttgacttggatggaagatttttaatgcggtgttgattatttgccgtgtttacttcttcctctcgcttgggctgggttggcttgggttggcgttcgtttcgtttggtttctctctctctcttttgtgtgattagcaacgcgtggaagtgctgcgtgacagatgcgtttcttcgcctgcctttcagaaagaaaacgtttttgttttttttattttcgtttcttttcgccaactagggactggagaggcatgcgattcccatgtttttatttcaaaaatccaataagagagcatgatttttcattaactctagaatatactccctccgtttcaggttataagacgttttgactttgcttaaagttaaactactgtaaatttgtctaattttacagaaaatatattaaattatagatttaatgaaacaatgctggtgttgtaaatattaatactttcttctgtagaattagtcaaatttaaaatagtttaacgtcttataaccggaaacggagggagtacattttgaaaaaaaaaacacaccgcatatctttttttaaaagacgacatcacatatttaccacaacactgacgtgaggtttctttttctttacacatatgggccatgcgggaacctagaaatataggaacaatggagaaatattatattaagatatttttttaaaaaaagaaagattaggagctttcactgtggactttttcaaatacaagttttatatttaagcgtataggaatgttcaatgcatatggttctatagagcttaactaagaatgaatgatgtcgcctagcacatatggtttgttctgaatctggactactttcgtgtgtttctaattgcatagagaataaactagagctcttacttggtgaatttttcttttccaaagtcgattgtcccactaatatatattatctcttcaaaagtacttcatccgtttcacaatataagtcattctacaattttccacattcatattaatgttaatgaatctaaataaatatatatgtctagattcattaacatcaatatgaatatgaaaatgctagaatgacttacattaagaaacggagaaacggaggaagtattttctaggaatgcaagcgggcagcatgctatcatgcgtaagacatacacatcagtttatttttcacccactagtatataaacagataaaaaagataatgccaattacggcttagtgggcctcaaagcctacaaacccgcctcacttgcatctctaatatttcttttccatcaaagcttccggtgttatttttttttaaaaaaacaaatgttgtttttctaaacaaaccacctcactgtacacatgtacatgtgattgaattttacatgtgttttcaatagtgtgtaatagtattttgtttttttcctgtttcttaatttgcacttttcaacaacaaaagaaatatatatattttggttgaaacacaaggttgctaccaataaggaaagaaaaaacaaagatcactagtggatccagttccaagctagcaaagcagcaaggctagaggccgatatgtaaacatgacgaaccaaaataccatgaaatagattatgagacttgatttatgttgaattgtcgtctcatgtcagctctcctcgccaccaatgaagctcaccatacatagagggtaaaaaaaaatgatataatgcattctaccagtttcttttctcaaattaagttttcgttgaaaacgactcaactgtaacaaaataaaattcccaacaattcctacgaaccattccttcatcaataaaatacaagtcttctagcccctttgcacattcacatccctataaaacacacgctgtgcttactcatcgtcacagcagcatctaactcccagtacattacaaaaaaaaagtaaatattactcagttttcttttaaaaaaaacgtattcgtaggtaggtatgcggctggtacgtgtttgctgggaagattccaacttgctccagttgcgataaatttccatgtttaaatttctcgtgtcgtgtagcacatagcctttttaattttcattcgttttttgtcagctacggcctcgcccagatgaaacctagcttgttttttaggcgatttttgaaaatggaattttatttggcaatatgggcttttttttcgtggcgcatatgcgcgtttggtccacgaaatatccggctcgtggggttccgttcacacgcgggcgtcctacgtggcgcgtgctcagggttcggtgtactggactactggggtggtggttggtgcggttggcagttgtgctctcatctgggccgtccaaactgggaagccatctcatccactccatcccttttggcttcttcgtgtcattccattctccaacacaacagtttgttattaaaattggagttttaaaagaaaattaaaatcaacggcttgttccctttgttattaaaatttggtacttactccgactaatgttatgagactttctagtattgtccacatttatatatatgttaatgaatctaggcatacatgtgtgtctagattcattaagatctatatgaatgtggccaatgctagaaagtcttataacctgaaacaaaggtagtactaattttcatacctccatctgatcctaaatatgataatttctagctatgtatctggataggggcatatgcatatacataagtagaaattgctatatttcgaaatggaggtagttcaattttgtgttatcttgaatctattttaatttagagccttatcgtattttattaatgtttttatgagagagtttctgaaactactcgattttactattaaaatttaataggtttggaactaaatcttactattaaactttgataggtttggaagtagcaatgatgtgaacacaacccaacagacagctgctggtgattgatttgtctcgagctgaactggtgctaatcatgcacggtactactccagtagtgatttttgtacagccagctggtactaatttcctcctaaacatagggttgttgttagcattttgttctctcatcagcttctacctgctcttgaaataaaagtaggactgcaatctgttgtaccttactatggctgtgtttagatttaaagtttggatccaaacttcagtccttttccatcacatcaacctgtcatacacacacaacttttcagtcacatcatcttcaatttcaaccaaaatctaaactttgcgctgaactaaacacaacctatataaaaaagctctgcgttgtgtttttccatttagagaaatcaatggtgtatatataagagtacagtttagttggactgtgtatgtatgttcgtggaataggagcctgcttagggcccctttgaatcgcatgattgaaaaaaacgtaggaatagaaaaaacgtagaattttgatatgaatgtaagtggaaaatagagcattgcaaaacacaggaaaaacacaggaataaccgtttgattgaaccgcaggaaaaacgcaggaattggatgagagagatagactcaaagaaaagttaccaagaggttgaagctcttgctaaatttcctccaaaatctctataggattgtccattccataagaatttcaaaggattggatagaattcaatcctttatttcaaagggcttcatagaaaattttcctatagaattggaatcatccaaaattcctatgtttttcctccaatttagtttccaaacaaaatttttcacgttgtcacatcgaatgtttggacagtattagatgcaaaaaaaaaaaacaattacatagttcgtcaggaaattgcaagacgaatcttttaagcctaattgcgccagtggcgtagctaggatttaaagtaaaggtggtccatctatatgtaatatgccaattaaaagggtggtccactatacaatttttattatattactagcacatatactataatttcaaattcttaggtggtccatggaccacggtgccacctagctggctacgcccttgaattgcgccatgatttgacaatgtgttgctacagtaaatatttgctaatgacggattaataaggcttaataaatttgtctcgcaatttcctgacggaatctgtaatttgttttattattagattatgtttaatacttcaaatgtatgttcgtatatctgatgtgatatggaggggcaacatttttttttgccaactaaataggccctaacctgctcgctgggttcaaaatattaaacttagggcctgcttggaaggtccataattgatccaaaactggtgtaaaatacaggcccgaaagattttccggtgcacgtggggcttaccacatatttttgtcatatctcaatgacatatcatatgtcacatatggacctcacctgtagtaaccgtttcccgtactattgaaagaatcgatttgcaccggttttcaaagagaaggaatgtgttatatccgattttatggttgagggagacaatttaagcaagagtacataagatgaacgacaaaaaatatacttattccttgcttcaattacttctacagtcgaattgagtttctttagtccatagctgggccaatctttcccagactcccacaatttgtcacccaccagttctggttaggccgagtgctcgcgagcgtggattggagaatatgccgacttggaaatcctttgggcaaatccaaggcccgattttttttttctttttcatcttattatgcatgtggatcagtggatctagtgtttaattgttccaccttgcaagcccctttttcaatccaggtgagaaaattacaattccggtcgttgaaaccactaaaaacccgaaggatagaggaaagcagagccccggtcaccttctctttccctcagtatgtagtacccctaaattttgggctaaccccgaaggcgtcgataaggcccactcagagacgggccgaaccatttagcccaacaacaactcaacatgctatgcctcctttccctcctcttccttgatagattggcaggcagagccctgcccttatataaacaaaactgaaaaaaagagactggttttataagcaaagattccgaaatatggatttttaaaagttgattttgatttttttttgaaattatatatttgaagtatttttgtttaaatcgttaaggacaaataaagaaaagttttaccataaattattattattattatttccaatcagccatatatatggcttgccaaccgatggcagcacaaatctttcgcgtccgtttgaacccattcttcaaacttgaagttggatttggacgtaatagaaggtgcagttgttcacttgttcctggcatcaacgtgtacggttgaacaaatcggtggatctcttatggttaacgtgccctgttgatgtctgaaaacccatctgttctttgttctaactcctatcttatcctctcattttttttcgcttggtctcaacttcgtgttctactagttttgaacgagtcactcactcggactcgagagctctgaacttctgaacaagccaaaatgctgtctgaaccgagatcttcttggcgctgtcagcctgtcacaaactcgcaatccaattgcacttccagcggttgagcaggttcaattcaacatgactttcatcaggagatggtaagttaggaacagattactgtcacaactcacaacagttattactactatcgcaacaaatgctagctgtccttatcctcatcgactggatacttcagaaacaagcataacagtagcattggagcaaaggacacagcatggctagaagtagatgctgctgcctagagatatcatctcgaattcatggcatgaacaaacgtcgttcatgcagccatgcaggaataataagctcagaacaggattcaggacaaattcaagctatctacaagcttgccagcatcatcatattataataattgctttaatagtcagcaaactcgtacagaatagccagatccaaatttccacaaactatatatcatcatcaggaattttaaaaagagaactcggaatcgatttcgcatgatattcgaggacacccaagccaaactgacgataacgatgactaacgctaatacctactacaacaccaggtgctggcccttatttgataacttgcgcctgcgagaattcttaggcagaagcagatgcagcagtggcaccgacgtgcttcacgatggtgttctggaggtcatccttcctggcgccaacgaccttgtcagcctcagcaccatccttgatgaataggaaggtcggcattgcctcgacattgtacttttcagcaacttcctgttggataaagaaaagcattactcactatcacaggggtgacaaaaatgtttttggaagattgtgggcaactctgcgcaccttcagctcatcaacatcaaccttcagaaagacagcaccagggaactttttggcgtattcagcgaacactggggcgatgaagcggcaagggccacaccaggaagcagtgaagtcaattatgacctgtagatcaaacagtccagaaaaggccatcattagggatggaaacatgacatgaacaaatggtcaattgcgcagtaagaaagaataacggtagcctcacagttattggcatgacaagcataagtaccactagttcagaatttcatactagataaatattctttggcaaccttgttgttgttgcacagaaagaaaataaatacaagaaccattgataattccatagacaacaatatatcagcctggtaagtgctaactactcttgatcaaaatcctcggtgatgccgcacaacaaggaaccaaatctaatacagttcaaatataatactcttggtcaaaatcctcgtttatgccgcgcagcaagaaaccaaatccaatactacagggcggacgcttatctgtacaaagcatcacatcataacaatgccaagacatgtgaagtggcaatctattgtccataacaacaattgaactagattagaaccagatttccttcaactctggcgaatcatgtcaaattatagtactatttaagaatatatctatatatttaaacaaagcttatactcaaattagagaatcatcagcatgaaacaactggagcaaacctaaacatcacatcacaccatcccatcttacggtaaatttaaacactaacaatttcgcctatggagtcaaatactatacagatagcggatgaaaattcgcttgcagatgtaagcatcaaatcgccccatctcatggtaaaatccaaacatcaacgattaatcatgtcaaatacagagtgccctgtaattactgcaacagatttcttttaaaagaattgttcattatatcatcctaaaatatattcatgaaaatctactactaaaatctcccccaccagaatcggcaatccccaaatccgcgacaaccctacgccccaatcgccaaaatagaaacaatcgatctcctcgcgatttcaccacatgccacaaatctcagcaagaaattaaatcctaaatttcttcaaaatcctatcgatctaagacgaaccgcgaccccctggtgaacaaaacccccaaaaaaaaatccccaaaattctgcgccaggaaacttaccactttgccggcctccttggccttggtcatctgggcgtcgaactcgtccttgttgtggcaggcgatcacgactccctcctcggcggccattgctctctctcctcctaattcctcggcgacgagatcaaagagaggggtttcgatttgaataggattttttttcttttcttgcgatgaagatgcgttctttcggcgcggcgcaggtggcaatttataggccaagagaaggggtgggagaaattaccggagtgcccttgcgttccgaagacgctgacgtcgtcacgctcgtccgcgtgttgcagtggaacgcgtttcttcttggactttcgcggcct

SEQ ID NO: 21540 - DNA, 13769 bp, Oryza sativa
  unsure (1)..(13769): unsure at all n locations
gactatctctctttatctaattcatgtatttttactgtgatccaccaatcaaacgatcattcctgtgttttcctatgttttgcaatcctttattttagacttgcattcctgtctgaatcctatgtttccctatacctttgttttttaaatcgtgtgattcaaagggacacttaattttagctctaggagttaggtttggagtggagttgtgtagccgtttaaactcaactccacctcttttattttgtgataatgtttcatctagctctattcccattttagatggatccgaaactgtttgattggactccaactcagaaaaagaaagctggagctgtgccaaacaagcttgtagtgttttcttaccgtttaccttttgtggttgaaaaggtggtaaaccgaagcaatgagagtacttttggaataaaactttatacttttaaaaagtaaaaaccgatttgagtggccaatttttaacctaattaagtggttgaaaatatgtgaaaaacctaaattatttttaaaatattttctgaagttaaaattgctcttcaacttatcagcatcaatcacaattggaatttaatcttaattttaaagttgattttgacgttttcatcatagttcacaacatatgtatactaggggttgttcagaatgatgttatttttaaccataacttctttttaacaagattgccaaaaaaaagtgtctacatttagtttgttaccaaactttggtaaatatataagaaatcctatcaaaattttaataatattatcaacttgccaaaattgtaaggtttattttggctataatatgaacaacctctaattttatctatgtattacttttgtttgctagtaaatgttatggcttataactagttataggcgaaatgatggattaatagtttaagggagtttgagtatgaatagttttggatggttaactgagttttaggtccgcgtcacttatttgtataaacaaatttgttttcaagacaagggaaatataaaatattcttgttggaccgggtatatgttgcaaatcgactcaaatgattgatttccattgtttttttccccattcgatattaatgcatcggcacttgttgctttagaaattgtcccatattagaaattgtttgctgccaagcgtccatgcgcaatagtcaatggaataagtgtccacatgttgcgacaccattatccaaattcgatgaaaggtacctcaacgttgaaatagtgggggctttggaggtggccatcaatgtgttcacttttgttctcaatgtgatgtgtaagaatatatctttggaggcatccaattgaggtcattctcctcttttgcattgagatgcccaagaaaatgcatggcctgaattaagatgtttttttcttcaacaaatgtcactagagtaaatgtccaatgtgatgcggtatatgtgtcttatttattatcatatataataataaaaaagtagaaacatgcaacttgaatatatgtacatatcactccacggaaaccttggaagtccattgaaacggctttaagttcttgaacttgttagggtctcgttattttgtccaacaagaattgaatgaagataaaaaattttgtgatacgtttttcaaactgtgttaaactgtgtgtttcgtgcgaaaactttctatatgaaaattgctctaaaatatcatattaatctatttttgaagtttgtaatagttaaaactcaatcaatcatactttaataccacctcattttgcgtaaaaaaacttaatcttcatcttcgggagaaaaaaacatcatctaagctctctttattactgcctctgtcccatattacttgtcgctttgactgtttgcttgcaacatttgaccattcattttatttgaaaaattagtgcaaatattgaaaatgataagtcatacttaaagtacttttgataataaaacaaatcacaaacaaaataaataataattttaaatctttttaataagacgaatgaataaacattacaaataaaaactcaaagcgacataatatgggacggggtagtactagtctagtacttccaagaaaagcttcttggctaagaaagaagatttgctttttatggcatttgtgcactgctatcattctcatgtcctgaatatcattttctcctcttggcaaagaaattaattgttttgtccatgaattgcttctggccccaaaccccactgctcattattaattcccaaatcagcgttaatagtcatgtgttctcgcgcataaatattcgtctttcctgcaactagcttgttggccacagaatcaaattccgggcaactgctccacagtgatacactagttatgaagtattttggtgatgtctccttgactgactttgctgcaacaattatgggcatgtttagcttgcgaaaaaaaaaagatatcacatcggatgtttcatcggacgtcgaaaggatttttgggacatgaatgaaaaaactaatttcataactcacctagaaaccgcgagacaaattttttgagtctaattaatctgtcattagcacatgtgggttacttagcacttatgacaagtcatggactaattaggctcaaaagattcgtctcgtgattcccccctaactgtgcaattaattttttttaattctatatttaatgctccatgcatgtgtccaaagatttaatgtgatgtttttgagaaaaacattttgggaactaaactaggcctatgttcataggctgatttgtccgagctactcaattgcacttataatcgacactaatctggtggttcacaaaaaataattgccctaaaaaattgtaaattccactgaaactctttttttaatcaaaaccactcttgattaaaaaaacaaaacccgctgcaattagtggtagtattttttttaagagagtggttactcctaccgcttgaactagacacccaagatttccaaatacgttgcgacaaaactattttggcatccataataaagatcatgatccaaccttgttcattagaaaaagaaaagaaaagcaggtcttttttttttccttccgatttactgcatgtcgtgcacgatgaggagcatttccctgctgacttgacccagcgaccccatcgtgagtcatggcgtggcattgccggatattctgcgaatgtgccatatgtacaatgcgatgaagccatcccattttgttaaaaaaaaagaagctcaaaagttacagaagagtttccatgcgccattccttgtggcttcagatagttcagttaactagaaggaaattaacagagcagaacagtgataatctgtaataacagttttgacaaagactactaatctgcctttctaaaagaacaattctactgtatgagacattaatatatgattaattgagtattaactattttaaattttaaaaatagattaatatgatttttttaaaataactttcttataaattttattttacaaaaatcacacaccgtttaaccgttcgaaaagtatgcacgcgagaaatttcttacaatcctcggctgccgaacacaaccaccacgacatgctcctgaggcctgcatctgtgcagtggtgcggcgtgcgacggcacttcgtggctgttgggccttggtccactcatcgttctgggctagacctaaggggatggatacccaggaataataagattcataataagattcacattgactcccttaactagtggcatatccctgagttctcgaccaatcaactattaaaaccggtgtaaattgactctcttgatggttttagagaacggttttgttgacgtgacgtccacgtgacatctcagtcaacaaataaattaaaaaataaagtaggatccacgtgtcatcctctttctctactactgtcagggttatggataccacatacctaatagtagttgactaaatctcggcaggacccaccacataccatgtcctatatggaaacaacctgcggatatggaggaagttccggataaggaaagacaaccagagttctacatggaaacgacaagaactattcggattatatccatattggtttccctagttctacttgaacaaagggacacctatgggtataaatacaaggccctctaggaggagagggggacggacaacacgaccacctcaattgacacccaccatagactggagggaacaacagaggccacaacatacaagacaacatacaccaagacaagacgccgaatatcgacttcagggatagacacggctagtcccctatggtgtctctggatactgtcagtagagacgaaagcgtttctcatataatcaaggaatggtatatatctaaatccaatctaatttcacctataaaaaaagattactattccttggtaatctataggaagggattgtctttttctctgatatcgccgggcacggattcgaggaggaagactaccctgttgtcgactacgagtcagaccttcagaccgccatgtcgacaacagttagataggctaccccacatattgtactggtgtgattatggtgaataagagcaataccggcttcggccaacaggatatagggttattacctgataattcaggggcccgaacctgtataaaagtccctgtctccgtctcttttacctcagtctcgcgtatatcctagcaccgacgatctccatactatgcaaataccagaattgcgacatcaaacgtcgacagtggcgcgccaggtaggggtgttttggtgctctaggatttcgacgagatgggttcaaaagatggattcttcgacaacaagataggacggcggctgacagcacaagcacaagcgccaccgccaccgccaccgccaccgcctagctccggcggccaccgtgcagcagcactccaacattggccgccgccgctactgttcctcttttgtccccgtcatcgttgcctccgcctcctccttgtcctcctctactaccggcgtggtggtggataatgttggagtgtataaagtgaattgactgtctttccctatcagcttaggtttttaggtgcaactggctgatgcatgcaacttaatatggtatcannnnnnnnnnnnnnnnnnnnnnnnnnnnnnnnnnnnnnnnnnaaataaaataattgcagcccactccaatattccacgctgagacttgagggggtctcgtgtgaggaagagtgttgaagtgtataaagtgaattgtccacctttccctatcagcttaggcttttaggtgcaacttggaggctccattgccatacgaaacaggtcgaaagtgccaaaaattaaaatgacttctcattgtgaaaggggacggaacaaacctgctggtgcaccgatcgagctgcacaatgtcagataagaatgggcaatgcaactataagcatgagataggttaactataaaatgagatcaattaattaacctgttcattaagttaaggcaggtctagtttcatatatagtgattttgtgttgaagacggagttaaagagccaaggctcatacagttgtacccccagttgagtttttgcttgtggagtggagctgaaacctcgttgatgaggacatcatttcatcatatacgcatataacttcacacgttccaatgataattccacgtccaagtctaatttagcctccggagataacactgacttcaaacgaacatagcgccctcatgcctactctgatttagatgatcttgagcttgatagaaagcttatctcgtcacctttcaaacgcattcggtctaggggtggcaacggggcgggcagggccgggttgggttggaatgccccgtcccctgccctcatgcgggtatccccgccccgaccccagaaacgaagtcgagtgaaaaacatcacccatccccacccccacaggggacccgacgggtgaccggggtcctgcatcagccggatggagttaatactccatacaaatattgcaatacactgaataatagtatgataaaatttcaatagccctcggcggtgcgggttggttcaaggaaggaaagggattacggttgaggggaactagggtgttgagcttttatatgttaatttgaatgcgattgttgggtctatataggggtgaaaacgggacggatatttcctgaccgcccgcccgaccatattatttcgggacaaattcgggtatccggatgttttcacaggtagcgagtccgaatacaactatttattgtcggatatgggatcgggtttgggagcgtggtatccgacggatacgggttatccggaaaaaatacggatattaccctgttaaatatccgggtattactcggataatctaatacaagcctaccctaataaagccaaaagaccaaccaccaacccactaagggtgtgttcggcaccctttttctcaactcatcttcctcgttttccgcacgcacattttttaaactattaaacggtgcattttttgtaaaaagtttctatacgaaagttgattaaaaaatcatattaatctatttttttaaaaaatagcaaatacttaattaatcacgtgctaatggattgctccgtttcccgtgttattccgggttaggaaccagctgcgaacacaccctaagcattcaccacaaggcccaataacaatattgactgtctaacaattactaacaataatattgactgtctaggactagaagagagagttagagagatgactgtttaggattaggagagagaaatcgagactttctgtgtgagagtgaggaattgcccaacaacaatataaaatgatttttaactacgataatactatgcttaggtattattgtctagtacgtgtaatacatgtttgtctcaataagtactcgtaaccgatagcgtatgtatctgtattggtacgtattcgttctatatttatacccgatattatccgagtttatatccgtatttgatactatccgtgtccgacccgattccgattataaattgtgggttaggatatgggaaggatgagatctgaccgaacctgacctgttttcacccctacgtctatattattgcaatgtgcaacttttatagaaataactcatatccggggcccctctgggtcacccgcgggttaattccgattcccgtccccatcgccggaattatgcggggccctgtccccactcacccacgggtgagaactcccccggccccgcccccgtaggggcgggtccccggcccaacggggaaattgccacaccctaatccggtttcatccaaatttatctcgagtcaatgggaatcatcgttgttgctgaatctgaacttggccttaggccttgtattagactagggccatctcggaagtgtctcccttcagctccacgaattaacctctataaatgtttatgtagaccctctaaaacaattggattttgtttagttgaattttgcaaagtgccattcatcatgtctctagttctcgctcaattagtcggcgactatgcattgagagccgccaatagttggtgtgttgatttgcctaatcgattagatttaccacttcaattacaactatttctttgtgcttaatcacctattcacaatatttagattacatcctatcttgttcttaaaatgttctctcgttagcattgcagggatcatcaaccacgcgtcacggttggtacgatatcgtttgtggggtagcgattacacgacgtcttgaacttgttctggtcgtagccacatcgcaaacgtcgcgcttgatcaaagagaaagctatcccctcaccagaagattgggccacgagagagagcgtcatcaggatcgctccttttccgccactactttctttttagtgtgaggattaagtgtctgtgctgcaagtatttacgctttatttatatttcgatatgtataaagatttatgatattattacctggcttgattcctggacaagaaattatacacaaaatagtctgaaaaatttggctaattttttggggcgtgacacccacaagagatctagcgaacgtcgcatgctcacatcccttgatagggaatgagtcgttgacacgtgggtcccacgtttcgtttcagcataaaaccacttacgaaatcttcaccgattttcgaagatgaagaaagttctcagtccggtttgttttgcggttgagggagaagtttcgattagcagaaacaaataaggaaggcagaatagacttgttccccttgattgctgcgagccgcggttccatacttccatccgtgagcctcagacatcgccgccgtgagccctagcctcgccgccgcggcgcgtcgatggacgtcggcgagggcaaggggttcggagccgtggttgatggcgtcttgccaccggagatgctgcacgaggtcttgcttcgcctccccgccaagcccgcgctccttcacctccgacccgctcttcgccgccgcgcacgccgcccgccaccccccttcacgccgccctcctcctcgccatcggcgtgcagagcttccccagattctgtgtcgatcttgtcgacctgtctggcgacattgtcaagcagctgatcccaaaaccccaatcccaagtggggagaggcatggttgtgagtgcgacctcagacgacctcgtcttcctcgacggtaaggagcatagcattcacctgctcgaccctaccaccggatccatctccgccttacccaccaccgaatccatgtccgctttaccccactatggcgacgtcagtacagactgctcaatgctagcttcttgcctggtttgcatttggccaggtagcatctcccacatgagagcgtaagctagttcagattgtgaagacattgagagatcgttacgtgtccgaggttatcaccgtcagccgccgcggcgtcggtggacagcagcggaggaaggtggagaatccacctgtacagcttgattgtttctgcaccgatggagttgtgttcaaaggggctgcttacttcaacttcgatatcctccaatgttcgccctccgttctagaggcaggttgcctgccttccttcgacctcgcgatggagcagtggagtatgaccctctaggggccggcgaagagcattgttgaggaagccaatgacagacttagctatcatgaccttgactatcattttatgttggctggaattaaagacactttgtgtacagcgcattgggattatcatttttatgtggtggatctatggtttctaactgattctgaaaagggtacatggtccaaagagtacaggattaatgttgatccatctttctatgggattggagattgtgtgaaagtgcatccgttgcttgtgacggatgagggaaatgtagtactctggttgcagatgccatcggaagggatagtgcagatttataatccagtaactaacactttctgggatataactcaaacgagcatctataccggagtaggtgtgtacactggaagtttattatgtcgagggagtgtgtgacaaggtaaagattggtctcacatcatcatatagctcgtatccatggaattgtttggttatgtttgtgcgctttattggtttagccacatcaacttcatttggttatttatttttaaataacaagagcagttttattagttccgtttaaattttcatcgtcttagttgtttttatgatgctaaaaacttccgtaaggtcacaaaaatatgatgatctccaactccaattaggaaatggcctttgatgacctgtttcatcggaaataaaataaaatccatcattaatcataatgattcatattcattgccttagttgcttttatgatgcaaaaaacttccacaaggtcacgaaaatatgatgatctccaactgcaattagcaaatggacctatataggttgatggtctttttcagaaataaaatgaattcagtcagtaattaaacacttgatcatctattcattgagatgtattataattatgaattgctggcaagaggcaattcttgctgaagttgtcgcttaaggaggattgagccgagcgaacatatttcttctccatgcgttgattagaaagcataataacccgggtctttgtgtaactatcgaggatgagtgggaggtgtggagggtcgcgggtctgttgcggcctcttggttgattgttgattgttgcttgctgtatgttcttagcagtgctgtgagttgagctgcctgtgctctagtgttggttgctcagctgtttgcttactgtaattttgttgttacagttgttaaaaccccttcttttcccttaataaacttcagctggctttccgctgccccgcgaaaaaaagcacaataatgggagggtcttttgagtctgttatgatctgtttacaacagaaactaatttgcatttgaaaaaaaaacatacataacatttgtatcagattttcatatattcagttaatatagaaaatggattgttctatggtcttatctcatgtagtgaccaagaaatgctggaagtcacaaattgcttcaccaaatagtgaacttatgcagaagtggataataatacagagatagttgaaatgatcagtcctagattaaattgtcaattgttttctcaatggcataatgctagggagaaaagttattggctcctagcagatagctgtgaggagaaatattcagtatcctctgtcgcaaaatatgggaaaatatgtagtgcaaaccacatatgtactgaaaacttggaacctaccgttggatcgagaaatggacgtctgagattcatccacgtcaccatgagttaaaatttaactcgcagattcactcatgagttaaaattttactgggagttaaattttaactcatggtgatgtggacgaatctcggacgtccatttctcgatccaacggtagtttccaagtttccactacatatatggtttgcactacatattttcccgcaaaatatagctacttttaactatgcatcttgacaagcgtgtcataaacatagtgtcaattaaggcttatgtcattatttggggaactgaaaagaacactgtttctttttggcaaaatttgttctatatctggtgatatcatacatcggaaaggtttttaacacatgcctgtttggtatcttgatgcgaaatgctttcagctacgtacattaattccataaaacttatccacgactatactagtgtctcatttatattcatttctttgtttgcaataaagatttgagacatgcacttgaagattgtgtctgccattgtattgggtccaatttgctgtatgcaattcatactatccatggttcattaatgtcaaatccgtactcaagaaagctctgaaggacttgtctcacttggacacatggacgaatttaaaattaattaaccttatgtatcttttggtaatgcagtcaataatgcttaagcacaaaaggcaaagcttgagataagatactatgttaacatgcaagttatccacagttccacaccacctgtttactgtgcctcttcgcttttttttttttttgtctttgcagatggttggatcagagattggtttctctattctgatatgatttatttcccccttcagcacttagtaatacttagggtgcactaactgcagttcacttcgcagtaggttgtcacctagagaagcactgaaattgatttagcccaacccttgctagttctctgttagaatgtctcttttttagagagtgtgagagagttttttttgtcagatttttcagatgaactctgctctgctctctctctctcttctctggagtaaaaaaataattcctccagtttactgaactgactgaagccacaccgaacggtcatgcaattgttaagaacaacaatggcagccaagttgttatcacaactcgaatcgaaattgtggcatctctagcagttgcagaccatgaaattctatggttctaccgaagcaggaaggctggactcttttctatgtaaaggctttctcaaaattggatgacagaaattgcccccttaatctgaagactgtcgctgaaagaatcacggagaaatgccaaggtttgccactggctcttgtagctatagggagccttttatcgtacaaagaaatggaggagcatgagaagggagttgttctataatcaacttaggtggcagctgagtaaacaatccagagctgagctgggacactagtgttaagaatctcagttacaatcaacctggttttacctcaagaattgctttctttactgcggcctgttccctgaagattatcggatcgacagaaaatggttaatcagattgtgaatagatgaagaaactgttcaggacagagaacctgagacaccaatggcagatgtagcagcattgtcacctgaaggaacttgctagtcgatcattgcttcaggttttggaaatgaatgaatatggaaggaaggccaaagagattccagaagcccagatgcatgatcttgttagagaaatagccctaaccatatccaagaaggaaaaaattgctaccatatgggactgtcctaactcggatggaattaccaatggatcacagtgtgcttcttacaaaaggattatggcaatttagtccaagcagcaaaatgttcatctcagcttcggtccatgttcgtgttttcagaggaaatatcatcgtcttggttcagactgctgcctgagaaattgcaatattcagaaagtgccaattgttttacttgcactacctaaacttcgggtacacaaaactgaaagacataccgagattgatagggaagcttagcaatctgcaaatgctttatctcaatggttctgtactggagttgccaagtgaaaccacaatgttaactaagcttcaccacctactcgtagatgggcggtttgggatgtcagcaagtagcaaaataagtcaactgcaacatctacagtctctgagaagcatagaagccaacagctacatggttaaaaacattggatgcttgacagggatgagatcatgaaggtactggagtcccacaacacagatctatgggcctcaatcagacatctctgaattcattgtccgttttcgcagaagatcgcgatcgatatattcttgatctatggacaacttgaaacctctatctcacctggagaagctaatgataagtggcaggatacataggcatctgggcttcaaaaccattacaggtaaaaatcaacccagtcaaccttttctctcttccttcttaatgaaacagcagagctcctgcttcagtttcaaaaagaatagggtatgttcactttgttgggaaaaacatgccaaattttaataatatagaattaaggttgggtggtgtttggtttgatgtcttaacaaattttactaatttttaagagtgggtaatttcaaaattaacaaaatttggtatcttaccaaaaattaataatgtcaaaatttgatacatttgacgttttgtagcattgaatgtttggtttgaagccttgctaaattttgatggagttttttttataaaaaaataccatttttatagggtggtccgcaatcatatagtaggccttggcttaacgtgagagttttctactcccgtgtcctcttgcggcaacttgttggtgttaaggagttcgataagcggtgttcactagtcctgagtggtctcgatgtctgtgacggttttgtcgatctaagtggtagccctcgagccaacgtcggtggtgctatcgatgtcgtcgtctggcgaa

SEQ ID NO: 21541 - DNA, 30163 bp, Oryza sativa
  unsure (1)..(30163): unsure at all n locations
atatatctcatataatctccggcaatatcgttatctaacctccaatcggctaacatctgttactagaaggcagccgattaggttaagtagtgacgttgacatagattatataggatatccaccactctatgaaacatccacgggcttgattgtctagatattgtctttcttttcatacttatagttgtatcagttaagtttgaccttataagtcgtgattaggatctcaatctctagcctgcttttggttgccgattagggtagcatcggggtttcagccaatcttacctaatttaactatatttatctcatatgcttgattgacatgttaaatctgccctttatgttaagatcttgctgcatttaagtatattaggcttttgtttggtatattttacttgctttgatatcttaatatagagtggtatcggagtattacccaagacacgctagatctatctgatcggctatgctatgaacatatatagtcttattgttaatatatatttcgatctaagtgatttatactgtctcggcatggcgaccgatctatcccaatcacttgatttaagtatatatcgacataaaggctacatattgttaatatctacagccgatcgagtagatttagttctttcttacttatttatgattgccgatcgatctatatgtgacatcggcttaaaaataaatgatatgtcatcggccactagccgatcggctatcgtttatagatttaaccgcggtttctttgtctttatttcatgttgattgcatgatcaaatcaactggcatgctcacgaacctaaaggccagcttttggacctgcactagagttaagcagatttctcaggccttgtgtttttacatcaacaatagtctaggaaaggtctgcacgtcgacagtgcaagaagcgatccagggtggcaagcgacgtgtgcggcgatgaagagcgtgtacaaggtgaagaatagccacgcacgggggccggggcgtggagatggcagatcgacttggtagggaggtgtagcaggacctcgagctacatgtctggaagcaagatgcagtccactgcggcggaggatgacgtcattgaggatgaggagttgagactagcggtgaaaacagatgtgtactttggccagcccgcccgactgactatacataattcaacaattacagcttgcacctatttattccattctaaaactataaaatttgcttaaaacaaattttttaccatgtagaccacaaaagcatttataaactattatattgaagccacatcagagtgttctattatagctgcaagtagtcttggcatcgggggcatatcaagctcatgtagaccctcaatggcccggaccacttcacccattgtcggccgatcagactcaatttcttggatgcaccaacatgcaactttgcaaactctttcagcctcttccaaactgaagtcgtcatgtaatcgtggatccatcaaactatgcacatctcccacatgaagcttgttaattgctcgcacaggaaaataagcaccatgatagctgttgctagcagatactttaggtgaatttctccttcctgatatgatttccaatagtaccatgccaaagctgtaaacatcaacttttggtgtaatagcaactccgctaagccactctggggcaagataccctacagtacctctgaatgtagttagaactcggctaaaatcccttcctacaatcgctgccatcccaaaatctgcaatcttaggaacaaatgattcattcagaagtatgttttctggtttaatatcacagtgtatgatgcattcgcgacaactctggtgcaggtagcacaatcctctagcaactcctatagctatttgatacctggtgctccaatttagaacggtagcattgctctgaaatagatgggcgtcaagagacccatttaacatgcgttcatacacaagtagcctcttatcaccttcgcagcagaaaccaatcagtttgattaggttgatatgttgggtcattccaattgagctcacttctgccctgaattgcttctctccctgacgagcaccatcaagccttttcactgctatagcagtctggtctcccaacattcccttgaatacagaaccaaaaccacctcctcctagcttctctgagaaacatttagtagcacgaactaaaccggtgtatctaaaggctataattccaccatcattaccttgactgccatataatggcacaccacaccacttggatttgttaatccaaatcgttaacaaaagcatgagcattagtaatccaaaactaacgacaatgcttacaatggcaacaactcttggtctccgtttgttgttcttccttaaactttgtgaatctctggcggcgaggcgaaggtaaagaacattttcagaatgattatcaatgccatcattctgattcacacttcgcaattccccatgccagatagagcatctgttaccattataggtataagcagtgcaagcgcagtcatgaagacaagcttcttcgcaatcgctctgggtcgaagcatcttccatgctttgagggtacaagggcagtgtaacaggagctatggggtggaacatgtctgttgaacttgtgttgttttgtttaccagatgcacaatctaagggagtatctctgatgcaccctccaatcggatcaccggcatcccaatcctgcggtgacttgggagagaagctctccatacatccacagaatgggactgaattgccattgcagaccgtgaaaggtccacagacatcgtgcaggctgcatggatcagatggttctgcatatatggtttgccaagacattttgggttgtgaccaaacattcagcttaacctgaccagtgatgtctatggaaacgaatacagaagccgattcatcaagggaggtgtacgtgaagtactcctcctcattgttgtggacatatgcaggtttgagcaagcctttggtccgtggatccatgtctagcagctcattgagcaatggtacaagcgtatacgccaattgtccggatgaccaagaccaatacaccacgacgggaggtttgcgacgcctaaggcgcaacaccgtgtttgtgtccatctcaaggatgtaagagccgaggcccatatcaatgaggctcttcttggcaacgaaccgacggttcaaaccggtgatcttgttcctacctaacttagcacccggaagcccaacatctgcagggtagtcgaagctctgccacaacacaacattgctactagccatgaggagtaggtttccattgttcatgaggagagcactggtgtttgtgctggatgatcctgttgtcctattgacaatggtgtgagtgctggaccagattatggactctgaactggtgttgttgttgttcaagacgatggcaagattgccatctcttgagattttgagctgtgcttgcttcagctcagggccagtgatgggattctccctattagcaacccaagctgtagtaaaaacctggatcttgttgaaccatatgccaagataccagccaggcaatgtgttggtggtggtgttaatggacttactgatgcctgcagttggttgtggctggaagaagccgagcgcgaacttgccgttcctcgagacgagcttctcgccgacagaaagcgcttggcctaccatgagagtgtcgccatctgcaatggcggcggaacatggaggagtgtgcagggaggagaggagaagcccactgagtagtagcaagacatagagaggaggtggcatggctggagaagataggtgaataatggctgaattggagaagggaggagtatatgcttagtaacggtttagctatgtagtgctggtatatgcttttatgttttatttggacaagtaagaggaatgcatgaggaatgcatgtatatacagagaacacacgcgggggactgcatcagcctatccatctatcatggggaacacatgaggtttaatgtaattcttccatcctaaaatatatcagcctagtatagaataagatacattctaatactatgaatctggacaggggcctgtttaaattcgtattattagaatgcactccgttttgtattataagtcactttgaccttttttttctgatcaaactttatgaagttttactaagtttatagaaaaatagtaacattttaaacaccaaattagtttaattaaatctagcattgaatatatcttgataatatatttattttgtgttaaaaatgctactatatttttatatgaacttagtcaaacgtgaagaagtttgattaggaaaaaagtcaaaacaatttataatatgaaacataggacgtatctcatatgttgctatattttagaacgaatgtagcataatagatgctgcaggttggagtacatgcatgtttaatttaggcagctgacaggtagaacaggagctgcaaggaccttccttggtcatgtttgttcactctcatagattcagagtttcagacagcaacttggcctggtagaggtacaacggtactcgacacggcaacgtacgatgctgcgggtcatgttggttcacatgtctactaggtcctgcagatagaagagcagagcacattcaagtcggcatgatgattgtgaaaattaatttgttcaagaaactaatggttttatacgacttcgaatcaaaccatgacctctgtatttgtgtttccacataggacacatttgctgaattggctttatgtgtttagctcacatcaaaattggaagtttggttgaaattggaacgatgtgacgaaaatgttgaaagtttgtgtgtgtaggaaaattttgatgtgatagaaaagttgaaagtttgaagaaaaactttagaaataaacacggcatgaaggagagattctttgaaatcggaaagatgaaattagcagttcttgaaaagaagaatggatgagctctgaactctctgttcgtcacaactatgttttatgccgaccaacatcatcttgaaggcttttgcagctgcctgtctttgccttgctgatggcatccacaatgtggatgacaagtggatagtaagaccccttactacttactttaccattgtgaaggactggaggtgggtagtctaccctataattcaccaactcactcttacacctacattactcattcatcaaatctaacggacagtattcctcagtgcccgatctaacgatcatcgcgtccacctcagtagtgtactgccgaggctgctgtaatcgcgtgatttatttcccatcaacgcgcgcgcctcactcccgaaatacctgccaccatctcaatctgtcgatccccttcctcgaatttcggaatcctgaagcgcgagcagtcggcttccgcacctggtgccaacggcctcgtcgatcacctgatctcttcactcgtgcgcggtcgacgttctcgcacgcctgcgaggtcttctactggtgaggaagcgtccgtagaccgctcgctaccgagaggatccggctgctctgtcgccgagcatgcgtccccgggtccctctgccgccagagccagggccacatcccgttctagcggttggcgatccttgcctctttgccatggcatgagagagctctgcagcgatggccacggcatgagaggggccctaccgtttagctgctgccctcttcgctgggccgtccacagcttctcttcgcccattaattgtgacgctgcgcctgtttatctcctccctcttgatcactcacggtcgagaattaaggctgtggcgaagtgggcggtggataaccttggaaggctagcgaccggataatcctgatacattatgcatgtccttcccaaaggagctctgctgccaagcaccataatctctacaagagcacaggctcatatatgcagggaaatatcctttttttcagttacttcagaaaggttaacaggtttgtagcggatctatcgttgctttctgacttactgtttctctgaacactgaaactttggttcctctgctggatttcatgtagatgaacgtgcaggcaaggtattggatcaaccccaataagatggtactggagatcctgcatgctgaatccaggtccaagcaggaaatggctctgctgctttgccaaaacttcatcactatttaagctctccactctagatgttcagggttctgcagatatctaggctggaaagggaagaatatacgaagtagtacaatcctaacatgctacattgtgttaaaaacaaaaactacatctgtagaattgaattgtatagcagaatttacataaattatcatcttagttcaaactaaatattaatacgaagggatattgtccaaactgataaaatgttcattatagtaacgcctgattttcagtacgacttgcctgaacctcacactaactgatcaaaatgtgcattcatgactaaacaaagaagaggctgctctctgtttctcagtcattcaacaaagaggtcggctgatcaagagttgtcttattgcaaccagccaatcttatagatattctcttatcgttttatgcatatgtatggcacaaagttatttagtgaggtgaagtctgatcctaaaaattggggaagatagtttttagatgagttgatgtcactatatcatataatttgaaaccataattgaatgtaatattttaatctgtaattgtccctgtatgctctttttgtttgataatttgagaagtcagattccttgggtgtgcgcaaacgcgcctcataatctaatgttgagcagtattcatgttaatcaatatatagtaggctgcttgggctcatatgttcacacttttggctagcagctacaaggttgcttctatcactttgtccgctgtggataatatcacgagtaaagcagcaccatcaatgcccagtacaagcctacaaggtaattttatcgtcaatacaagtgtcagaaaccatataatgctcaccaatttgtggtttatccttttagacaaactgacgttttggtttcttaccgcataaatggagcagaccaatgtcctctgcaaattttattcataatctgcctattctatataattctatatccactgttcattcattcttcttactgcacaataatcattttgtacaaataaatatgtagtagctttttgatgttcctgcaatatttgaatagatgagtgtaaaggaatatgtttattctttgcagcaggcagctaaccactgttacatcttgattagtaaaaaaatattgctttatttgcatttcgcattttttgaaaccctaggagccatttattaggtttttgggcagcacatgcttttcatgttagatttcagagcaaaatagatggaatgctacaggttggaaaataaatatcaatgccctcagctaaggccaccaatgttggcatcaattgaagctgcctaacaaataagaaaaactttgtagtgcaaaccctatatataatataaacctgaaaactactgtagaattaaaaattgaatctttggttcacgtcatcttgagtaaacttttgctcccagttttaaccatgagcaaaggttttattaggattaaaagttttactcaggatgaactggatgcatctcagatgttcatttttggatcctacaatagtttcccgctttgcactacatataaggtttgtaatacatatttttgcaacaaataatgtgttgtatttcacaacagttatgtattggtctattgtgacatagttctagcaactttaatgatttcttctgctgcggtgtaacctgtaaatatttttcttcttctcagccaaatgttattccattagaggatttaatttgtttattcaaatatcttaaatacaattttttttcatcattactctgatacaaatgacgattattgatgaagcaatagaaaaacattaagtgatgtttgtttatgcctaaagaaattgctcccacttgattgagaattgaactacacaactaaaagctgcccaagtttgtgatagttataataataattaaattagcatggatgttgacatatataaattttttatgcatgcttactaaatatcgccgtagcgttagcacgggcctgctactagtagaggaggtaataactataccgggtaatagcactgctacctggtaataggcataaaaaatattaaactctctcctctctcactccctctcttttttctacccaatcattactttacacgtgggttatatcttactatccacacattatagatggccaaaaggcccgaggcccgatggcccggcccacggcacgacattttggcccggccgccgggctttgcctgggcccctccaccggcatgttgggccggtcggccaggcccgacaaaaaaataatagggagcaaaaatagacatattatatgtcacagttcaaagaatagggacgaaaaatagacttatattagctatatatatgtcagcccaatgaggagggaggaaaaatagacttattttagctatatactagaaaatgagcgtgccagttggcacgctagctaagttagttaatagcatgtgtgtatttcccttcagaaatcatacatttgaaaaggattgttgaaagtccattcccttttatttttatgtttgtgaacaaactaagatagaatagtaaaaccatctagattagtggtattatcatgctgaacagactatataacatcgagaaatgactaaagatgatgtacattaataaaatacatgttttactaatatccaacacaattctcatatagatgtaagtcattgagttcgtattagtaggaaatacatatccgaaataaatgtgtcttcgattactattttttatactaatttcatttagaaataaaggacgatgacatggtaaagacacttattttgatttcatatatccagatatactactatgtagagctcagctggtcaggttctctacctatacgagttaagttctaaacttagcatagacgcttgtatttacggctatttgttttttcaatggtaggaaacccaccattcttcatcactcctaagatatgcctgatggcccagtcttcgaaggtgcttgtagtgattgggtttgtatgtgtgcgtttacaggtgtgtatacacacgtgtatatgaacatctatatctactgtgtttcgcgataaaaaaaatagcagtatgattgttgttacttaccaatgttccaaaataaatgaattcctagcataaaaaagtataatgtgaggagaaaaaaacaaaaatactctgaattaataggaaagtagttataaacttctcggttcacatggaaatttcacttctattccttccgttctataaaaattcaggtattttcctcgtttcaagtaaaccttatctgaagatttttaattttcctaacgcaatccttgctgtcactatttgttttcatttgatttaactatttatttattttattctcttgaaacacatgatattaacatgaagtgacttttcctcattccgagtaatctgtagtaaattgcatttgttaaaagattattatgcaaaggctaaaaatcctattatttttttctccttttctttttattcatattattttattctaaactggcttagtaatatgtacctgtatgtgctagcttcacgctgcatgaggaccatgcgcagcagcgcaggtacattgtggagaaaggccgtgcggcgccaggcccaagctcgcatggccttgcgagatgcctggcccacgttgcaagcgtatatacgcgaacgttttcccgatctctcgcgaagtgaataccgtcactttgactcgtggcaaatttttggagggggtgtaaccaaatttttagggagccacgtggcccaataaaaagccagatcccctgatttcggtattaaagatatgccacagcctaaagaggagggaggaaaaatagacttatttttcaaaaggcacgatggaccacccgtgccttcgggccggcccggcacggcccgactgctggtgggccgtgcctgggccggtggtgcagcccatgggccagcacggcacggcccggtgtgttggtcgggctatgccggcccgacagattttggcccgagcacggccgtgtctgggccgtgccgggccgggccgcccgaatggccaactataccacacattggccgtgtttagttcccctccaccaacttcaaactttcaacttttcatcacatcaaaaactttcctacacacataaacttccaactttcttcaaacttcctaatttttccaccaactaaacacagccattgtgagaggtagaaacaactaaaacctaattatgtggatcccatcttactacccacttgataaaagaatcaatttacagtggtctcgaattccggtgaactaatctaacttaatttgaaatgcttaaaaacgacatctgaaaagtcagtatcaacgaatctgtatcgacgactgcggtgcaggggagccaggaggcagtgactactcgactgatggctgccgaaagtctttagtaatttttgccaactaaacaaggcattaactgaggccgagtttagttacaaactttttcttcaaactttcaatttttctatcacattaaaactttcctatacacaaacttttaacttttccgtcacatcatttcgggcttgtttggtttaataccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcatttccaaatatttggctttaaaccaaatcatcacatttactatttaaactaccaaaacattggtatggcaacattttggtatcaaaccaaaacggcccttcaatttcaatcaaacttttaagtttgacatgaactaaacacagcctgacttggatctgaacttgacaaattttgtaccaatccgatgtagcagaccatggatgtagttcttttgtcttagcgtctgtccacctccaagcatttgcttcaatgcttagaaaattatgacagctcacctctatccttgattgcaaaatgtgctgcccttatgtagattgaaaaatttgaaactattccaaataacatccaaagtagtactagtaaagtagtaagagaaggtatttcatcgaactttcccaattcgcttcctccccatccaaagtagtagtgaagtagtaagatatgtataggagttttgccctctgatggcctctgcatgttactaatgaccaagtgtatggatagctgagatcattagttattattagttattgattggttgaattgaacgtgcttaggttgcactaactgtaatctttttacttatggcaataaaatgtttacctgattcatttacttgcgccgtgtttagttccaaaataattcttcaaactttcaacttttccatcacatcaaaactttcctacacacataaacttctaacttttctgtcacatcgttccaatttcaaccaaacttccaattttggcgtgaactaaacacacccataaacttccaacttttttcttcaaacttccgattttagttcacgccaaaattggaagttaagttgaaattagaacgatgtgacggaaaagttggaagtttgtgtgtgtagaaaagttttgatgtgatggaaaagttgaaagtttatagaaaaagtttggaactaaacttggcttacgtgtgtataaaagttttgatgtgatgaaaaagttgaaagtttaaagaaaaattgggaactaaacgtgggcttactgtgacacacttcttgctgaatgtcaggtgtatgttaaacatgtgttttagttgagattactattgattggttgaattgcgtgtagtctgaactaatggcaataaattagttacttgcttcatttgtttgtgccaaacgtgtactctgcatgagttggtttgagttcagactcttaagtctgaatttcagacaagttcagaattgagctggttgaatttcagagagtttagaattgagttggttgaatttcaaagaagttcaataaattagttacttgatatatttgtttatgccaaagtaataacaccagtagagttgattcggacaatgagggttttaatggtgtcaacagctggaattaccgaggaaggctctgtcgctgaaactgacgccggcgttttttttaaaaaaatattttgatgggtgatgccggtgattttggaacaacagcaactaatgtttctgttttatagagaatacacatgtgcatgcaccgtattgtttaacagctaggagcaatcttaaccggcattatatcaacaaggtttaggacgtgtttggtttaaaaccaatttttgctctaccaaatcttggtagtgccaaaatattggtaagttttgacactaccaaattgggttgtactgaatttgaactactgtgagtaaaatttggtagcaaaccatatatgcactttttattattgaagttaccaaaattttggtagtataataagttggtatcaaaccaaactagcccttaaactgcgtccaagcttttcaaacagctgtccttccattagctttgttaaaagttctgaaaaaactggtccaaggaagagatgaaggatctgaacttcagacttgataatttcatagcacctatccaagagaaattttaccgttcttgaggtaccacaacttcaatcccactgttaattccacaggggtgagatctgtatggggaaatttattgacacaaccaagtcctaatgactatagttggccaaatgggccgcccggcacggcacggcccaggtccggctgtgcttgggccgaggtgttgcacacacgtgctgcacacacggcctaggcacggcccaatacgactcgggccatgctggactggcccgaaggcatgatagcccatcgtgcttctccacagaataagtctatttttcatccctcaactatgtgggctatgttcatatggctagaaataaatctattttgtatttctctcctttttgggtgttgccttatatggttatttaagtctatttttcatccctgtactatttttcttcgatcgtgccatgccgggccaacccaccgtgccgagggtgcagcccaagcatggctcggctgtgaccgggccaaaatgacgtgccttgggcgggccgtgggcctcgggccatatggccatctatactaataatgacttaaccgtaacctgatctttatcctcatctttctctccagggttatcttcctttcacaacaacacggacacgcggtgatggaactccttgtgcgtggctcgctttaggctgtgttcggaactcaagttcccaacccctctcactcgtttttcgctcgcacgcttttcaaactgctaaacgatacgttttttataaaaagtttctatacaaaagttgcttagaaaattcaaattaatccatttttttaagaaatagctaatacttaattaatcacgtgctaatggaccgtttggtttttcgtgcatgggagatgggttcccaaccccctccaacgaacacagccttactcattccagcggcatggaaaaagaaggcaaagaagaagatggttctaacgtgtgggtcttgcttgtcattgagggaatagtgaggctatgagcttgagattggtccttctggaccagccttgctgtagcagaaaaagaagagaaatgagaaacaacagaatttacatatatattacgtactttttttattatattagtataatcacataaataaaaaatattcttaattgccaaaaaggtacaaaaattttcagaactcagaaaaacgcagccaaacctcacgaccaaatgtaatcttacatgaatacaaaggatggacatagctatcattatctgctctctacctcactttccgtgaggcaaatacgcatctaatggcatttaattcagctaagcatcatgcttacattaataaatgatgacactaaattccccttggactcccactctttggatgaactagtaaaagctaccaccggtgtcaggtgacaccgacgactttcggcaaaagttatgcttaaaatgcttattcatatattataacattatattctaaatataattagcatactataatatcgatagacgataccaaagatgattcgccaatgtatctagtacaacatatcttgagtatttttttataaaaaaataatgttacggcaccagtgcaccactgataaatctgtttgattattgaagaggttaattaaactaatatttaagtgatcatcatatgaatatccggataaaagaaagtgaaaatgaaatgaggtaattttttaatagaaaatggcagtactccgtccgtaaaaaaaaaatcaacgtaatattagatgagatattttctaatacaacaaataacacatcaaatctattacttaggttgattttttttttatggagtacagcctatctggagtagcaggctgaacggcatcgtaattgaaagcctcgtcagagcaggctggtcctcgaacccttccgaaccatccagaagaggagcctcccgacggctaggatgcatccacatccactcatcaacggctaagacgcgccctcctctctccgaatttttaccaacttttactgctcgcatcaaatggagcgcgggcgaggcgggtaaaaaaggaagcgaagaaatccgtggtatttatattttcgagacccaaaaagaaaaccacgaattcccaataaagaaataggcaaaattccccatctcctcgtctcctcccaactccaaaccctagctcccaccccctctcgccgtcgccgtcgcgtcccatggcgaagtcgcggccgcccaagcggatcctcgagtcctacaccatcaagggctccgacaaagtcatcaagcgtgaggctccccctcccacctccccaaccggtgctcccttcgatccggaatttctgggggtttttttgggggggattttttttgtgggggcgtgggtttcggtgggtcgcggtttgttgaggtctggaattctggggttttagctccggttagattgaatgtcgcggaaatgtttgctctgtttcgggggagcattttaatttccctgatgtttccgtgcgaaatgaaatggtgtttaggtctctggtttactgttgatgtaagctcgattcataatcagaaaaggaaaccatggtagggatatgtgagcatgttaacttaatctgttggagcgttaactctttgtggttttgattgttcatgggtttatctctcttttgcatgggttttaggacggttaatacagaaaaaaatatatgtgctattgagttatgttatgagtttaaactcatcttgattttctgttttagattatgtccagtggagcccctacatggttttgtctgggttgtgagctacagttttagcaccatgagctatgtcattttgctgatatagcgtttttaattgcaatttacgatcgccaatagtttggattcatatgttgctaatcccagttagcattatgatcattgtggtgcttatagtcgtgctgtaattcttgtagcttaacccctcgaaaaaaaaaatttcttgtagcttacgttgtgtttcagttctggttagtattagacatttgcatgaagaacaataacttctactcaatgtgtcttacctttgactttttatttaagaaaatctttatctcatggcttagaccttgtgttaagctaactaattgattctatccagttaggcatcttaagttttttttttgatagatagcgtgctttagccttaaatgaaaaacgattattttgcctagtttttctagtcttaactcttttttgtgctatttattcaaagttgatgcatgcgttctactaatcttagcttatgcaaaggtcagagatgccagattctgagatttctgacattgttctattggcacattgggattctttgggatggaaacctgcctagataaaccttaattaccggtatattacttgcaccaatctatgcaaacttaaatgcttcttctagcttgagcctccttttctatatttatggttaatatccagacgtgtgatagcaccgatgaaccttgatgcttcgattaccttgtgtgtgtgtgtgtgttttgagaacagattaccttgtgtttggtgaacttttgattaccttgatgaacagacgaatatttttcatggtttctaggagggtaatacatatatgtgctgttgagctatgttatgatcttaaatgcactttgatttcctgaattcctgttttagattatgggagttcagtctgtaagtagttttgtatctgtttgtgagctacaatttagcactactggcagaacccttctgctagatataatctagaatctgccttctgatcgtcattttgctaattagagatttttttaccatcttaatggctgtgttcatgtgttgcaaataccagctgtagttacaattgtttatggtgcttatagtcttgaccttctagcctatgttgcatctaagttctggttggttttgacatttgcatgaagactaatctctttctacacaatgtagctactgttggactttttactgaagaaaatgtttgcttaactgcttaaagttatgtaatcaatactatccagttaggcaccctaaagttttgttttggctagatagtgttctctagccttaaatgcaaaatcaatatgttgcatagtctttctagtctgaactccttttgtgctgtttgttcaaggttgattcatgccttctgctaatctaacttatattcaagttagaggtgtcagattctgaagttttgatatctgttaaattctttggtatggaaacctgcccagataaacatagttactacttacaccgatatctgtagacttaattggttcctttagtgtcagccctttgtttaattttataattcatatctagatgttgacagcatccatgaaccttgatgctttgattaccttgtgtttagtacactttgttttactgtaagcagattgcatttcctttgctctgagattatcactgtgatgccagtactatccaataccagctttacatcttgatgatgacccatgtcactattttttataagcataaaattatctcgatacctgtctgattctcttatatgtttcttgcagctggggactgtgtgctaatgagggcatctgatacatcaaagccaccctatgtggcaagagttgaggctattgaggctgcagggtcacgaggcacaaatgtgagagtacgggtgcggtggtactatcggccagaggagtccatgggtggaaggcgtccatttcatggtgccaaagaggtgttcctctcggatcactatgacgtacagagtgctgacaccatagagggaaagtgcaacgttcacagcttccgtagctacacaaagcttgattctgtcaatgctgaggacttcttctgtcgctttgagtacaaatcagccacaggaagcttcgtgcccgaccgcattgctgtgtaagaatttaatgcaacctccgctatgtgatagccctgaaaagaacttgtttcgtatttgcagttaattccgttgacatctgcacaatattgatctgttatgtcgatgacattttccatatttaaatatcatgttatctgttgattatgttttccagtcttctttagggatttcacacatgccttttatatttgatgtgaaatcccaaggtcaacaagttcgtaattctgatgagttgatatgtgatatatgtatccttatgacctgtctagattctataggcttcagtgcatcaccagttttatctttccaaagagtcacaataactatttccctgtgttgaagtggaatatgaagggatgcataaggttttgtgcctattttcagcttgccacatttgctgttattacttgcttttggagaaaatagaggcacagtaaaatgctcttacaaacttgagatgttcttttaccgaagagccactgcatgccatgatatattatgtggtatgtctatggtaggctcgtgtagtggtgtagcccatattgcacataagtaccaagacagctagaacccattgcttactacaccgccccaatttagtgcattctgcaccttgccccatttaaaactattcttttcgagtcacatgcatgatgcatcacggctggtagaaggcttatgaggggtcagcgtgccaggctcatggaagcagctcatgccgtaccttccatctagctgttggtgtttgagatgaggctataggttgtgctggccatagtactagattagtccggatcatgtagtgttagcgaggttagagataagattggttatgatttattacttctgcctgttagggctgtctccaatcgtatttgttagagacacgatctggacaacctggtgctctcatgtggtagggtgccagtgctgcagcctttttgtccatgaggggccctccttggactgcagccatagccgccacctagaagcttgaggatgagctgctcgaaaggaggggtgcaatgtcataatgtgagaggttatagaatgttctgaaggcagcagcagtagtgaatgtgcatggttctgtcggaagccgctgactggctaacgcatcaagagattaggagctggtgtgcacagtgcacgtgaatgtccaatgacatgttcaactcagataggtatcgaccaagtattggtcgattatacataaaaaaataattagttttcttctcaaatatgtggtcaacttttctctgactcgtatgcgacacggcccagcccacatagccaggatactcaaccctaatcccatccctgtgtgccctcaccaggctaatggaattttggaacatatgggcatgcattgagtattgactgaattctaggagctatggactgtctttgagataagttttccttttttacagcttgccatacattatttcagtgtcaaacaattgaaaataatgtatacataatatttttatttaaatatgtagtgtgtcaccatattgtcgtttccttttggtgggtgggtgggcgttttgtgttgtctgtgggtgttggggggggggggatggcgaattccctgtatcagtaccatgccatgtttacggtctgtatccatgcatcataggctgaagcaacagattgctgtcgtactgtcattaagattgttagctaacttttggataggcatatctcttatccttcctataagtttgacaaggatgtttggcgcatagctagcttatataaggacacgtgactgtgtcattagtattaagcaagaaataacaaaatggttccttaccttcgttcttcttatctccctgcccttgcgatgctgctgccaaccatcagcatggtcgtacctgttcggtagagcctgtggtgttgccaaatcctaagcatatatgacactttgtaatgctgtatgccactctgggtgtttccttatcatgttagttggtttcaaatatttctttatttgaccatgaatcctcattttacaaaatggatgtcttgtttattatggtagttctatccgaataacatgaataaagatttttgcctgtagtggatgaactgcgaccatttttatttactgttgctacattctcaaccaaatatcacttatattgctatgctttgctggcctatgctatctattaaattgatttatgtattgcattaatatcatcattttatttgattttctcatccctttactaacaatatgacaggttctgcaagtgtgagatgccatacaatcctgatgaccttatgatccaatgtgaggaatgctctgattggtgagtaatgaaataattcatttaaattcatctttttcctgaactgcgctggtgtacattttatggttttatccctcttgccactgggtgaataggacaaccaattttttttacctattaatggatttgggtgtcttgcccttatcttattcttgcctattgggatgggcggcaactagttagccgtcagagaaataaatgcttttccattttttttacaccagaacaaatcactcattggctctatttattcacaatccccaaagagatttgtgcagatataaaggcataaccattgcataatgtctatactctaaattcctgagagcaaggctacaaagtgggcctctcaatatgcatggcatgtctttgttgttacatcgccatattaatttgttgaaacatgtgttttgggctgatgttttggccaataatgtaggtcgtgcttatatattgttaatgggaataagcactattacaattgccacactagactctcttaactctttccttgctgtggcaatgcagagacgaaggaaaaaatttccttgttcgcttgtcctaattctaatttaaaataaggaaacaattaatgcgctggtaaaaactatagagagatatatatcctagcaaacataaggaaacaagctaaaccccatatggcctactgagttattgttttttgctagctgtagaaccttggcggttatagtactctacacaccccaacccccacacgctctgaaagaaattcatgacctcaagctacatgtccatggaatccaccatcaaaagttaatagaattgcttttgagtaggcttcacatttcatatacacttttcagtacaatatatatatgaacaccaaaagatgaggaagggtttagcaagtgaagaaagaaatccactctactctaaactatttctctggagctcttaaccccctaatatatatatccagctccacctttcctagacctggagcccaacgaaacagtttcagctccacctaaaaggggagtggaatgggctggattgattccaaaaaatgaactagatgggtgaagcggggcttgggccgctccaccgctccactccagattccactaggagttggagccttgtcaaacaggcccatattcttttgttcattgcacatggcaaactattaaaactaggccacactactactcaacatcatttgtctattttgtttttcttgtacaagtagtaactttgaggtatgacagattacttcgtactattgtgttctataatattttaagatttttcctgactatttcacttggttggaaacacctaataccggtttaaggactgagatatgaacttctatgcaaatgattattacaactttgaaaatatttcttagcatagaatatgatagtatcaaccatcgtggtttgaacttaaaagtactagcaaaaagaagttgggaagaggatggttcactggagtaaaatggaccttttcctgagataataaaacatttaatttgttttgtcttctgcttttacttttgcatgaactttcttatcatttttttgtcacaacaaatatctgctgcttttgctttccaggtttcacccttcttgcattggaatgactattaaagatgcaaaaaaactagagcattttttctgccagagctgtactgcggaaaatggaaagatggctgagaattctcatgaagctacagcgcaatccgaagaaaaggtaaaatatgatatgttgggattactgaattatcattaatgatttgtttagctatcagtagtgcgatggtaatacatcaaggccagggtctcccgggttcaccatgtcgtcttaataacataggctacacataattttcaatgatattgaggcatgctgcttaataatattattataatatatgagatgtctgtcctgttgtatcgctactgtagttgaacaaatttccaatacttaatgacacaaagcaccagttgggaaacagtaccaatttattcatatggcagtaaaaagtctggtgtgattttacaactataaaggattggggaacttttgcatgttgattactgtggcaattgctgtaaccttttttttggatactgcacaatttgccctactttagcttgtacagtttcactcttatattatgcataatctaatcatacagtaaataaaacccatccaaggtacatgcactatttagttcttttttaatttggtaatcaccattctgcgattctgaaagacaaacatttcatttggactaatctcttcagcaggtggagtcaaaaagacggagaaggtgactgccccccagattcattgacgagatacacctggatgtacaaagccttctcaagttggtgtaatgctatttatttgtcatggcaagtgtgtgtgacccacgaccacgagagtcccttcctgtaatgtcagtcgcatggtgtacataaacttttcaacctgagactgttgtattaggagacgacacgacctgttgttgttgcatgatgtttttagcagcgtcagaattagcatggtagagtcgggtgatgaagcccctcgcgggcattaggactcccgtatggatgttatcactgatcatacattgatactacattggatgcagttgagtctgtcatctgcgtttgtctttggagaattcttgtaccatcaatccatcatgtgaactttgattcttttcgagacgcttcgtaattaatgcaggcatttctgtgtgggtagtcagctaacgggggcgagaaatggcttaagaagtatggttgaaattggaacgatgtgacggaaaagttaaaagtttgtgtgtgtaggtaagttttgatgtgatggaaaagttgaaagtttaaagaaaaagtttggaaataaactcagcccaaatgaaaatttgacatcaccagccaaattttgggtaaggtagtactaatgtacaatcctactaaattttgttagttttgaaattttccactcacaaaagtctactaaaatttgtgaggtattaaaccaaacatcacctaaccttacttttatcttattaaggggctatttacttcatttctgaccttatcagttttgtgttaccaaattttattaaggtaacaaaataaacatgttctcatctctaccttactaaaatttactgtaagttttcgaagtttcctctcacaaaaacactaccaaactttaaaaagattacaaattaaacatatccaatgctatcaaaatttggtagcatcaaaatataccaaatttttatagtgctaaataggggtggaaacgagccaagccgagccaagccgtgaaagcttggtcaagaacaggcttggcttggctcggcttgataaatgaaacgagcaaaaagtgcagctcggcttggctcatttaaaagctcgagccggctcgagccagcttgtgagggaggctgagcggcactgaggagggaggccggaggcagcgcaggggagggaggcagcgccgcggtggcacggggagcgtcgagccatcgaccatcgaccatcgagcgccgctggggagggaggctagagccagcgcagctgcacaggggagggagggatgcagcgggccggtggcgtaggggagggaggcggcgagccggtggcacagaggggcgactggggacgggggagggaggcggcgccacggcggcacggggagcgtcgagccgtcgaccgtcgagcgccgctggggaggaaggccgaagctgtgcagccacacaggggagggaggcggcgagccggtggcacagaggggcgactggggacgggggagggaggcggcgccacggcggcacggggagcgtcgagccgtcgaccgtcgagcgccgctggggaggaaggccgaagctgtgcagccacacaggggagggaggcggcgcaggggagggaggcggcgagccggcggcacagacgggcgactggggataaaggagagaggcggcgggccggcgggcggcggcgcaggggatggagccggagacggcggccggcaactcctctcgctagtcgccgccagacgccaatcgtgcgcgcgtgcggcggcgtgcctgcgcctgcgtgggatgggaaatggggagggtcggacggagcagttaaggtagggttctctgttttttatgggccagacggagacaatttgttaatgggccaggtcaggtcatgtttttcataggctcgacgagcctaccgagcggcttgcgagctagctcgggctcggctcgatttgcaaacgagctgtggagggaggtcgggctcggctcgtttagtcctcgagccgagccgagcttcacgagctcgagccaaagcccgagccgagctcacgagtccaagctttttgtccacccctagtgctaaatgttgataaggttgattttggtaataaatttgatatgttttttttccccaagaaggggaacacaccataagaacaagttcctgatgagcaacggctttcttacctgaaagttgagtgggctgattttacctcctaatgggcctaaagtgcagcggtcagcccggtccttaatcgggccgagagcaccatggccgcaataattccatgctggatctgtgttgaatttttttagtttttagattttttttaatatttacagaaataatctatcggccaaaaaaattacaaaaatagaccctgctgcccacctctagggcggcaagctgacgtgacaaacgggggaggaacgggcggtgacggagggagggttttttgcaggaaaacccttgccgccctgggcccgaatgcaaaaaagccagtcggggccgggcattttgcaggcggccccttgccgccctctggccgggcgggaagtttttttttctataaaaggcctgccgcccagcccccagccctcattcctcccccctcaaatccagtgaaaataaaagaagagaggggaggagaagagaagaaggggcgaagccctgccggattcagacgccaatttcaggtaatattcatagatcctatatgtgactattgagttaaatagtgtgtattttttaaaaatttgtttgaataaatgcattatatttttagggttttagttgtactaatctagaagtgcgtattgtagatatcggtaactacgtacatctgctagtttggaatcaatacattaccgttgcattggcttacacaagaagatattacgttgtagatgtttattgcatgaaagagtaatatgatctagttaattcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtctacggcttgcgcatacatcgagtgggtcgatacagaaaatcccgttctcgacctaaccacttgtttacaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtagtgatcgttgtcaggttcttcgttccataaatcctacaacattggatcgaaggttctttgtttgtccaaatattcttgacgacgatttcatggtaagaatattttgattacatgaatccttattttctcacaacatttactaactttactcgctttacatctattctttcctcccaggaaccaccaaggagatgtcaatacagagaatggatagacaccagaagggttctaactccacctagccgtgttgtgcagtttgaactaccagaacaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcaaatctaatatcatctatgtaaccgtaatgaaaatagttgtatcatgttcaaattgtactactatttcttcatgttacataattctccttgtttaagtccatataatgtttctacgaccgagattgcgataggcctatattaattatccgagtactaatacgtcgaatgaggtacaaaataatacctcacttaacatatgaaattgcgcaacaaccaacttcaatacatttttataacaatattaacaagttttaccaataaatacttctttatttattattaacataacatagaaaaatcttttggccgtactttttactggggcggcaagggacccagatgcaaaaagtacggccgcaagctctttatgggcggccaaaattgtaattagccccttgccggcctctgtatgggcggcaagggcctaatcgcaattttggccgatggcggcagacggcgcggtcgacccaccgtctgccacgtcagcttgccgcccaccattggggcagcacggtctatttttgcgattttttttggccgatagattatttatgtaaatattaaaaaaaaatctaaaaacgaaaaaaattcgatctgtgttaactgttaggttgacccaaattatgtccggaaattcaattaagccgacatttcgcgattacttttctgcaagtcagagatgacagctgcagtgcagccacactgctgtagtgtcgtctactcaatcccccgcccttcgcgtggatggctccggcgaggtccgccgtcgccgccgccgccgccggtagcacgtacaggcaacggaagctgcagcgtcaggtatagagattttgttggttggttccccacctctccttggttgcatctgttgaacggttgtcaaattttgtggccgtacttgtcctcgagatgatctcaagaaccagatcagatcttgcggattgcctgttattagtgggataattggtagtgagtggctggtagagaaaagattgtttgggttttaatttcttggcttccacttggtggatcctagtgagtgaagggtttgattcagggatctcactggagatcctcctgttgcagggagagttgtatcggcttggcgatgttgattcttgtttctatgcaatttatggcatgctggggcttaaagaatcacctgtagatgagtaatttttattcctgtggagttgttattgatgctgaaacacaaattggaagagtccttttttttttttagagaagagtattttttacccggcctctatatccaaccggatatatgcagccttttttctaataggaacttagcctatcgaacaaggaactagccctcaaataacccaatctgaaattcactcctatagagatttgaactcaggaccttgaggtgctattcaggtcactgcaaccactaggctacatgaagagtcctttgttggtgcttcacatgcatttcagtggagatcggagtattgcggtgatgatcagtgttgtggatgatacacctgctgagactatctcgttcggtgtcgatgtcagttgtgtttatgtgatgagttaatggcagtgtttcactatctaggttatgtcaatctaatattagtcttaagaaaaaaaagccaacctagtattagttgtgttttctcagggtccaatcttaggtaaggaatacttgttcaagcaagcataagtccataagggtgctggcttttccataatccacaatgtccagctatggaatgcctcctattctcaacatttactcatgtaaattggttttctctggttgcaggattaaacccgcaaaaggatagccaaggttccagacttccagttataggtttaaagctaaaatttgaacatggtagaagctttggtcatagcagttgttcaaaagatttcatcggcacttgcagaagaaggatcgaagatacttgcttctaagttgaagaagcaagcacctgaccttcttgaagtaaccaataaaatgagactacttcaaagcgacttctcaatgttgcaagcattcatagctcaagtggctgtggacaggtccaatgatatggtacttgaggcctggatggaacaggtaaggctagcagcgcatgaagctgaggacattgtcgatgaatacacttatcttgttggccaaacggaagggactggcagtttcctaaagaaagcattcaaccaagcaatcgaagttaagaaatggcgcaagctttcagctcaggcaaaactagtagaggatcgtctacaaaagatttctgaagcgaaaaatagatttgatatctcatttgcaagcagtggaagagagaatacagcgagttatccaagtaggcaccatcatttatctgaatattcatacttgaatgatgatgatgatttagttggtaatgcagaagagatgaagcgattaatagaatggttatgtgatgcaaaaaaagatcgcagtgtaatctccatatgtggaatgggagggttgggcaagacaactcttgctagtagcatttacaagaaggaagaaattaaaagaacatttatttgccgtgcatggatcactgtctcacaaaatcacggtgttaaaaatctcctgaaaaagatcttagtccaactcatgagcaaaactgaaaatattatggatggggctgataccatggattgtgtgagtcttgtggaacaacttcaaagatatctaaaagggaggagatacttaattgttctggatgatgtatggagtagggaggcctggcctttactagataatgcatttgttaagaacaacaatggcagccgagtagttatcacaactcgaatcgaaacggtagcatctctagcagatgcaaactatgaactgaagcttacacttctaccaaagcaggaagcctggactcttttctgtcaaaaggctttctcaagattagatgacagaagttgcccccataatctgaagaccgtcgctgaaagaatcgtggagaaatgccaaggtttgccactggctcttgtagctatagggagccttttatcgtacaaagaaatggatgagcatgagtgggagttgttctataatcaacttaggtggcagctcagtaacaatccagagctgagctgggtcgctagtgttctgaatctcagttacaatgatctccctagttatctaaagaattgctttctttactgcggcctgttccctgaagattatcgaattgagagaaaacggttaatcagattgtggatagccgaaggatttgttcaggatagaggacctgagacaacattgacagatgtagctgcatgttacctgaaggaacttgctagtcgatcattgcttcaggttgtgaataggaatgaatatggaaggccaaagagattccagatgcatgatcttgttagggaaatatccctaaccatatctaagaaggaaaaatttgctactacatgggactgtcctaactcagatggagttaccgatggatcacggcgtgtttctttacaaaaggatggcaatttagtccaagcagcaaaatgttcatctcagcttcggtccatgctcatgtttacagaggaaatatcgttgtcttggttcacagattgctaccaaagctttagattgctaagggtcttgtgcctgagaaattgcaatgttcacaaggtaccagattctgtttctcagctgtttaacttgcactacctagacttgggatacacaaaactgaaagagataccgagttcgatagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21542 - DNA, 706 bp, Oryza sativa
ggatgtatgagcgtgccagttgatttgatcctgcaatcaacaagaaacaaagacaaagaaaccgggattatttctttttatgatagccgatcggctagatgccgatgacatatcatttatctttgagccgatgtcatatgtgaatcgatcggcaattgtaaggaaacaagtcagaactaaatctgctcgatcggctgtaaatatcaatgatgtataatccttatatcgacatatacttaaatcgagtgattgggatagatcggtcaccttgccgagacaatataaatcacttagattgaaatatatattaataatgagattatacatattcatagcatagccgatcaaatagatctagcatgtatcggctaatactccgatactactttatattaagatatttaaagcaaatagaatatactaaatagagatctaatatacttaaatgccacaagatcttaacatgaagggcatatctaacatattaattgagcatatagagcaagagcaattagatcagataagatcggctgaaactccgatactaccctaatcgcaaccagtaggcaggctagagaatgaaattctaaacacgacttaatagatcaaactcaactgatacagcattaagtatgaaaaaaaggacaatatctagacaatcaagccgctggatgtttcatagagtggtggatatctcatataatct

SEQ ID NO: 21543 - DNA, 472 bp, Oryza sativa
ctcgcgtgctcgccggcgaacgacggcacggcggcgcaaacggaggacaccaacgcgtagcggacggcacggcgaacccaccggtgaccaaaacgacggcggaagatcaacggacgacgatgacgacgaggaagagcggcggcgacgatcgggtcaacggcggcgacgatgctccggcggctgacagcgatggcgaaagggcggacgaggacggcgacgcgacgacgaccacggcggtgacctccccgagcgacgacgacgactggagcgacggtggcgcacggctggagcggcggcggcgatggcggcgcgaggcggcacggcgctagagctctaccggctacgagagactaaggcgagggtggcggcgggtagaggggagctcgggggtcaatttatataaacaagaaagcggcggcgaaggcccacggcgaccggcgacgggaaggaaagtttagggttcgggggatcc

SEQ ID NO: 21544 - DNA, 1955 bp, Oryza sativa
tacttttatcagagagtttttcaccgttgctggtgggatgaggcactggagtacaatctccttctccagaatcctccctttcagttgcaggagcaaatggctgaggaacagtgtggtttgactcttgctgttcagctataccatggtttattggtgaactgggaagagaagacttctgctgatcaaccagcttcagcacatcttgatctgcaggcactccatcctggacattcccattcatatgtgagtctatagtagaaggggtttcttgccctcttgaagaatcttcatcatgcctgccactcataacttctgtatgaccagctttcccatttgggggacatataaccacacaatctgattcatcatccgtggacatttctacaacccctttgccgcttggactgcaaaaataaataaaaggtataaatacatgcatgactgcatagctggagccttgaagcccctcacaatagatcagcaaaaacaacagagttattacttattaaagagacaaacagtgagctaatgtagtattttatattgcactatcttaaaataaaaaaaggataactacccaatcatatgaattatcaatgacatgcaagcaactatgactaaagacaagcagaagaattccacatatgctaaaatgttaacgaaacaggtgtgtgcatgtagagccatcacaaaaaaaaaggagggggggctgtcgaagctttctaaaacaacaaatatcgcaatgatatgcatttatttgtaagttttaaccaagagctgtagtgtcaacttgaaggtattatcagtacatttggtgatgtctcttaatcatttcaaactccaattgtactacattgttctagaataatcagtgcaccatacttattttttgttcacgttatatcaacaagtaaatacttgtagtaatttaagcaagtgccatcatagccagaactccaaattactcacataaattctacttaaattcatgtaaaaatttgcaaaactatattttgaagaatcaaaatcgattccacaatcctgagaaatagtttctgattataaataccactagccaaaagaattagttaagtttgaatcattaagcccacaacatcccttgcaatataaaattgaagtggcgcagtcctaacaccttggccactaagacaaaatcacaaatttatccaaacaaatagcttagaaatggcaacacttttaaaaatgctttgcaacacgtcacgcgagaatataattccccctcgacaagttcaacgccacgtccagcagaagcattcaaagaaaaaaaaatccagcgcgactacagcatatgccaatttgatatcctttcgcaaaaaccaactgatgaaatggcaagccagagcccaattcgctcgaattatttaaagatccgcacgaacgcgccctcaactccttgcagcagcggaactatcaacccgccctcaatgccattgacgcaaccgggaatgcgattagaacagtgaccattttgcggcaataacaatggaacacagacattgagctaagcaaaccattccgaaccattcaaaagccaacgcctccactccccgcatgcgaaaccctagtcacccccccccccccccccaccaatccaaaaaaaaaaatcccaccaaaaactcgagaaaatttcccctagaactccaccggaatcgaccacggagccactcagatccaccgacaaccccaggaaaccacacaccaacacaccattagccccccgaaaacctcgccccccaaaaaaataaaaaatcaaaggccaaaactagatcaaagccatcgtcattacgtgctgtcggccgccttctcgggcagatcccaccggcgcctcgccgccgccccggcgtcccctcccccttcccctccgttatcctccgccgtcgccgccgtcgtgcctagcctctgcaacccccccc

SEQ ID NO: 21545 - DNA, 28194 bp, Oryza sativa
  unsure (1)..(28194): unsure at all n locations
tgcgcgtgcgtgcgtgtgtgcgcgtaagattttgggcgagggtcgcgcccagagtagacgcgcggtttgtttgtggggccgaagggggtaggtggggcccaccggtgcccggctgaggttaccccggggaggagggggaatttggttttgaccagccacgtggaaactcgggttagttagcatttcgttggctattctgattctgggaatcgttaaataagtagtaatgataattttattttaattagattaaatgggttttggagcagtgttttgtcgttgcgaagagcggtgacctctcacctgtgtgatcacgttagtttgctttcatgtttggtgtgagaaaataaaccagtgcatggtagtctcgtattatataatcttcattcttcgatcaattattatagttgtgatgtttgatgaaatcgacagtgttcaaatgggtgtagaagatacatgcgcgtgtgtattatagtattagggctcatttgaatcgtagaaatgaaaaaaattgagaaataggaaaaacatggattctaacatgaatgtaagtgtaaaatagaggattgtaaaatacgggaaaaatatagaaataatcgtttgattgaaccgtaagaaaaatattggatgagagggatagactcagaaatttttccaaatggttggacctcttgctaagtttcctctaaaacctacgtacataagtcattccatacaaaaattttaggatttggaaaattccaatcctttgagtcaaagggctacgtaggaaaatatgttcgcttcactatttttgtttatttaatatttatatcttgtatgacatgtactttgaaaaacaatgacgtattgtttcgataacctttgaaaagggttgggagtacatgcaaacaatgatggagcacaaaaaaacaaatatatgtaggccaaataagacgggtaatggccatttaggtgacgggtggataaaacgagcgagtggcgacaatggacaatgaataggataggtggtggcgtaaagcacggcggtgctacagttgaggcgttgagcggttgggggcaagagcgggaggtgtccacacgtcggttttgtccactggtgcacttgtcggcccactaaagcaccaatcatagtaagtaacgacccaccaatatagttacagactcaaaaacaatcaacactttttaatttgtctttctctcgacagcaaatagatgacatatgtagtatacctagtagagatggccttgtggcgcatagggtaaggttctcttcggtggctagctcgatcacttgctatatgggacgctccgtcactacatgcaaactctagatgctatatgttatgtgtttgaatatctagatttggatcgctataaagaatacttgatttgaaaacacgagatttaaaacatatacaaaactctaggcattactaggctaggtaaatctcccaaatgataggctgtgttaatgaaggttcacaaacaatgagtaaaccgaataataatcatcatcattttaagcattcaacatggtctactatcttatttacctgggtttctttttatttgcgtatccttgaattatgataaaatagccaacgattgaggtttcaacctaaccacccacattttaaacatcatcttcacaccacttgccagatgtgagataacgaaaacggcatgattaaggttgtaatctcccaagctaagcactctctaactaccacacacacacccaaaacggacgagacgccgccgatccgttccgttccgttccgcggtgacgcgacccgcagcgaaacacaccgcacgagcccccaccttaaccaccgcaatccacacacccacacccacctgggtgggccccaccgctcccggggccccacacgtcatcgaccttagctaggccccgctcgtccgcggtgtttttaatccgtgccacctcagcgcgctaatcgcgacggggggactcgtgttaattaaagggtggcaacaattacgtcactggccccccgcgctttcgaaagatctggggcgttggtgtggaaacggacggctgggattcggtgggggaccggacacgtcggtggtgggttccggcgcttttgaaaggccgccggttttggcgcggcgcggtgggccgggatcttctgtggctggttgggccggctgggttagttttcccccgcgtgtccttgtccagggcgttgaaaagtcaaaggacaggtgggccccactcctgcctccggtgtcagcggcaacgagcccaaccaacaatatccacaggctcacttcaaagcaaactttcatttgcgctctctaactctctttattgtgtacaggagagctgatcactagtacgctctcgagagttatctaaatagttataattagttttagagaaattcgacctgatagtttaatactccctccatttttttaatagatgacgctgttgactttttctcacatgtttgaccattcgtcttatttaaaaaatttatgcaaatgtataagatataaatcacacttaaaatactatgagtgataaaacaactcataacaaaataaattattattacgtaaatattttgaataagacgaatagtcaaacatgtgagaaaaagtcaacgacgtcatctattaaaaaacggagagagtacaagtttaaaaataaattaaattatgggcctattcactttgatgtcattttcaaccataccattttttaataaagttgccaaaattttgactaccaccgtgtttagttccaaactttttttcaaacttctaacttttccatcacatcaaaaacttttctacacacataaactttcaacttttccgtcacatcgttccaatttcaaccaaatttccaattttagcgtgaactaaacacatcctatgtttagtttgttgccaaattttagtaagtacatatgaaatcttgccaaaatttggcaatcttgccaaaattttggtaaccttataaaaatttggtaatgccaaaacttggtaaggttgaaaatggtagcacagtgaacaagccctataaccaattaatgtatatgtacaattaaattatttttttattacaactcgtagaaggttaatttgatcaatcatagttgtatagtgatttgtcatatattaatatatcttgttaattttttttaattaattatttgaatgatatataaataataaggggatgttccctcgagagtttagaattgactcccttaggctagggattttcacatcagcaatggttgttgatgagttagaaattatgattgtttgttggctacgtgcaaaatttagcattgcatggtaaaaaggaatgcatgatgaggaatgcagttgatggaaattcggtggagttatcatatgatcttgtacatattgttgctttagaagattgtacttacgctgttacgcacggctatcttttcagaataaggcagtgaaatttgattgaaatctcttacaaagtaatttagggtcggtttgttttcctgtttagggctgggtggagttttcatatgatccgtatatattatttgtcttgcactcttcctattaactttctgaaaaggcaaggagaatcttcatgttgcttcaaagtaatggagagaaagacaacattctttatatctaagattgaatacttgatgccatttaatttgtgttatttttttccacaagaagtggttgtacacaactacatatggtcctgatatgtccttttctttaaagagatcactaccatccaaattatatatagtatggcccaaaacatttttctttattttgtagtggaaaaaattaacacctaaagaattattattttttgtctaaaatcatttctttccaaggagtatagtaggacatttcatgggaggctcactatcatagtctcacttaatcatgtagtggtccatgcttggttttctcaaccaacgcatatgaaaaccattcgagtttttcatataaagattttgtttgtcctgaaacatttctttcaaagagtataataggacatattgcatgggaagctcattatcatatatagccattgaatcttatagtggtaccatgcatgcctggttttctcaactaacatatgaaaacaatttgaaattgtcggtttctcagccttaactaagtatatggattcatacatacattatatactatccactgtttacacacaggtgcatgtttcactagaatttcttaaggtttcttggttataaaattttacatacattagtccaatgctcgtgcttggctatggatcaaataaaatatattataatattacctaaaataaattgaggtatagtatttgatacgaaatgtgttacccatcttttttcctatgtttaacatttacttttgtttgattgtttttatagtattaagaagttgaaagggtaatttacaatagaaataggtgggggtaaccgtggcggatgacatatttactcctatcatcatttttttaaaaaaataatatagatagcctttttttaagtcatccttattttttagcgtatcaaacttgtgtagtgtgtgcgcgcttatgcttggctactagaaaaatcatttattaccacgaaaaaaatcgtggcatcaacattaaaattgtggcaatagatacatgttgccacaattttaaaatcgttgctaaccgtggtaataaatagcgtggtaataggctattgcaacgatttttatttagtggtaataataaatttcgatgttgccacggaatggatgtggcaaaaaatcatattgcaacacttcatatgtggcattagttctattgccaactcacctacgcatcaattatgttagaaaatgcaaatcgttccatttgagcctagctaactgagatttgaatcatagatttgaatatctaaaatatttcaaatgaaaaagttatcacctataaaattgtagatctcatcgagagtataattttcatataaaatttgtctcaatccgtgtccatatgaataaattaagttaaattatgagataacaatttttttattgtaatgaacttgttgatcgtggcaacaaaaaatagtgaaaaataccatgtactatgtaaattaccacaaaaattaaaattgtggcgatagaacatgtttttgcaacaataagttttttttggcaatatcttattttctattgcaacaaaagtactaaataaaacaacgattgtagatcgttgcaataaaatataattatttgccatagaaaaattatcattgcaatagtacaatatattgctacgaattattttttattgtaataatttggtggcaatagctcaattgtcttgtagtgatacatagcattttcatataggatccttgtgaaaacctcacacgaatcaattcatggtccgtgaaaaatagaataattcatgagttttaaatggtgtcttatatatatcttgtaatccaaaagagagagtgagaaaaaaacttgagccactgtcggttttttaaaaatcatagtactgtaaaacaaagccaagtagccagtgagccacagagaatttttgggttgttgtggatatgtacatgctcccacatttcagaatcacctcgaaaacgaaaatacaaatgatttctttctccgagatgggaagcaaaagtcaggatgcttggaagttggaagtttgaactgtatttacaagtgacgtcagccaacgtataggcgagggcaccgaaagtggttgttcgtcaggccaggtggattcgctcgtcacccgtgtgcatcaagtactttttaaacgtattttgagatggttgttaatcaaatccaaagcagttttggagtcttcaatagttcaatcctttaggccggtgcagtgttcgtcgtggctacttgcacacgcattttcgcgtaagacgggcttatactgttatacattgatttcgtagaaactatattgaggaactcgcagcttatttcacttgtaaccgcccttagccattttcgtacaaaatgtattagattttaaataatctggcatcgagtacatatattataccacattcgagttctaaaatcatcggaaaactagttagaaatcacttaggcattatatatactccctccattctataatataaggcaaaaccacttttttttagatgtttcataatactccattaaattaagacatgcatacatgtaggcaattaactataactccttttctattaaattattacttttttaaatcattcaccctcatgttgtctaattctattggatgcatgcattgtatttattaggatgatccaaactacaagatgataataattatttcttggttttttgggcagaggtggttatgtcttatattttgaaacagagagagtaacgtattattatatattaattttatccagttggtttcgtttacaacacaattgatagaaacgacgtgccccatctctataaatttcggatccgttcatattatagccaaaataattcttgtaaattgtcaatattgccaagttttgataagatttattatgtatttaaaagagtttggtaaaaacacttaacagatacatatatctaataggaaaaagtacgaattatcccccgaacaatcgccgtcgtccgaattacccccctgaaccacaaaaccggacattcttcaccctgaactttcaataccggacaaaatacccccctcgacccaatccacggtggttttgatctatgtggcgtacgcgtggcagctgagtcagcattctatttattaaaaaaatatgggacctacatgtcatactcttcctctctctctctcacgggcgcgaggccgggcacacagagctgcggcggcggcggcggccggcggtgggggatgagggtgatgcggaggcggcggcggtagcgcggactcgccggagtcggacgtcgctgcggcggaagcggagaggtcacgcaatgtagaggcgaggcgggttgcgtcacggcggtggagcgcggcgtgggcctcggcgaggagctgcttgagtgacggccggggcagcggagggggaccgaggacggcgacggccggggacggaccagttggggtcgacggtgccgcgcgcgcacggggaggcacacggcggcgtcgctttcttcccgcgctccaggcctagcggcgccgcgctcgcacgaaggggcaccggcggcggcgacagcgcacgagggagaaggctgggccagcgagcttgttcgccgggaccggcggcgaacgggggcggaggacgcgcggatctggaaggacgatgcgggaccccgacggcccccgcgagccgccgtcctccgctcgcccccaagcgccgccgttgtccgcggcgccgggccgccgagctcacttgtgccgcccatactggcgggggtccgccgtccgccccccgcacaccggctttcaccacgcgccgccgtagtccgcagctccgcgccaccgtgcgcacttgcgacgcccctactggccgccgtccgccgcccgcccccgcgcgccgccatccgccgcgcgcccccacgcgccgccgtcgtccgcagctccgcgccgcccccactcgccgtcgtccgccgctcgcccctgagcgccgccgtcgtccgcccgccgctccgcacttgcgcctgcgcgcacaagtgagacagaacggagagagaaattaggaagaggtagagtggaggcatgacaggtggaccccaccaatttttttttaaaaaaatgctgactggactgccacgcatacgccacgtaggataaaaccgctatgaattgggtcaaggggggtatttcatccggtattaaaagtttagggtgaagaatgtccggtttgtggttcagggggtaattcggacgaccacgatagtttgggggggtaattcgtactttttactatctaataactttaccaaaatttgataagatttattttggctagatatattatatataccacggacatcattttcaacactttttttttctctcgtgctacgtacatgagcgtaagatgggaggaggggacgaaaaagaaaactcattaacagatagcagcaattaacggtggcagtagcatgaattggaacggttactgtcccgtgaattcgtcagcactcagcagtaactggctactggctaactgccatccccagtcagacaatgggcaacgtactatcgcgatcgatcgatctgctgccgttcagcagtatcagatagagcagcaaaataaaagtcatcacaggggagaagtggccatcttcaatgacggatcgatcgatggatggatcgcctggatctaattagtccaagctcgattagcacaaagcaccaaacccttaatccaaaagcgacgctagcttagctcgataatgggggacactaattaataatgcatggcggacagcaacatcacctcacctcacctcacctcaccatgttaattatcttgccacagaatacacagaggctgtttgtgtgtgagtgtgaaatgaactttaattaattagcttccttaaggcaagcagggataatggtttgcttgattttatccggccagcattgtccactcatggtgtccaatccatctgatcttacctacatgttgcaaagctcacctcagcatgcagtgtgaaattttaagatggggatgctgcaccttgcaaattcagacaccttttgcattttaagaaaggaacactgatcttgacattttgtccattgggggatgttatttgtttttctccccctaaaacagatagggtggttatcttaaagctcaaattagtgtgtgattaattatgtgatatgtgtggcaccttatcattcttgaacaatcctagaagtagcattactgattttaatataagttgttttagagttatgtataagaattaattgaaggccggttttgtttgttgctaaactaaacgtgtcaaattttgatgatgctaaatttaagtaaaggcaacaaaccaaacatgtattggccattactaccctatcaaatattagcgtgataataccttttagccactccagagagatgggtggcaaattgccactttgtgataaggacgagacggatatggtaaagagtgtcaaataattaaatccccaaattgtggcaacttcgaaagcttgcactccaaaaatgctgcacccaattttggtaaggttctaaaccaaatattacatcaacatctttatataaccaaaatttggcattagggttaattttagcgacaaaacaaacaggaactaagaaatgaaatattgggaaaaaatgagtcatatttatttatttaggaggcgcagacgtggaggaaaaggattaaaatgtatagtagatgtttcaaaatgacttgcactaaagaaacaagtctaaaccgtcttatatttagaatgagagatggtagttcagagtccatctagcgtaatggaaaaaataatctttctcacaaactaaagtgtcaagtcataaaataaacatgtactgtctgattttctctccgagtggtatgagccgttagatcattatttgattggcgaaatttctcctcgatccttcgtgaaatttcaaatttctactttttttcctttagtatatgaaccatcaatataaccctgtagagatcttgaagatgattgcacagaccaaaaaaagtgataccttccactccatttgctgagtactactgtcctagctagagccataattcttgtcgagatcccataatcactcactggtacatcaactgacagcctaccacactattaaagaggagtagaaagctacacatttaagcaaagcgatgtggttaatggatcgatccagtacatatattttttgctgaattgtttgcctacactgcacttagttcaataactacatctttgggagtgtacatgtagaatttgcacacattttgaagcaacaaaattgtcattcttcttttttttttctttttcagttttgacaatacgtagtacaagctagtctagtcggcagtcaccatctcgatcctatttcgaagctttgctgtttggtgaagaaattagaaaaaaaggtagtagtagtagtagaagtaatatcatgtgattgtttgatttgtacagaacgtacaacgtctgcatcctgctcatctcgatcatggcaatgtagcttggatgtaccaatcttgaggctgcagcatgtcggcaaaatttgcgtgagagatgactaacaataaccattggatggatagaatgcatcattgcatcagagtcacttgcaataaaatgaagcagtacaaattcttcagaaattagctaggaaaaaaaaacaaattcccaaaatatttgttgttaaaggaaaagagcaaagcatgtgatttttcattgtaactatatctgaaaatgtatcagcattctgatcatttcacatctgccaaggttcattcagcaagttgggaaagaggctcagaactgaagattcatacgagaagtcgtttcatctgtaccctgatgtctgaactattgtcgaaaatgatgcaatacccatctacaacaatatgtttttttaatacgcaaaaaaagaataaaactcttaataaaagataacattttggaacgacctagcgacctaatgcactataaaatatagcgacctagtaatacagtagtacaaaagctctgaatttatttgcatcggtcatgctctccatgattctccacgagctagcaatggcccatgggccatcggtgtgtgaggcccagtagattgggcttgggctagtctaaaaacaaagagttgggccgtgaggatatgccctagactttgtcatcggccgccgccgcctcgcgggcgacgagctcgtccgccgccggcgccgatcgtctacgcgcgcggcatgccatcgccgacgaggtctcgtaatggcgagcagcagcaagcgcccggctgccttgatcccgtgcggaggcagcagcaggagcacgcgccggcggctgacggccggtcggccgcctccgccgtcgccgccactcgggatgattcgtcgtgggcatctctcccggaggatctggtgagccaccacctgcccgcgcggccgtgtcgtcgccgtgcaagctgcgcggggttcgtcagcttcttcaacctctccaccggcggcgccatcgcccgcgtccgtctctctcatcttccgcgaccactgcgcgacctctgactctgataccatattaagtaagcatgttgcactttataggaaaagacaggcaattcactttatacactccaacaaccgccatcatccgcctcctccacccccttcaccggcggcatcgctgagttcccgccgctggacacctagctgccatacgtgagccatgtgaggtaagtggttttgtctcagagacgtcgaggcgcgcgccgctgtcagagtggccgccggtggagtcgtctcgctcacgatgtggctatttggaacggtgtatgtgtccgtcgccatctccggcgataagcaatggatgaatggaggatttcaacaaacaggagaatgaagaatttcttctccccattgtcattccaaggcaagctatatgtgttactctctctgtcccatttcaagtgcaattgtgagtttccgtattcaatgtttgactgtctatcttatttaatttttttatgattaatacttttattgttattagatgataaattataaataatattttatgtgtgactttattttttaattttttttataaaattttaaataagatggatggtcaaatattggacaccaaaacttacaaccacacttaaaatgaaacggagctgagggagtatatgatcatgccaatttacgatgaaccagagattgcagatcgattcaccgacggacacctcgccgccgccgccaagattgattgccaaatgtccagcaagaacacccgaagcacatttatcctacaatttggtggaatgcggcttggagattcagatctggtgaccacctcaaatcttagtagtgttcatcggcatttttcagtttacaggctacccgaccttatgctgggaatggttgtcctggtgagcaccatcggttgcaattccctcttccttggtaagaggaatctatgtgtcaactccagtgcgtttcttaccattgttagcgacaccattgtcttttaccatcacatggaattttgtcttgcacaatacaacctcggaatcggccctgttctttctctaataagatttggatgaagattaagattttcgtgccacacttttcaaactgctaaacggtgcgtttcgtgtgaaaactttctatatgaaagttgttctaaaatataagattaatccattttcaagtttataataattaaaactcaattaatcacacgctattaccacctcgttttacgtgaaacacttaatattcatctctatctttatcttcaggagattcaaaccccgtcattgtcgccagcatcataaagacgacttacggcggattttataccaagtcctaccagcatcattcatcatatctacacatgttgctttaatagacaatggttggtgaccaatttttttttaactccattgttctctttagtagtaaccattcctttgattggagcattttgtggtgctagaggtaattaatcaagctcattgtttcccttatctgcctgaaggaacaagggacagataagctttcagagagaaagcaaggggtagagagtgaaaagaaagtggagaaagggggtaagtgaagccttgcttccaggggaatgattctattgggcttctccaacattcactgattattgcacttgcacccagggcttactagttattaggtgttttcctaatatcaatttaattattaggtgttttcctagtattaaagttatactattaacagtcccagatcagctgtgcggctgtagctttgcattttaattggatataatgtattgcaattagatgtacacacatttctcgattgggtttacaaaccgttacaagtgtctgtattcattaccagcactgattgcttattttcttgacaaacattttgtgtgtgttagttacaactattgttataagatgttcttggttcagctttgcatttgtgcttaaccggccgcacaaatgaactattagttgcaccaatatgtgccagggttcacaattccaatggaaaccggtcgaattccgcgaaattccgaggtttcaacgaggctcgaaagtagaaaccgtctgatatttcgatgagtttcattcaaattcaaatttgaattgataaaaaagggaaaaaatcaaataaaatcttataaataatatgatattaatagaacctattgggatataaattttcgaaaaaaatgatgtattccatgtatttactgaaatttacagtagaaaagaaaagaataacgaattaaaaaaaggaaatcaattttagtttacctctttttctagctaccgattgaaatttcgatgatttcacccggaatttcgccaaagccgaccggttttcatgagcttatcggtaaactaagggaatttgtatttaaattttggtttatgaaatttgttcggaatctaccggctttccaccggattagtataagatatgtgcatacaaggttggcaattattagtctcacagctgcttgtctggagctgctaaagggcttagaagaagtactggcttcttaggttttgcaacaaaaaattgcaatcaataagtagtgaccttgaggacaaagtacaacacaatttgatcagtcatgaacctggagagtgtatatgttccaagctctcttagataactccctaagcacagcagccgcaatcaacacaactgaaatttggttatcgttgtcatttatgattgcaacgttgtctctattaaaatcataccatgacttgttaccatgcaagacttttttgcctgttagcgctgaacttaattagcagagagaaagcaggtgtatttttccgacgatatgcatatgtatttgcaagttattgaattgttagttgaagtgttgaacacgcattgctcttatatgttggttttctagaagcttaatatgttcactgttcagtagctatagatgttactttgtcttttgcatatttaggatcgcatagattctctatatcaatgtttcattatgcatgatttttctaatgttttatttgacttgattggttcagttaatatatataatgactgacttggcacatgtttttctaggcgtaaagccgtaaacagctcccattctatgttggtggtgcctgcctgcctggttttcctttagggatcaacattctgttgatttttccacagggaaagtagttccctgtgttgtggaagatttgctttggcatcctccatcatgctattatttctaggacagatgcttttctgcaccgtggaatcctataatgtagttattaggatttttctaagctgtggttattgaagcactaatttaagtaattgccctggtattattaatggagctgtaatttgtactattaaatgtcttaatgacaagtaaggggtatgagtatgacactgcatattcatggttggcagctttggaactaaacactagtatattactgtgcccgagtattcataactatttcagcattagtgttatctatcagtgacatgacatctacaactctgcaaaattacctaatgtcggagatgctctaatgtccaatatatttatctttttgcacctgtttgtgatgtgtttatcaagttgtatatcttgtcttggtcccatgaagatcatgttgtgttgcctcaagtagaaattgaaagataagaagatggttagctgacaatgcagctgatggttaaaagaaagaaaaaaaatgtagccgacgaggtctgcagttgatatctttaatataccaaaggtatttgtgcttccgcccagtgatttggcttgttgttggattcgcttgtaccctcgagttagtacttgctgttaaaggaaaatggcaaacatgtgatttgttactgttattatatctgaaaatatataagtacatgctgccaacaatcattcatcatttcatccttagatttcaacgatcgagttcgtttatctatattcagaagtcagaagtttgaactatagtattgccaaaagatatttctcaggaggaaaataatacattagtcatttcagtttattgcaacagttcataaaaagaaaaaaaatcgattccaaatacaaaactcagaattattttcatgcaagggaatgctgctataatctcaatagtccacaggccaacccacagggtatcaatggcccatcacccatgggtgggcagggcctgggagttggacacttgggcttcatctcgaatatatgtgatggaattttgattcttcgccctacaaaatagttaatactctgatgctttaacagtgtgaaaaaaatactacctccatattttaatatatgacgccgttgactttttatctaacgtttcactatttgtattattcaaaaaaattatataattatcatttattttattgtaacttgattcatcatcaaatgttctttaagcatgacataaatattttcatatttgcacaaaagatttgaataaaaggaatgatcaaactttgattaaaaagtcaacggtgtcatacattaaagcgtaatttggaaccatgccattataattttacaaagtttgagatatgccatcggtatcttaatgacatgtagtacccacatgagtcaatgacatgtgggtcagaatgacatatctcaaattttacaaaattataatggcatggttccaattttccctacattaaaatacggagggagtagtatattttgttgccactatcaattatatttgacatggctacatgagtttaattataacttttgacatgactgtcatgataattcatacaatcacaaccaaaaataatcatgacatattaaactattaacacaacttatctattatcatctggttatgtctaaaattcatatataactagttatctggatttctactttctaataggagttttgctagaaagaaatccaaaatctggccggccattaattcatcacaatggaattgtaaataaaaaagttatgaaattatagatgcagaattgccgaccacagacaagtttgtttttagaactaatatactccctccgtccctaaatagattttggttggatgtgatgcattctagtacaacgaatctagacatttgttgtactaatatgtgtcacattcaaccaaaatcattttttatttagggacggagggagtatataagccgtatataaacacctctccctcgtgttccgcgcacaccatttttaaataactaaatggtgcgtttttttaaaaaagtttctatatgaaagtttcttaaaaaatcaaattagttcatttttttttaaaatagctaatacttaattaatcacgcactaatataccgctccatttttcgtgcgaactgtttgtttccggttggaaactagagatgctgaacgcagcctaatccagtttgacatggatactatacaaaacacacacccacttacaagtggagcccacaaaaagtagcaaatccactgctgtacactgtactgcacctgcagtatgtgtcactggcatgtgggttccacctattccgggcccacatgtcagtggcacttactgcacatacattacaggagaggatcccaattggcacaccatatcctttcctcttcgcaagcctcccccaccttcatctcctcctccgcctcctcgcctccccaccccttctagaaccttccagaaccccagagaggcggcgagatgcacggcgtcctcacctccccgtgcctgcgcccccctcccctcctccgccgcgccttcccgagccccgccacccgcctcctcccgccccaaaccctagccctccgcccgctccccctcccccgcggcctccgctcgtcgccgccgccgccgcgcgccgcggcggaggcggcggcttcggcggtgggcgggctgctggccccgctctcgacgctggaggtcggcctgcggagcgtcaacctcgcgccgctgcgggcgccggtggccgcggcgatgtcggcggtggtgcggtggctgggggtgtacagggaggtgctgctcgtcggcgtgctcttctcgtggttccccaacatcccctgggaccgccagccattctccgcgctgcgcgacctctgcgaccccttcctcgcgctctgccgcgaggtcatgccccccgtgttcggccgcaagctcgacctcagcccgctcatcgcgttcatggccattgacatcatcatcatgatccttcgcccgcagccacgcatgtgattgctcccggtggttatggtatggcatcttttgcttggagataattatccgtccttgcaagtttatgattatgcagtagatgcataactagagtataaaaaaatcacgttagaagttttaaaagatgctctgggggctagatatttatgtattgcgcattggatatttatgtactgcgcattggaggatgagctacttggttatattgtgatgcctcttaatttgcaaatggagactaatgttatgtacttgcttgcaattgtatcgataatgcaaggctatggatggtcgaatctcgtagttacaaatgatttttgaaaacaatgtaaattgtcttgttgcctctgttgttgataagtggagtaaaccatatcaatataggtgtgtttcatgtgttaatcagtatttattttgtgcataaataatgagttccaatggcctttatgatacaaactttgctcatggaagtgatcaaacaaacttgcaacatgtcaatcacagctggtcttgcattatgtagtgttgagaaaattcccagattgaacctttaccagttaaccgacagggttgagcccaaagatgtccaacataggttatgggccttttttttcatttgatgtgaatattggattattatggtaacaaaatgtggaattatcgcatggtggtttaatagtgacagtttataacataggaaacctcataaaattgccagtctcaagtgtgtctattcaagcgtggcaggtctctattttagaatctacacctatatgacttgtgtgtggtgacccactttaaagtccagttgtccacacatagaatgcaattcctttccacctaattttccagtgtgattacttagggggtgttttgatacccctaactaaactttagtccctgtcacatcggatgtttggatactaattaggagtattaaacatagactaattacaaaactaattgcataaatgaaagctaattcgcgagacaagtttttaagcctaattaatccatatttagcacatgtttactgtagcaacacataggctactcatgaattaattaggctcaatagatttgtctcgcgaattagtccatggttatggaatgggttttgtcattagtctacgtttaatacttctaattagtgtcccaacctccgatgtgatagggactaaaattagtctccctgcatccaaacaccaccttagatttctgaaacagtattttataaattataagttaattagaagcgttctctggggttgaagtacgatccaaagtagaggcaatcatgtcataacttagacaggtaaatataaatttcagtacatatcagttatgatagttgaaagctcgaagctgaatgtgaacaaatagttctgatgcatatcctttttctggaccacattctggctattcccatcaaaagcgtgtagcttcattgcatcttagagtttgaactttgacaatctgaatgactacattttttttctttgtgggtgatttactgagttgcattgcatcatagatcattgaatacttgcaagctgatactttattttgaattggttgttgaccagtatgtaaatcttgatctcaatttcattctagtgtaagtggggccttgctgccttgggaaagcccaatttacagcgtggtagtccaagttgatatcacaaccagaatatttgctcccataacaagtactcaatataagaaaaactagattggtgctactccatagttaccactttagatgtatgccactgatcagttgaggcttagaaatatgtcattccaaactggcgttgcttccaagcatgccattgtataccctttgcccgattttttatcttctttagcaatgcatttttgactggatgttttttaccactggctattcctggccccacccaagacctgagctctgaattccctaactcattcccaacccgaccccaaaaccttgatcgaacggcaagccatggcagccacaaaagcgcgctgaaccggaatatgttcttctcctccggtcctgctgacttcactctggagaagattctgaggatggatctgtcgagttgcttctccacccagactagtcagggccatgcgaggtttttgtattgaaccgtgtcagattattaattagaacaataccatgaactatgtcagtttaacactatgaacaatgtcacatttaagtgaggcctggaacttgaaccatggattcatttcattttacacccccccccctaaactacgaaacaagacaaaatacacccctcatcaattcaatccggacaattaagcccccctcataccctgttttaggtggtttagagctgagttgtcttgataatccactgaatcttgcaaacttagcttgatgcaggcacttgttttttacctgtgccatttctcccagatggcacctcgtggtctttggaactcacaatttggtgcatttcagtgactgactcatacagcgaagaacatataccgttagtagatcaaaacatcaaaatgtagccatgcaatgtaacagcaaaaccccccaagttctggacaagaagaaatttatcgttgttttctgtcatataaatcagttgtttgcagaaacccccaaggtctttacagaaatataaatcagttgtttcctgtcatatatattgtttgtgcaatgaggtctgtgccaaaaaaaaaaaaaaagaaacagaagcaaggacaaggaacaagtaatataagtcttaatagcaccaggttgacattgtaatgacaaacagggatttgttctttatgagaacacaaaatgtgtcagaagcaaggtttgtatgagaacaagtaatgtcaagacaactcagccctaaaccacctaaaacagggtatgagggggttaagtgtctggattgaatagatgaggggtgtatcttgtggttttatagttgaagggggtaaattgtacttttgcaatagtgttgaggggggtaaatcggacttgacccttccaataaagacagtgaactgcttcatcagcttctagctgtgctcagtttttttatggacttgaacaagccaccctgaatgtgtcttcatcccacttgatgcagcgaaagcctgccctgtgcaaaggtgtgggcagtagagtcgctctcaattcctatggatgccaatgcattgtgaagaaaggaggcactgctggaggggctaggttagaggatgagatggggacaagatggtgtagtactaatgttggctggagcttggactagacaggggttactcttgtccatgcacacaaaaaaaaaaattcaacaatataatatgtaaatttgattaaaagtggccaagggtacatattttaccttgatgtttgtttgttgagcattcacatagattacttcagaaaagattgagagtactgaaaggcccccaaaattttatgagtagcaaagagatcatcagttgctaggagctcgattccaatgaagtgtttagttatttcaaaactggtacttgctttcttcagtatttaaatgcatcatgatgttgcagggattggaggatgctggttggtaaattaggtttactatcggggcacaggctattttcggtcaatcaacaagggatggtgctgctgaattttgcaagacaagaaatggttggttgagtaaagttgcaaagccaatatagttcttctaaaggtagctcaatttgagtaatttcgagaagtttgttttcaagtgtagctcttctatgtatggcactcgaggattgtacaagtagtatatgtgctagctacattttttttttgttttctttgcaaatcttgctctctgctcggattggcagtacatcctgcacatgcgtttaatgtgatttcaaattattgtatcttaagcgtctaggctcatgttcctcaacggtttgtgacaattcttctggaatctcaattaacacaggcacgagcttatatattcatatacgcttttctgatctctctgctgtttttcctccatgacttttatgttcctttctgatcgaataattgtcgtgatgcaatcacatgttctggttgatcgttgagggttgagactcaaaatgtcaattcggtacagctttgtttgtgtcatcattgaacaaccgcctcatattttattcgtgctattagctgttgctacctcttgaaaatgtattcgagaaagtgaactgaactgacccagctgcttcgcttaggatatgcaggaggcagccgcctaactggattccttctgttgtcttcaaccgatatcaacaaggtcgaccaactctgaatatttcgcaacgcactccatgaatccatctgaatgtgcgttgctacagaaataattactcctgccatattcttttcagtttatttaccgaattatttgcaccatgctttaacaaaacaatctcaaaaagatgttttctagcacattattaacttgtctaagctatttattatgtttattttttaataattcgtttaataatctaaatcaaacatgaccgatctcccaaattccaattgtcaatatttgttaatttcaactcgtaccatcgatgatttaatagtaaagataatatctgttattgtaaggcattattccataaactacattgactagaacacaaaacaatatagtaccaacttgactaaactaatatggagcattttcttttataccattggtcaaatttgattattgtaagtcaaaattaatactccttccgtcccataatataagggattttgagtttttgcttgcactgtttgaccactcgtcttattcaaaaaatttgtataaatataaaaaacgaaaagttatgcttaaagtattttggataataaagcaagtcaaaaaaaataaataataattttaaatttttttgaataagacgagcaatcaagaagtacaaataaaaaaaactcaaaatctcttatattatgagacggagggagtacgaatttatggatggagctctcgatcaacataccagatggctgggcccacatgtcattgcaggtcaaagcagagcggagcagtaattaattggctgccccatgtgtcagggagcaagctccagtgaccaatccccactgcccgtaccgtttcaacgattacccgcggccattaacgccccgccacgtcacaagcggagggatctcatcgtgaatctcgcacgctaaattaattattatttctatccactccggtctccggataaacacgagtccgcctcgcgagacccgtatatgtcggaggcatatgctgccgattcacccctatccactgccaggtgggcccgcctcaccaaccgcccctcccccgctgccactgacaggtgggcccagatccccgcggccccaccggccagcctcaccgacgcatgtttcacccacccctccaaaaacaactcgtcgccctggcccgtgtctctctcctccccttccccttccctttctccatttttgcaaggggaaaaaaagagaggagagagagagagagagagagggaggaagcttcgagccctagcaatggcggggtggtacgaggaggcggtggggctgctgcggcggccggcggtggcggagatggcggtggacgtgctgctgtgcgcggtgccgatctgggcggccgtcatgatcgggctcgtcatcggctgggcgtggcggccgcgatggacggggctgctctacctggggttccgaagccgcctccgcctcctctacgttcccccgggcctcggcgcgcgccgcctctggctcgcctgcaccgcgctctccgccttctccgtcgcgccgcggctcctctccaccgccttcggcagccgcggcaagcaccagcgcaaggacgccgccttggccgacgacgacgacgccgccgacgcctccggggacgccggcgattgcgtcgatggcaggtgggatcctcttgagttggattatctattatcgctgtgggttagcgtggtaggatgaggtgggaatgcgcagcgtttgccttgttagctgcgtccgttgggaactaggtgtgcgccatctcgaaattgaatttattactgataatcgaaatcaatgtgctcacaactcaattctgtggtgactaatgctgatggcaggttaggagcgccgtagcttttggtgaaattgcataattttaactgaactgatgatgatgccatatgtactgacagagctatagaggctggattaatgaaaatccattatctaaaaaaacatgtactgacagagcgaatttatgcttatggcatgcttgaatttcaaattatcgatgttatgttaaaattaaggtgcttgatgtccgtagtatttatgctccgacagataacattaagtgaaagttgtgcgtatcaagggtttcaatgtgtcatattaaaatcatatagtggaaggattagtacaagaaaattcgtttgctatttgttaagtacaactgttaataagatgatccattgtactttacccttgaatttgaccaatactgttattgccaaattgtggagttgagtaacagacttattcttctttctttagcaactgaatttgatgtgattgagttcattgggtcaagtgggtgatcaatggtcgatgtactgacataaaatgcatcaagccatcatcaacataaatgactgggagcttctgactgaaatttcaaatgctgattaggacttgagaattttagacttgttggacataattgaacttttacatgattgcctgttatatattgacctagttgatatgttttttcatcgggtgacccatttgttatgttacagtagttaataactaatgcaaacaaaaagttatttcaaagcatgattgcatctatttaaactgacttcaatataggtttatgcaacaaactgtttgctaaaatccttttcttctgtccatattagaacattttttgagggcggccatcatgttgtcactgagaaggacctagaacacctcgtacaacttcttgataacaaggagagtggggatacaacatggcagcatttgatggaacgtaccacttccaacatgacttacaaggcctggcgccgtgagcctgaggtatgttttccaatgggattgtaggaaagaaacagatgtcaaagtatatgtatagcgtgattgcgtaaatgattagagggccctgtattagaaataagttaaatactagcatctgaattgaaagaaaaactctgaaagttgaatcaactgtaccaagatcagaatttatgtttttaaaatcctgtgatgaccttggcttgccgtggtataatattaattcatttccttgctttgcacctttggttcatttcctgtcttttcaatgaatctacgtttgatgtgaccaaatcaatagcatataggttatagtgcaacatctaatggactgatcttcctttgcttgtaggtgggacctatcatgtactgtagtcgcactatttttgaggatgctactcctgagcttgttagagatttcttctgggatgatgaatttcgtctgaagtgggatcccatgcttgcatatttcaaaattttggaggagttcccccaaaatggaactatgattattcactggataaaaaaggtatgacaacttgacctgcatatctcttgacaagcatatcccccaaattacatattgaatcatgtaatttcaacatgttgcttgttttgtagttccctttcttttgcagtgaccgtgaatacatttttgggcggcggatatgggaatctgggaaaacttactattgtgttacaaaggtatttctaccacaaggttccagtattactattttcacaagacatttttatgatatgctaacctggctttggctgatgttctcatatggatatctaacttaagtgcttaactactgtaattgtatgagcacctattgcaagatactacctctgttcacgaatgcttaaccaatgttctgttgcgaaggctatttatatgtgaccaaattaaccctagtaagtaaactacttactattttctgccaaaagtggaaaggggaataaggacaaaactggaaattctacttgggaacatgaagtgacaaatatttattcagaagaaaatgtggtgaaaagtgataaatattcatgaatagagatagtatctgatttttgaggattctaggtagcggtctgggtgcttctcttgacgcagaggctggatattttccaattatctaaaaggatgaggattctaggtctagaaggtaattagatttattagtgactacaaggcagatcttttagtgaacaaaagatctggtatactaaaacattgtttgttgcgtagcaatcttgcctggctttctgcaaattgcaattctgacatcgatacgattgtacttactttttttgagagtgctagatcaaacatacatccattgtattttaaggtgttgaaggtgtagttgatgtgaatggagatcgaagtcaatagtgtctggcttctagaggatacttttgcatagctcatgcatgtagctcttcttacatttggttcaaatttcaaacctggatctcagcccagagaatcagacgccatggcctagcattcttgcataatcaacattagaaatacatgtatttgaagattgttggcaatgcactatgtagaaaatttgactactatctattatagcgcatatgcttgttgagagacttgtgagcactgaaacacttccatttgcagggagttccttatccagctttgcctaagaaggaaaaaccaaggcgtgtggaactgtatttctcaagttggcgtattagagcaggtaacttttgttcctaccactattcttacttcacctgaattagttcctttcatcacaagttttggtcaagaaggaacacaaatgtttataccttgacattctgttcccttttctgtttgggtaaccacagttcaatcaccgaaacaagatggacagcaatccgcatgtgaagtaacgctggtccactacgaggacatgggcatccctaaagatgtcgccaaggtgggtgtccggcatggcatgtggggtgctgtaaagaagttccagtccggatttagagcataccagcaaatgagagacacagagaacaccctctctcgcagtgccatcatggctcgagtaaccaccaagacatctattgctagttccagttgccccctggatcaagagccctccaatgcagcgaaaaccatcgatgagagtgagaattccagagcggttcaaccagggttcgactggaaatgggtggtgttcggtggcgcagtggctgccgtctgcgtgctcaacactgggcttgttgggaaggctctcctcatcggagctgcatcaagaaggcaggcgaagaagtgatgactgagtactgatgatgagtgatcagcaccctacctgtcagcttctgcaagatggcgttgagctctcttgcgcttcagactgtgcatgttgcaagtagagaagaggtaaagcgaaaaaaaaaaggacatagatgcggtgctactacaggaggcagataattagcacgcttaattttggatctcgtatttatgcagtatcgctgtcgcacatgtgtatcgtcaccataacgtaacaacagatcgtcgtctctggctaatgtacctgaattgaagatatgtctaatgggggattaattattaaaaggttttgctaatgtgcctgaactgttgcagttgataataaaattctccgccgtaattctcgactattgttcattttgttataataacgtgaatgctgccaccttgtggccctttcctttgttgagccagaacgatgttgttggaccgggttctgggtcttgccgttttgacctcctgttatttggtgggctgggctgcaatttctactaccggcaggtatctggttatctacttgtcagagccgtctgtcaatgtgtatgtgaaaaacgttttgatttttttttctaagttgaactttttaaattttgattaaatttgtagaacaaatatagtaatattcttatacaaaacgattatgtagtagatgttactaatatttttataaactaaagaaaaagttaaaacatcttataatataaaatggagatagaattatagattatcagaggttttttgcaattttgcaccatcttcggcatctgggtaacacccatagaaagagagagaaagaaaaactgaatatgagcattcagttttcttttcttgataagagattaggctcatacaggccggacaaacccctccatattctccccaaaaccatgcatatgcattcatgtgtctacaggtggtgtacatgtgtctgatgatgtaactaatggcgaaagaaaaaaaatcacattatccggctgcccacatatccaatgtctcaaccattactatctttgaatgggaacgaagtttcaattatcactgtattcttttttaatggaaacaaagaccaagaatttcctgattgcagctcctggattctacgcccagtgcagaccaacaccttatcaatttgtcatatcgccttcaaacttttttttcaaagcttccaagctgctccacttttcgtaagcgccgccaccacagcatccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21546 - DNA, 3765 bp, Oryza sativa
  unsure (1)..(3765): unsure at all n locations
gcgtccttggataactnnnnnnnnnnnnnnnnnnnnnnnnnnnnnnnnnnnnnnnncacgacatccagagtaggtgctgaagatgaggtgggtaatgtcggtggctggacggccccacttggcaatggccttccttgcagcagactcggcgagctttgggacctcggcggcggcgatttcaacacgagcttcaagggagggctggtgtttgtcaatgatctctggatgggcacggatgatctcctcatcaaggtggatgtatcgcttctctatgcctgattttttacctataattaaaaggaagacccaatgcctctattaattaggttgtacctagtagtcttgaggatagaaaaaatatatagaacatatcattgcagatttatatctctgttgcaaataattacaaaactaaaatatatgttataatgctctttccagaacaaaatcacgcaatttgttttcgtatgtattctccaaatatttagaaagctgtacatgtttaaaatttggaaagattgacttggcacatggttttgttgaagtaccaatggtctcatgatgtagtatttaaatcctagtcccggccagcaataataaacaatttagtgagatttcaataaaaatttagtaagacccagagattattgttgtgactccctctgttgagatctaattaaaagtgggaactcctcactcataggtaagtgcttgtggtgtgcgtgcctgatttttaacgtgacaaagaccattaatttggtttttacctgcatttatcacttagattgcaaaatggcaaaaacacttatgaagcgtgtctaaagtcgagtattatcatactcttcatttctgattactagatagtgcggcatatatatctaacctctatataggacacgtagagcctacattcttttcaacatagaataaatatatgtgtggtttaggaaccatggcatgatattgctagaaatgtaagagcttgcataacttgtttctgattgaagtaaatggaaaataattaataatagtcatatgataagtagattgaacgatcttcttacatatcctcttcatcttgtccttaagttcagtaagatgctcgctcttggttaggccgaagtagtagtcggcaaagttatcctgaggaacaatattagctgggtttgcagtgccgatggcgatgatggtggcggggccttccgcgcgctgtgcgctacggcggctgtcaacaacggcggcggtggtagctgctccaggcatggtgatggaaatggaagatgtgtgcttatgaaattagttagcctgagagagatagaagattatgtgatgcgtctatggatggagcctcttgctgctgtctctgtgtttttatactaagcatatcagctacctagcactaggtagccacgaactctatctgcattagtaaatggcttagagaaattctcaaaaaatcgtcacatgttccgtgggtttaatgaaatgaaatagaaatatttttcttctatagaccacatataatatatatatataactcaataccataatatatgtagtaacaccctgatcacatggccatgaacaaaatcatacattaagagaactataaaagacatatcttccaaactctaaatttacaattaaagttgggtctgccattcaatccacagctactgtggtctggatcaaggaccctttttccacttcatgtcctctaacatcgtgcaaagtatcaaatgagcaaaatctttacacgagctttattatattagaaggagctgctacgtacctggctgctatcatgattaattccattgcatcgcgcgttattatttttagataacaggaaaaatatccctgccatgttcaatatatatagtatcttattttcacgatagactatagattagagtatgtaattaataaatactaacatataatattgtagagcaaactagtttagaatgcgataccgtacccaaatatttcagcattaattcgtattttcatatgcagcttgcgatcgtcgagctatcattgtagtccaaacatagctggcttggggttgttaaattattttttctgcacaatcactgcactcctgcattgagcttaatcttccctttcaaattaatgagtttcaggagaatcaactagtgctgtggagtttacatatcttaatactccctccatctcaaaatatttgacgccgttgactttttaaaaaatatttgaccgttcatcttattcaaaaaatttaggtaattattaattcttttcctatcatttgatttattgttaagtatacttttacgtatacatatagttttacacatttcacaaaagtttttgaataagacgaacagtcaaacatgtttaaaaagtcaatggcgttaaacatttaggaaaggagggagtatataactcgatattgatcgatccaatcctacagcataccttttttttatatatttagcttgtgattgtccagctgttaatctagatcactgagatagtcaattaacttagttttccgcacaatcacccctcatctcataatcgacagagtggtcactagaatcatgtaccgaataaaataatatgtatcactcatgactgcgacattggttaagactggtaatgtttcggatattcggcgattaaaagaaaaatatgatatcgattgttgaaacatgaattcagcaataataaaaggggtagcacacgagacctaaaagtggatggatgcggagacaaaggatttagacaggttcaggccctctcgatgagaagtaataccctactcctgtttagggatttgaatccgccaggtgtagtatagatctgacgatcatatgtgctcatgccccctagagggcctcctgcccaccttatataggatggagggcaggattacaagatagaaaccttaaccaatacggtatcggtttccaatattatcaaaccaggactttaggccgttccgtaatatacaaggaaacgtaatacccaagtcatgatctggtacatattccatagatataagttatcccctataactagtcagataaccatgccgtgtgggtatggggtacccataatctccacatcgataaatggtcgtcattctctcataattaaatgtcataaacatgggtaccgggtatcccacgacctgcaaagatgattcttgcaggcggcgtcttatgtgctccgcctgccataacctatcttcacagacggaccgctaactcctccccggtactcattttcgccggcggagtttttctccgatgaccatacctgcctacgaaaaaaatacccaacaacggcaaaaatgctttttctagtagtgattcttcatgcatcgttctttagcctgagcatcccacataacatcgttgattgtctagaccccaactcccactaggttcaattctaattccatcaccgacattgctccttcagccttaatcaatgcctgcacattaacagcaatgaaattgttgtcgaaaaacaaccacttctgccgaaaggcaggcttcacttgaagagtggaaaaggaaaatagtggttgtgtattaatttcttcaaaattagctcccccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21547 - DNA, 3752 bp, Oryza sativa
  unsure (1)..(3752): unsure at all n locations
gtgtgccnattgtatnnnnnnnnnnnnnnnnnnnnnnnnnnnnnnnnnnnnnnnnnnnnttggtggagtgggtttgaggctttgatttgcttgctctcctctagatcatgcaaaactcacaagtttctacccagtttcgggcctccctgaggataacaatcctactcctacatttcctttttttggattgaataaactagggatatacaaacccaaatcatttttcctacataactcgagagtctgtcttcaaatgttttcaaccccttcatggggaaccctcggccctttatatagtatgatagagggacaaaaccaagagaaccgtgcaaacacccatgatggtctaagccctagttgctgtgctactaccacattgttgagtagatcagatgctagctaatcctgtcagcgggcaggatccactatgtcccccccccctagggatttctaggctgccatccgctcatagcccttgggaacgccgtgcgttcggcctaatccacctctgggcagtggtgtaacagacggcctaggtttaccaatctggggggtggtcccggtgggaccacacaaaaaataaggcaaccgacccaactatatatagaaaaaataatagaaaaaaagcgcatgaacctggaattggaaaccgaaacgtcgcgcgcagcatcacacgattgctacgcgtcctcttctcacttgactactcgtttttcgcgctgcctcctgccacccgcatttgcacaagcaagtccatgtggagaggagcagaggacggaggactgcgactccacgagcgcgggctgccgccgccacccgcctatcaccggccacggctcgcaaagcagagtggctagcgtgacgagactacgagtccactctccgctatattgtagatcgctaattgttgaaacatgcagcaaagaaaaatagttttaaattgctttcttccccagttgtggtataggagcacactcaggaccaagacgttgagaagatgtctcaccacccccgccgcgggtttatgacattgacagccttccacatgatcaagaggaaagactacccattgtaagttatcttgtcaatgatcaagatgcagttcggagagcatatgttcttaaaggcccatttaaaccttatccacatgattttaagaaaagaaaaattggaaatagagatcggcaataacaaaagggagcagcgcacgagatctaaaagtggatgaataaagaagataaggatttagacatgttcaggcactctcaatgaggtaataccctactcctatttgaggattgtatccgccggatgttgtattgatttggcgatcgagttatggttatgtcctcggagagctccttgctcacttgtataggttcggggtagatttacagagaagaaacctatttgaacacggcatcagttttctaatctattatatgataacctaacaaaacctatgggctatgccgcatgatacaagccaacattattctcaagcccaagaccattacataatgctatgggtccaacccacctcctatttccaattggatacgtaggctgagtggatatgtggtacccatgatctccacagttcagcctgaggaggtaccttcaaatctaagagtccaggatagcattacaaaagcctagcaaataaataccacagataagaaagataagcaaaataaaagaaaattggcttaggatagagttaaaacaagtaatttgaaatggaggaagtaatgtttttcattctaaagacaaaatagacggagacattcatgtccaagtccgaaatctacatgattctgagttgtttatgacaattaagtcacaataatatagttgtttctgacaatcaaatcgcaaaaatattctgatgatacacctaacggatagaacagggagtcttgaaaacaaaaccccaacattattcagaacacagcatcaatgtaagccccattagccaagtgaaatcgcgacttgtgcgtggtcatttgaagctccactctcccatttctgtttccgctgcaattgccgtgattcacaaccttggttacctccacaccggtcaagattacaaaatcctgccaagtcaatttattgtcaaaatcgccacccaactccagtttttcaatgaaccttgcgatgcagaacctgcctgagcccaggttaacaagttgaggatcctgtgttacctgccataccctgttttgttcaagttccttccaactgctaactagctctggctgggaatccatggctgacagatcagcagcagccaacagctggtcctcggcagagaggccaaaccagagcttgagctcgggaacatactcgaccttgcccaagaagggtagcgtccactcgcccactcgactccacatgttgctggccacgtccaaacagtaggttcctgcgtcctcagccgatacgaggatgcgccacgaaccgtcgtcatcgccggcaaccacggcataggatgtgattcgatggcgtctctggctgtaggcgtaatcgcggacgtatggcggtggcgggagcagctggcagtaccacgacatgaacgacgctgtcaccgtgggcttgcggtagacaaaggcctcgaactgatcgatgcaccgcgcgctacaccccgcctctgatttggggcttttctccatgatgtagagactgttgccttcaccatcgccgccgtcgttgtccgtgccggggacgaagagggagaagggcctccacttgggtttgttgaggcttggcattgtcaccacctggtctgtgtcggcgtcgaagaggaatgcgcggccagactggtccacgcagacaaccttgcgatctgcaagcgggaagcagtcgatattccacccgtaatcaggatcagccgcttgagctttgaagctgaagattgggtcgggaagctggaacttctcctgcaccataaacgctgccccatccgcatgtttgttcttcgtattgaaggcatcagcagtctgttgttgctgcgaaataatgctgctgctgctgcacgcttccattgttgttgccgttggtaacggtgggtgaaagagtgggtagcgtgtcaagtcgatgcagctaagtgatctgatgccaggatccgccccgttctccacgatcagattcagaaaccgccgcgggaggctcatcgtctttcaatcaaccgaaactcaaactttggatcggaaacaattgtgactttgtgaggaaggaaggaggagtacctcgtcctgcggtcgaatcgcccaagatggcatcataaaaacccaagcaaataaatacctcagataagataataaagataaagcaaaagaagagtaaattattggctctcgatcaaaaaagaagaagatgatgaggcggacctgatcagctgaggcgggtgcaaggtcggagaagtgagaagaaatctcatactttgggggagtatgagattgctgaacgtctagggtttaagaaatctcagccacaggcgggcgcttgggccgttctgtacgggcctcggccacagcccacagccacactagtaaaatgttttttttttcgaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21548 - DNA, 2988 bp, Oryza sativa
  unsure (1)..(2988): unsure at all n locations
atgggtttgntttgtanatgatataacnnnnnnnnnnnnnnnnnnnnnnnnnnnnnnnnnnnnnnnnnaaatctcagccacaggcgggcgcttgggccgttctgtacgggcctcggccacagcccacagccacactagtaaaatgttttttttttcgaaacaataccaatattgctgcccagcttaatatttcgcccaacggcaagctcctgccgatatctatctcctctgtacgtatgagtgtcagtcggatgcttgcatgcagcaatcagtatacatacttgtgcaattgaatactccctccgtttttcgttataagttcattttgaatttggtcaaaatcaaactacttcaaatttaatcaatctatatacctacttaaaatatacctacttaaaaaaataagtaaggctttcggtagggttttttcgtccgtcaattttttttcacacgcggtatttttctcacgcgcggtttttttggccggtttttatcagattccggtttttttacgtgtggtttttgtccgatttttttgtccgattgttttttggtgggcccggatattccccaccgcgtccaatttttttgtgggcccggtttttttccaaccgttgattctgatgggcccggttttttatatacaaaagaaaaaaaccacaggaatccatgttcaccatgttcacgcacagaaacacagtagtccaggttcacgcacaaaaaacacaggagtccagttcacacacaaaatatacatacaaaaaaacagagtccaggtttaccaggttcacgcaagaaaacaatatcgcatacgagtcaggttggttcgcccacaccttttcctgctcctgtttgcgcagcccaagtcaggagttagattctatcccgattctatcccgagtcagattctatcccgcttttgtttccgctatatttagctagcactcccactaacgtgattttatagatttttctcgcaggacaaaatacacaaatatgattacaggcaatacaaataatagaagcgcacaagaagatatagatcacaaggctcttcttcctctaggatgtcaagccacctccaattaatgtcgattccaggttatcaatgaactcaaccctgaatgcaatttcaatttcattagatttataagattaatattgaataaaactacccaaggtcttttttctgtccatgcagaaacatatagcaagttagcaacaggcatattttcatttcagttgctcagcggctattttcataacataccaccacaaaatctaggagttgcaaacccaaacatgaaaatctcttttttaagtggctttatatattactagaagaaagaaaaagtattggtaattgcagcaagagcaattttatgcagaaaaacattaactgtgcagacagatgaaccatcgtttaattattgcaattttttatcatgctctaagaaccttaatgtttatcatgctctaaaaaccaagtaaatacaacacgactagatgaatgtctttctgctttctttttaccttatgtccgctctgcttttattcttatttattggcagtaattaccggaatatttttggcaatcatctcgattctatacctccaacccatcaaagggtgataagaagaaggttcacaatgcagcacgacattgccaattgcctgaaaacaatgtcatagccaacacttataccaatccagatcagcagacatcagtatggagctcttaaaaattccaaagcattacaacggggcatagcaagtacaataggttccaatttagccatgcaactaaacttaattctgaaaaaaaaattgacctgatcatcataactctttagattaagaaagatatatcttgatgatctttcagaatttcatgttcataagcttatattattgttgagaaaggctccaattctatacacatgcataaagcaaaatattttaaatcaaagatgtgtagggaaattttatagactccaatgctaccagaagtaccttaaatcacggatgcattagtgagtctttttgcaataatctccacattcttcagcagagcactatcatgaacctcagtacactgataatttagatgtatagtccttggttccaatatcgctatactgtccctgcatcatggaaacaaatgcaagtaagaaaaaatatccatcacatatcaaaacaaagtttctttaaatcaaataaaagcatcatggcatatagcaaactaaggtttgatttttttttttttggtgctacattggtacatgtcagaattgagtgttcctaaacagatgaccaatcaggcatgcacattgcaaccaaaacaaagcaggaaaccatgtgatcagatattacatcgtaagagaaaaaaaaattggttgcagtagtacggctgtagtttgcacaaaatttgagtccgtcgcatatcgctcgcgccattaggatcgaacaaagacagagagggcagataccatgttcaacccgaaagagattactagaaccaaaacgattactacagattcaatttggactaaaaagggggatgaaataaacctcataaatacaagaaggattccactagattactacaacaaccaatcgaggaagactcaattggtcagatcgaagccgcgtgaagcgcagatccagcaagaaggaagaagagggttctggcggttcaggggctgaagagagcatagaacggcagggggattgtgggcgccggtcagcaaggaagagaagattgcattattgcaacgatgaactcaccgtggccactctagatccgctccaccgctgatgtgtgcagccgtcgtcgaggttgtcgcccccttcttccaatctgccaccccacctcatggccggccaagaaaggagagcaggggcgccggcaccatctagnnnnnnnnnnnnnnnnnnnnnnnnnnnnnnnnnnnnnnnnnnnnnnnncaagtttatacaatggccccg

SEQ ID NO: 21549 - DNA, 6732 bp, Oryza sativa
  unsure (1)..(6732): unsure at all n locations
gtgggcnntttgatannnnnnnnnnnnnnnnnnnnnnnnnnnnnnnnnnnnnnnnnnnnnnnntatatcatgctattgtaaatgatctactattatctctcctgctcactttcttatccatattttctagccagcagctcagtacataaacaatataaaatgctatattaactatctatgatatactaatagtccattaaactccttacaaacactctcaatctgtcatatagtgttctacaaacactcctaagacgtcatgtggcgctcaaataaactagaatatcctagaaattatgataaaaaattaaaactattgattttcctttaaataggtgaacccaataattgtaactactacatctcacagaaataaatccggtacccccatctcaacccctaccatatgtgtgcacgcatgcacgtacgtacctactccttccaccatcctactcacctctaggatccaactctcatcttctattttctagctaacacataattaatgtataaaaaataataatagctaaatacatgtacttttctcagtttatttgatttggtgggttatttataattaaatacataatctgagatccatattacccatatttactatatagaagttagataatgcggctgctctaactacaaatatttgagcaaaatagcagtttgaaaacaatcaacgaattcaaatatgagtctaaagtccaagttcaatcaccaccaagaagcctggaaccataatgcatactttgggcctgaatccgaggaaggcggagctacaatgaggtggacactgatgacagcagcagcatcgacttcctcaagttcctgagccaaataacgcgctagataattatgtgcagggcaaggactaacaggaggggcagagagagatgttccatgtcttcgacaaggactagaaaacaacttcatctttgccaccgagcctcgccacgttatgtccaatgcatcaagaaaggctcactgatgagaaggtcgacaatgatccgcgaggctgatggtgacaggcggatcactacaaggagtttgtacttaaattcagaaaaaaataaaagaagcaatttgattaaaacacatacaaaaattataaaatcattaaaactataaaaagaaacaagattccatgtagaatataaaatatcaagagtccatataaaagtataagttataaatatatggaatttggaataataaaagaagtattaaaagaagagtccaaatacaacacgatacatgattaagtacaatttaaaatccctaaagaagacaatgtagaataaaacaataatttgattttaatacaaattctagataagaataagtcaatcactaaattcaaaatacaataaatatttttattagaatttttctatatttattgattcaaatgcataacaaattgcatatatatatatatatatatatatatatatatatatatatatatatatatatatatatatatatatatatatatatatgaaccgatataaaagagggctttctcatatgtacaaatatacaaatattaccaaataaatctttgtcagatctgttcatatcgacactatttaaatataaaaaattccttacttttatctcaatctggttcgttctaactatttttgaaacaaactaatacgcatgcccgcgcgaatgcgcgggctatcttcctattttatataaatgtgggcaatgctagaaagtcttacattatgaagcggagggattattttagttttgtaattattttgaacaaatacttaaatgtccaatcatatgttttattgttttatcaaaccttagggggtgctaagtactaactgatagagatatacatggttcttccttattcactgcaggtcagaaatcgggcatagagaagcgctacaaccatccttatgaggagatcatcactgcccacccagagatcattgattgtcacaccctaaaaatcctaaatatataaattgttgtttaattggaattattagaaatgattttaaaagcctagaagagaagatctaattttaattaataaattccaatataaaatggggccagataaaatttcattaaatactttgcttaactctataattcctagatttttctgggatttatttgagctaaggaagtatttttaatagatggaattgcatttaatgaataatttaaattgaaaaaggtttttaaaatcctcttttggctttgggccgaaagtcggcccaaaaccttctctctccctctccccggcccaagccagcccagtccgcccgcccgcgcttgcgttcgccgctgacaggtggggcccgcctgtcagggtcatcgtcttcctcccgacgaaaccctagccgnaccgngccgncgncgncattccaaatctaaccgtccctttccgtttccggtgaaattgattgaggggaaaggatccccgtgatccactctaccttttcccttttggaaacatcgtctaaatcgctttggaaattcgcggattcgatctcgaatcggattcgtctctctctcccgaaccctaatatttccattgcgtcgccggtcgccatgggccttcgccgccgcgccctagtccctatttaagcacccccaggtcctccgctacccgtcgccaccctcgccttcatctctcgtcgctggtagagccctagcaccgtgtagcctcgcgccgccgtcgccgccgccgctccagccgtgtgtcgccgtcgctccagtcgtcgccgtcgctcgggaagaccgccgtcgtggtcgccgtcgcgtcgccatcctcgtcggcccctccatcgttgctgtagaccaccggagcaccgccgtcgtcgtcaacccgaaggttgccgccggcgagcttgcacgcccgagccgccgctggtgatgacgtcatcgccgacgccatcgttgccatccgtcgtagaccggtcgtagaccgttaaatcttggccgtccgttgtggataggatcgatctcggccgttcgtttccgtgagccgccgctgtgcacccggttcaccgtgaaccctagccgctgacgcaataattcccttttccttttcaaaaataattcattattgcgtcataattcaattaaaacccatataaatgttgtaatccgatttaaactttaaaaattcataactaattcatcttagctcggatttagttggttcaagtctctaaatttttctaaaattgagatctacatgttaaaaatatccacatgtactgttcatgcttgtttatgtgttgttttggtgttttttctcttttctgtttagattccgacgtttccggagagttcgttttcgcaggagaaaaatttgaagagttccaaggccagcaaggcaagtcacacagatcccaaacaattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgcttgggagtccatgccttgtttataagggggtgattatgatccaggaacggtgcactgtggtggattgtgttgtgcgaggggtactgtcacagctcctttctgaggtaccgtggtggtatcgaggcgcatggtgacatgttgtggggctgtgtcttgtgggttcagtggtacatctctggccagagtaaaactatttgaatagccgtgcccgcggttctgggcgggtctaacaatgtctttcgtgattagtttcacacttctcatcataatagaagatgctataactggtaataatttgattagctcctggtttggaatggtatattcctggtgtggagatagaactgtgcagccgggatggttgttcagaatggttgggcctatgcaacagggtatgttgtatagcgttggattaatattgtttaattattacctaactgttttattaaattctgaaatgtttgttaaatgctgtttatgcaaatgaaaccctactatgccatcctttgttatcctgtgcacttgcatatttgctgcgtggcttgctgagtatgtcatatactcaccttgcaattatttatcagaggaggagttctacagtgatgctgatggtgtggatgattaggcgtagccctggtcaaactgcctgtggagaggagtcgcctgcgctgtttcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcctccttgaccctagattatgccaaatggttacccatagaagccctctaaaaatattggaaaagtagaactgttctgctccctttctcttttaattaaaccaaactaatagcacatgcacttcataatctcttttagtggttctcattgaaaatttattccagtgttattagtactgtacatctgttactgtactaatggctcatttaccagcaaaagttttacaacattgttttatttaatcttgctgcaatgaaataaatttagcatgttgattttataactttcttttatttctttcggaacctgttgttcaaaagtgcaaaatttgtgatcttgtttccaactgtttcaacttatcttgcaagcctggtttactttatttacttaccttttacttaatccaaaaacttgtgctattaattgaataaatgtcataactccctcctttcacttatctttagatgccgcgctacaagcctgagtacttgtttggtgttgagggatttgtccaggagttgcgtacgatgtcctttgccataggatttgggactgcccctttgtatgcccagattccccatgattgtgatgaagagaagtgccgagtcaaagtcaccttgaacagtaacagtgaagatatcccatcagtgatgttcaaagctggaggaggaaactacattcatgcatgtcaggaggtggcaaggatcgccataggagagctccgcgatcgctacagtgatcagttggccgacactgagtatcgctaccatcctcgccaaccccagggaagtgaccgtggcagctaccttgagaccgaggggattgagaatgatgctaccacaaggcatttggttgagatgctgtgggctatggatgagacccacgcggaggttgtgctagcagctcaagatcgtgaagaccggaatcgtggaaagatttgcaagctagaagacaaggtggagcgtttggagaaggaactagccgcgttgaagggagaagcaccaccgcagaaggccagggttcgtcttaccgcaaggaagagagctctattcgtccctcgctaccaattggcgccaaaggtccgtgtggtggagaaagaagttaccccagccctagcgaatcctccgatcgtcaacgtaagtgatgatgaaggagaagaatcgaagcgcacccactcaaaggtcgaatggggagctactcaagatgatggagacgagctgaacgagccttcaatcaactccgatgcccggaagacctagaatgccttgtcaagccgttgtcctagatcgttgtgttagtttgcttgttttaagtttggttgtgtgtgggggtcctgcatgtggtttacatctgtggtgggatgtaagtgcatgcgtttgtttgctttcgagtgttaggtagttggtgagtttagtgatgtgagagtcttcagttttgtaataatgaaactcagttaagatcaataaaagttaagttagtagaaaaattaattctctgtcctaagtagttttccccggtttctcttcttgtgctcctgcccttgccagatggtgctcactcgcagcaacgggaatggccccaacatcaataataacaacaacaacaatggagagaatcccacacttgcccaagtcctggctcaacaggcacagcttatgaacatgatgatgcagcaactccagaaccagcagaacgagggaaataaccatgcacctccccagaacaagttagcaaaatttcttcgtgtgaggccgcccactttctctagcaccactaatcctgttgaagctggcaattggctgcacgccatagagaagaagttggatttgcttcagtgcactgatcaggagaaggtctcatttgcatcacaccaactgcatggccctgcctctgagtggtgggatcacttccgccttaacaggactaccgctgaacctatctcttggtttgaattcaccgctgctttctggaagacgcatataccatcgggagtggtgtctctcaagaagaaggaattcaggtcgctcacccagggatctcgcacggtaaccgagtatctgcaggagttcaatcgtctggctcgttatgctccggaagatgtgcgcactgatgaagagcgccaggagaggttcttggaaggacttaatgatgagctttcttacccactcatgactggggattatcatgatttccagaagttagtagataaggctattcgccaggaggacaagtacannnnnnnnnnnnnnnnnnnnnnnnnnnnnnnnnnnnnnnnnnnnnnnnnnnnnt

SEQ ID NO: 21550 - DNA, 7671 bp, Oryza sativa
  unsure (1)..(7671): unsure at all n locations
cgatgggnntttggannncttgnnnnnnnnnnnnnnnnnnnnnnnnnnnnnnnnnnnnnnnnnnnnnnnnattgatgatttgtttgatcagcttaaaggtgccactgttttctccaagatagatcttcgatcagggtatcaccagttgagaatcaaagaggaagatatacctaagacagcttttaccactaggtatgggttgtttaaatgtactgttatgtcttttggacttaccaatgcccccgctttcttcatgaacttgatgaataaggtgtttacggaataccaagacaagttcgtggtggtctttattaatgacattcgtatctactcccgaaccaaagaagagcatgaagaacatcttcgccttgcactagagaagctacgagaacatcaactgtatgccaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcctaggcctcgcaggatattatcggaggtttatagagaatttttccaagattgctaagcccatgacacgattacttcaaaaggatgtaaagtacaagtggtcagaagaatgtgcgcagagttttcaagagttgaagaatcgcttaatatcagctcctattttgattttgcctgatccaaagaagggttttcaagtgtattgtaatgcatccaagtttgggttagcttgtgttctgatgcaagatgggaaggtggttgcctatgcatctcgtcagttacgtccgcatgagaagaactaccctactcatgatcttgagttagctgcagtggttcatgcgttgaaaatttggcgtcattatctttttggtactcgtacagaggtgtacaccgatcacaagagtttaaagtatatctttactcaaccagatctgaacatgagacaacggagatagttggaattaattaaggattatgatatgggaattcattatcaccagggaaaggctaatgttgtagcagatgctcttagcaggaaaggctattgcaatgctacggaaggacgacagttgccattggagttatgcaaggaatttgaaagattaaatttgggaattgtcagtagaggtttcgttgcagccttagaagcaaagcccactctaatcgatcaggttagagaagcccaaattaatgatcctgatattcaagaaatcaagaagaatatgagaagaggaaaagctatcggtttcttggaagatgagcaaggaactgtatggttgggcgagagaatctgtgtccctgacaacaaagatttaaaagatgcaattctgaaagaagctcacgatactttatactccattcaccctagtagtaccaagatgtaccaggatctcaaggagagattttggtgggcaagtatgaagcgtgaaatcgcagaatacgtagcagtatgtgatgtttgtcagcgggtcaaggcagaacatcagaaacccgccggtttgttgcagcctttgaagataccagagtggaagtgggaggaaatcggtatggatttcatcactggcctacccagaacgtcatcaggccacgactctatttgggtaatagtcgacagacttaccaaagtggctcatttcatcccagtaaagacaacatattccggaagctggttggcggaattgtatacggcaaggattgtgtgtttgcatggcgtccctaagaaaatagtgtctgatcgaggtagttagtttacttcaaagttttggaagaaacttcaagaagagatgggttctaagctaaactttagtactacttatcatccacagacagacggacaaaccaaaagggtaaatcagattttggaagacatgtcgagagcttatgctttagacttcggtggaagttgggataagaatctaccttatgcggaatttttgtacaacaacagttatcaagctagtctccaaatggctccgtacgaagcactgtatggtcggaagtgccgcactccgcttttgtgggatcaaacgggagaacgtcaggttttcgggaagcagaagagaaggtaaagatcattcaagaaaggttgcgtgtggctcagtctcgccataagagttatgccgacaatcgccgcagagatttgagttttgaagaaggagattatgtgtaccttcgtgtcacgcctcttcgaggagttcatcgcttccacactaaaggaaaattggcaccgcgtttcgtgggaccttacaagattgtcagcagaagaggagaggtcgcttatcagttggagttacctcaatctttggcaggagtccataatgtgttccatgtgtcgcaattgaaaaagtgtttaagggtacctaccgaagaagctaatcttgaacagatagaagtccaagaggatctaacctatgttgagaaaccaatccgtatcttagaaatagatgagagaagaaccagaaatcaagttatccgtttttataaagtccaatggagtaatcactcggaagaagaatcaacttaggaacaagaagatgaattgaagtcagctcatccgcatctattcgccagttcttccgaatctcgaggacgagattccgtttaagggggtaggtttgtcacaccctaaaaatcctaaatatataaattgttgtttaattggaattattagaaatgattttaaaagcctagaagagaagatctaattttaattaataaattccaatataaaatggggccagataaaatttcattaaatactttgcttaactctataattcctagatttttctgggatttatttgagctaaggaagtatttttaatagatggaattgcatttaataaataatttaaattgaaaaagatttttaaaatcctcttttgacattgggccgaaagtcagcctaaaaccttctctctccctctccccggcccaagccggcccagtccgcccgcagccgcccgcccgcgcgtgcgttcgccgctgacaggtggggaccgcctgtcagggtcgtcgtcttcctcccgacgaaaccctagccgcaccgggccgccgccgncattccaaatctaaccgtccctttccgtttccggtgaaattgattgaggggaaaggatccccgtgatccactctaccttttcccttttggaaacatcgtctaaatcgctttggaaattcgcggattcgatctcgaatcggattcgtctctctctcccgaaccctaatatttccatcgcgtcgctggtcgccatgggcattcgccgccgcgccctagtccctatttaagcacccccaggtcctccgctacccgtcgccaccctcgccttcatctctcgtcgctggtagagccctagcaccgtgtagcctcgcgccgccgtcgccgccgccgctccagccgtgtgtcgccgtcgctccagtcgtcgccgtcgctcgggaagaccgccgtcgtggtcgccgtcgcgtcgccatcctcgtcggcccctccatcgttgctgtagaccaccggagcaccgccgtcgtcgtcaacccgaaggttgccgccggcgagcttgcacgcccgagccgccgctggtgatgacgtcatcgccgacgccatcgttgccatccgtcgtagaccggtcgtagaccgttaaatcttggccgtccgttgtggataggatcgatctcggccgttcgtttccgtgagccgccgctgtgcacccggttcaccgtgaaccctagccgctgacgcaataattcccttttccttttcaaaaataattccttattgcgtcataattcaattaaaacccatataaatgttgtaatccgatttaaactttaaaaattcataactaattcatcttagctcggatttagttggttcaagtctctaaatttttctaaaattgagatctacatgttaaaaatatccacatgtactgttcatgcttgtttatgtgctgttttggtgtttttgctcttttctgtttagattctgacgtttccggagagttcgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggagttaacctattgtttgttatagcccttttgttcttgattactttattccttgataccttgggatattataacttgactagttgagctttatatattggttcagctagatattagatatgattgcttagtcatgcttagaaacattagcacactattgagataacttataattcactattatttaatgatggcttaatgatagctcacgatggtcaatcgtgattggttaattaattaaactgccaactaaaacttgctaatggtgggttgtgagcacatggttttgatggtcgtgctcatgataattaaggaccggttcacgagttttggttgtgaaacattaactgtgccaaccacaagctagcgtgggcaacggctttaccttttgtatagcatggttcattgcggagcaccagactgagaagtggcggagataagcccacgggggtcgctggggagtccatgccttgtttataagggggtgattatgatccaggaacggtgcactgtggtggattgtgttgtgctaggggtactgtcacagctcctttctgaggtaccgtggtggtatcgaggcgtatcgtgacatgttgtagggctgtgtcttgtgggtacagtggtacatctctggccaaagtaaaactattcgaatagccgtgcccgcggttatgggcgggtctaacaatgtctttcgtgattagtttcacacttctcagcataataaaagatgctataactggtaataatttgattagctcctggtttggaatggtatattcctggtgtggagatagaactgtgcagccggaatggttgttcagaatggttgggcctatgcaacagggtatgttgtatagcgttggattaatattgtttaattattacctaactgttttattaaattctgaaatgtttgttaaatgctgtttatgcaaatgaaaccctactatgccatcctttgttatcctatgcacttgcatatttgctgcgtggcttgctaagtatgtcatatactcaccttgcaatcattcatcagaggaagagttctacagtgatgctgatggtgtggatgattaggcgtagccctagtcaagctgcctatggagaggagtcgtctgcgctgtttcttatttttttccgctgcttagatctttattgattgagaggaactatctacctctgtaatgacattttattcgcttattaattagagtaataattgtactctattatcaatttgttattgtgtgcctcggttgattcctggacgagggttcacacacatgtaagcgtttggaattttggataaaaattccgggcgtgacattgataaacacatgccctcccttgaagctcgtgtagacatcgtcgcttccgaggtcccgaagcttgccgagtccgccgcgcggaaggccattactgagtggggccgtccagccactgatatcacccacctcatctttagcacctactctggctgctgcgcccctagtgccgacctgcagctagcatcgctcattggcctccgccctaccgtctcccgcacaatcctcagcctctatggttgctctggtggtgctcgggcactccagcttgccaaggagctcgttgagaacaatcgtggcgcgcgcatccttgtagcactctccgagctgaccctgatatgtttctcagcccctgatgaaagcaaaattgtcgggcatggactattcggggatggcgctggtgcaatcatcgttggcgcaggccccttggctgatggcgagcgcccattgttcgagatggtcgctgcctcccagaccacgataccaggaacagagaacgcacttggcatgcaggccactagcagcggcatagatttccacatctccatccagctgccgacgctgatcagggataacatccaggagagcttgctccattcattctgttcggtcggaaacacagatcctaaatggaacgacctcttctgggcggtacaccccggtggccgcatgatccttgacaacatagagggtgagctctaactacagccgtggaagcttgcagcaagtcgtcaagttctacgtgagtacggaaacatgagtggcgcgacgattgcgtttgttcttgatgaactacgccagtgtcgggagaaggaaaaacaagagccagaacagcctgaatggggagtgatgctggcctttggaccagggatcactattgagacaatgatcctgcgtaacccattgcctcatggtcttatggaaaattaattaccactatcatgaaaagaatgcaaagggaatcaacacgtgatgcaccagtatttcactacgctatgataattaattaatggatgacactgattgttcacgcttaagtatttccaactctacttgttgcaaatataacttttattacttccatatgtcctctggttctttagctttcttgatttgtaacaaaatttgaaatacccttttaccgtgtcatttgtcagtatagtcgaattattacctctgtcaaggccctggtaataagattatgtattttttttatttccaaaatcgcaagaatacactgatttggggaaaatttacacaaatataccgttgatgctcttttgatgagcgagagcgttgcagccatgtcaatctcgcacttcgggagagagaaaccgcgatctcgctaaatggcggcgtgaaggttgttgaaattataagcacataataatttaatttattccataaataaatcatgatattgcagatgtaaactagcatgaacgtatcataagatctataacatgaacaacacgaacagatcaaatatgcgcaaaatattaaacacgtaccgagattgcggaaaaacctgttgctcggcaagaattactcgcggttgcgggcgccgacgaaggcgcgcagcacgcgagcggagaggaagacgagccgtcgcggacgaacagggagcagtcacgcaaaacgcttttcaaaaaccttattgctgccttctcccggtgcaagacgtcgaaggcagaggttccggagacctgctctcccgattaccggtgcacgccggcgagcgggatggagtagtctacgagcgacggcgcagcacagagtaggaggcaaaccctagattggtttcgcgtatgttgcgtgaagtcaccggctcggtttatatagagataggtcgcttgatcagggcgcccgcacgatctccactccgctaaccgaactggattagtcgcgcgtaacttatccggactccacgaacaaaactaacaaaacaaatccgaatttcccgcagcaaaacaagactgcaaaggaggctgcttctgcgcaagggtgaggaactaattgttcgggccattcgacgcgtacatcgtgcacgcgcgccgcctgtacggcccgacgaggcgaggcgagcgnnnnnnnnnnnnnnnnnnnnnnnnnnnnnnnnnnnnnnnnngttcttcaatgtaatcaatgcccac

SEQ ID NO: 21551 - DNA, 10905 bp, Oryza sativa
  unsure (1)..(10905): unsure at all n locations
tatgggcnntttgatgttgtacatcnnnnnnnnnnnnnnnnnnnnnnnnnnnnnnnnnnnnnnnnntgagataggcttttgtgattttccaaagaattaatcttcgagtgggctaaggcccatctattaattccaacaaaggggatagcgctatatcgctaatctatccagcggtatcgctaatcctttaagtgcgcccaggactgtaactgtctcacgctccaaacaagcaagagctactcggtctcgcacccttaatacgcgagaccaccggccaaaacacacaacccagcatcgaggtggtggagcccgtgaaggaattggcctcgcgcggctatccgcgagagcgcctctctgacgcacgtcggggcccacctttggtctcgcacttccccaccatgaaaccgagtgcgatttcgcattctcccagcgcgagaccgaaatgttaattgcaaggctaagttgattatatttcgtgtgaagaccgtggagtacgtatatatattttctttcatgatttttagtagttatgtgtaatatatatatatatgagagaaagtagtaatttaattagtgagactagtcttatccacattaactgcgattgataaaatcattacttaatgaattatagttaaattaatattatggagtacttattatattattatgttggtaatcgcaataacatatcacggcaaataaacttttagtgtaattctcatggagtctgatgaggacacaactagcttggatataaccaagactaccttatatattaatcaaccaaaggtgcatatgttctacattagatttacttgttatatatttgaacaaacgttgctacacaaagagttttgtgtgttttcctttgcagaggtacttgctttggggaagaaaaagaaaccgagcgtaacgaatgcacgaatgattaaagaaattgattggagaccaaaccaaaaccttctccaagtctatttccatctcaccacgtcacttttggtccatagaagacaagagataaagttctatacgttttggatccggattcgggcctcctgacaagatcaacttaaaatggacctagccgctgatctagatggaatttcggggcctatgagtacttgttggaagtcttatggagtctactttaagatggttttggtcccacatcaaaattcctaccaagctgccgggaatctacaaaacaagccacatatctcatccagtccgaatccgatttgtgttttggccttgatagtgtcgtgggcttagcccaagggggtctgagcactacggcaaccctaggacgtccttaatcatacttaatcagtagtcgtcatcgcttagaggcgggttttgcttagattaatttgttaagaacagtttcgccactagatcagtttgtagaaccccaaattcgagtggttaatcattcatatgcaattgtgttgcaatctatcttattcttgcttgtgttcttcgattcgcacgtagggattatccttctcggccaggtcaaccgggtttcggcacggttgataaccagaggagacgtggtgctgcaattgcggggctcagtagcgtgttcgttcagaagccggatcgagttgtgtcgcgactccgcccaaatcgattgtttatcaatacctatcggaagatcgggagctaacatccctcatcagttggtatgagagcgcggttgcccgttaggtaatttatcttcccataaccagaaaattgccacacaaaaaaatattctttacctagacaatgtgacccgttgcattgttctattagattttcctttgttgaattctagattgcattgtcgtgttgagtgctggtttagttttagatttaattttaagttttgagtattgcatctgttcatcacttaggcctagggttcatcactcaagtcggtgtgagttgtacgtcagttttaggtccagtttttcatctcaacgattgttgctggtatcttgaaaaattgaatcctctcttcgtcgggtaaaaaaaggtaatgataatggtgctacaactactcaaggtatgtatatttatgatgtgccaactatgtctactacttatgctacattagagcaacccatagtggaaacaattgctgaaatacctttgtcacaaaataatttgcttgatgtttcttgtgataaagaagagttgtgcgatgctccacttatatccatgccacaactagtgaatggacatgttagttctatagtagagccaccatgtgttgagtttaaacatgttattaacattgctagcgagaatgaagaggttaaattattatcttctttaaatacatagggttatattctatttgatgatgtttgtcctatcaactgttcagagaagaaattatttgctagatttgaattgccatgcccttctgatgtgatttttcatattattggcaattatgatagtaaaggagaatataatgtgcatcgagtatatatttgttcgaagttcactatacctccttttcatgatgaaatgtattgtctagaggaccgtctgcgtataagtaattctctatctagttcctctagttgtttaaatgagttacatgttagtttgcaagaaggggagtgttgtggtttttcgactacaaagattttaggatccatccatatggccacaagaaatgttcctcaccggatgttgtgatagataaagataagttcaaaatgctccatgacaaggtgaaactgaggacggtttccaatcaagaaggggaggatgatgaggacacaactagctcggatataaccaagactaccttatgtactaatcaaccaaagatgcatatgttctacataatatttacttgttatatatttgaacaaatgttactacacaatgagttttgtgtgttttcgtttacagtggtacttgcttgggtgaaggaaaagagaccgagcgtaacgaatggatggatgattaaagaagttgattggggaccaaaccaagaccttctgcaagtctacttgcatatcaccacgtcacttttggtctataaaagacaagagataaagttctacacgttttggattcggattcgggcctcctgacagcatcaacttaaaacgggcctagccgctgatctagaagatattttggggcctatgagtacctgttggaaaacttatagagtctactttcatatggttttggtcccacgccaaaattcctaccgagctatcgggaatctgcaaaataagccacatatctcattcagtccgaatctaatttgtgctttgggccttgtaattgtgtcgtgctcttagcccaagggggtgtgttaacaaccaaatttgataattcaagtatcggagatgaagataaaaccgaagcggaatccgagatagagatcgttccggaagcagagcaagaatcggctaaagtccgaatcggctacggttaggatcgctagagttcgagtcagacaaggttagccgattgagccgattccgacaatatgactcgatacatgacatcaggttgggttatggtgcttcatatggattgccatgcacggattgagtcctagaaaggcaattgtatatattaattaggatattctatgtaatttccttagagataagtttggacaaaagtctgccgcaaagacttatggtatcttagagtttgttagagataatagtcgtgtccgatatggacatattttgtaatcttgggtataaatagaccccgaaccccatgtaatcaatctaacacacgttcaaatacaatgtcggcgcatcgccacacttttactttcgttttgtttcgacgagttcttgctttcgggttgagctgcatctgtttcgatcttcaactagaggtaaaacttgttttggcggcttgtgttctcgggattagtgcttccatctttatgatactctaatcttgtttatgtaattcgtcgagttatcatatatcttatataatctctggcaatattgttatttaaccctcaatccgctaaaatctatcgctagaaggcggccgatcaggttaaataccaatgttgacttagattatatagggtatccaccactctatgaaacacccaacggcttgattgtctagacattgtccttcttttcatacttaatgctgcatcagttaagtttgatctattaagtcgtgcttagaatctcaatctctagcctgctttttggttgctgattagggtaatatcggggtttcagccgatcttacctgatttagctttatgtttcatgtgcttaattgatatgcttgatctgccctttatgttaagatcttattacaataaagtatattaggcttctgtttggtatattttacttgctttaatatcttaatatagagtggtatcggagtattagccgatacatgctagatctatctgattggctatgctattagcgtctataatctcattgttaatatatatttcgatctaagtgatttatactgtctcggcatggcgaccgatctatcccaatcacttgatttgagtatatatcgacataaagattacatactgctaatatctacagccgatcgaatagatttagtgctctcttaattattaatgattgccaatcgattcaaatatgacatcagctcagagataaatgatatgtcatcggcgattagccgatcggctatcatttatggatttaaccactattttcctgtctttgtttcttgttgattgcaggatcaaatcaactggcatgctcacgaacctaaaggcaagattttcagacctaacatccctcatcagagtcccaacggtgtgctgcacagaaaattaacgtcgcgtgtagtgcaataatgataagttacaatatttatatattcatggagtcgcattagttggtacaacaatttggtaaatactaccatttttatgttctagcaaataggaaaatatcttacttattgtttttttataaaacaatggtctcatttagtcatgaacaataacttcgtgcacttgttttttaaggtctattaggagtacaatattttgcactatgtattgtgaggttttggagtgatgttttatttttttcggagttcctttaacattccatattaaataggacatcaatgcaagaaatattcctcaaatacgaaacatcatgcacaacatatagaatattgtacaaagacatcatgttcagtgctactcattgttgtggtcagtcggagtcctaaaactaccagcttgcattttctttgtctgtttccttgcacctgcggcatgtcgggagctaaaagagaaacacggttgggctcacggcgctcatggttaattctatgctggttgttgtcgttcccttctaaaccaccaacttcatcagtctgcaatgccgaaattcattagataccgaggacgaccctccacccaagctacacatcttgtcgtacgatgatgtctacggcctaaaccctgacattagttttgggtggtagcctacagaagcatagtagatatcaatcaaattgtcaaactagagcagagaacaataacataaactaaaatatacaaacctgttgacggtgcttgcatatacagaatttcattcggatgcaagagatattcaccaaatagccaatcaccttgtttcaacaaatccatataaccctgcactccaccactgaaagtcgtaccttgcattcatgttacatgtagtacaaagttattctcttaagttgcagttagagtcatgtatcgtagaaaagtaccgccaatatgtaatgattaacaatgacggttgtgagcgtaccagcataatccatgtattgtccttgccatgggttggtaccatttgttggtggatgcatgggagaaccacctgactaggccctgcaaatatcaggaagtaaatagttaaaaacattcgtatccatgcaaaattaaataattgaactgatagtagaaattcatccactaaaacataccggcctcattactcatgcgaggaatctccatgcttgtccctgtgaactggacacatcagaaagcatcaatagttgagaaaaataagaaaattgtgaaattacatggcagcggagacccagcgccgaatgacgcaaaccctcctttacctatagttgccctagaaatttgggtcatggtagggaccccgtggctagtccttgtaaatgcaattaattagcatgaagtgaaaggacatgtggacatattgaaaggaccttgatgtcgcctagaagggggtgaataggcaatgcggaagataaaactaaaaagggttggattgtctgataccaggttagagagtcctatggatcggattgtccaaactgagatcggattatttgacctacatagtaacaatcaaacaagtaacaacctaaaagctctagatccaattcacaagtaaggaggagagctcaactaacaacatgattggcgtggcacaaagcaatgcaacaagaaggtaaagagagtgaggatatcactaagatttacgtgatgatgtattttgcggagttcaaatccttgaggggattccaatctccgtcgagaagcttgcaaagagcccggtcttttttcaaccctatcctcgtgaggttgcacaaatccactcctcctttcactaagggtatctatttccttgcggaggtgagatccggccttcacaaacttctcttggccaaccacaagtagatcggtggcccaagaataacacctagctgtctaggagtcctcaacctccaagagtaataaacaccacacaacactttgacaaatcatagtgctcaagataaagaaaagtgcacactaggctcccaacctgcaaatccacactcacaaagatccaagtcacaaagaacaagggggatttgagatagagagggagagagctcaaaaatccaaagcacttagcacaaagctcaacccaaaacaagatttgaatgaaatgaatttgagcaactctagaaaactgttagtggggggtttataaagatccccccaaaatgtgaccattggaggggaatcttttagcccacgtcagatagtccgatactaaatcggatagtctgaaaatttaaatctccaaggcaatgagatacaaagaacgaatttccatgaaatatcggactttctgagacattggactatctgatgttaaatgggatagtctgatattttacaagcaaaaacttcatcctcaagtagagactcaggttccatgaaatttcgaggtctatgtttcatcagactatctgatccaacatcgaatactccaatacttagaaaaaaactcactcgagaggagttttcaaaacaagaaagagagtgaagttccatgaaaaatcggatagtctaatttcaaatcggtagtctgatgttgatgaagaaaaatgcaataacttttttactccgaagtccaattttgatgatcttggactttaaagaaacctagttagaggatatcaaatacaccataaaacatgagacaaaaccttcaagagatgttgaaaaacttgaaaagaaacacggtgtaagtgttgtgacatgtaaaacaactcgcagttggaatttgcttaggtttttcaactcacacaaagatgaattattttaaacactagtattcaaccaattatatgcatgtggtatccctcttaataatacagcatcctaaactcaaatgtaaaaaagcaaagttataccaataggaataccttcataccatacttggaaggttaccaacgtcaaggacatttgatcattgggaaaatctcatcttcttgatctttggcatttcatcttcaatttctcaaatgattgatgcggataatccatggcttcaaatggcctcgcacggtccatcacaacaaagtcttcactcgtccttcaccatcagtttcagttggtcggtgtcaagccccttgcttgctcttcaccaccgcatggtccatcgcagcagagcgtcacttgcgcttcaccgtcttgccataggtagtcacttcgtaccccctcatcttcaatctcttctctttaattctcatccatcgataagtccatcttctagcttcttcatcggactaatcacttgcttatacactcaataagcgcattagtcccttaattgtttgtcatcaattaaccaaaatccactaagggcatagatgctctttcacatatgcgtaacaatgttacccaatcgagccgaacacgtgaatgatgcaaatcctccttgctagtgtgaggttgcgacatctagagccttgggaggaaccacttgagacatgggacgaggcatctgaggcatgggatggaccattcgcgttccctctgtcatcaattcaaaaacatcatttagtcgtgcaacaattccaattgtcaaaaagtaagcatattgcacaaaaatgtcttacgtgcatacaacacaaactcaccctgccactgagaggtgatgggcattgagctttgcggggggtacctattcagggtgcgctacaaaacaatatattagtttataattgaatgacgcatattttatcattccataagaaggttttttacctagaactagggcaaacccacataggcgttccgagatttatgcgatcgttggaaaagtgggcacctcacgaaaagaaattgaccatcctgcatgagcagcaattgatgatcgtgtggaggctgaggggcgtgctgaggtggacagctgggaagaggtagacagccgctccggcattggctcgaacgtccttcttgtagacatctaacgaatgtcggcacgacgggaggcacatgattcacttacttttttcacgaagaaagtcgaccgtggccataacttcatggttagtacccacaatcccatctctaaacttctcccacaaagttttggcctcccttactaaatcccctgcaatttcggtatgcaaggaaggtagtaacaagtttagaaagtgtcttcgcatgaagaacgaaacaccgatgcaacaaaatctttcaatctgaagtagtacagtcaagtgagccagggttgctagctgcatctcatatatttggtcaaggttggctagtccgcgcttgtcgagatcctcgggtgaaaacagtcggatgcgagtcagcgatgagtactaggccatgtattttcgtaagtgttgtggtcgtatgccttgttctctgccttgttctcctgaacaacatcagcctgcgcttgcgattatgcctctatccatgggctcatccttgagtatatagaacgacaatacatgttgtcagcttgtctcttttgccttcggtgaaaatagcatcaataaaccattacttattgctcgtagaatttggagtaatgtacaaaatgaacttatgtgtgcacttctggtggaaccataagtccaatgggaactgggacatccagatctaactccagaacttctactagcctattaataactacattgaagtagcaggatgaggatgaatggaagatgtgatctgtgaaggctaaaatatggagctcctgcacccttctatttatagagggagataccttggactataatggccaaatgggccacccatcccggcccggcgtgagcatgaccaggcacgggcgcacggcccaagatcagccgagtcggcacggcccgaccaacacgccgagccatgttgtgcctacacattggctgcaccaacgaccgaggcatgacccaataagactcgggtcatgtcgagctgtcccaaaggcacgacaagcccaccatggtccttctcggaataagtctatttctcctccctagtctatttgggatatgtcctaggaattcactttgactcccttaactagtgactgaatctgattcgtatccctgaaccacaataccggatatctcgatcccccccaactattaaaaccggtgcaatttgactctctcgatggttttggaaagcatattagttgacgtggcgcttacgtagcggtattgacctgatctttgttccacgtggcgcttatgtaggattagaactaaaaaatatgtgtggtacccatttgtcattcacacagaaattatagtgggacctaatgacatgtggggaaaacatgtcatcctttctacttacattcttcctcccacctctctctcccttatctctttctcccccccttccccttttcttcggctggcaccggtaggcgggagcaatggcggcgggcagcgagcattattcccagagcactatcttggagccgttgtgaacgccgacgtggatccttgccgccacggaagtgttagatggatctccctccccttgagcccaacggctcaagggggccttgacccgcgccctgatcaagggcgcctagcccaatggctggtgggcccccgtcaccctgcgcaatataaagaggggtggaggctggggtggcacatgacacgaggtttgcgctgccaactccaccccataaaccctaatccgatcgagagggggcgcagccagtgacgggaatgcgccaccgccgcgccacgcctgatcgtcgaccacgactcccactgctacgaccaccgtcgccgtcaagcacatcgtcgccgccgtccttgtcaagcagagcgacgacaacgacgatggccaggacttcctcctcatccaacgcgtcaaccggtcacatccctaaacccttttcccttaatctctatttttttcaatcattcaacccaaatagaacaacccaactagatctaaacctaggtgatccaatagacaaccctaacaatggtatcatagcaatcctagcatttagattggttcgggaaagaaatccaaagatcaaaagaaagaacagcacacgatccgcacgggtcgaaagggagcgagtcgaataacaccct

SEQ ID NO: 21552 - DNA, 4124 bp, Oryza sativa
  unsure (1)..(4124): unsure at all n locations
tctctcgaactctcaggtgtttatgtgtgagccgcgctantnctatcacccgcatgtgtgtactgtgttaatttnnctttttatttttcagattnatttaaaaaatataaaaaaaaaaagaaggattggattgcaatacactggnaagaaaanaccctacctcgncgccggccgtcgccgacgccggcaaagaaagaatggggcggagatccccggaaaagagcaagaaagggggaatagagactcaccgccgccggcgtgcgcgggagtcaaccgccgtcggtcgccattacgccaacgcaggagagaaaagaaggggtggcaccgccccactgtgctcgccgggcgccgccgcacagcgctcgacggctgcgcgcgccggcgaaaggaggtgcgacggcgccagcgcgccgtgccgccgggccgtgcagccgccgtgccgccgtcgcaccatggctagggtttcggccgagagaagaaaagagtggctagggtttggccagcggttgggggctcgggttttgctctcccgatctccccgcttgcccgtctgatcgaaaccctagcgatcggacagccaacgtcggccggaccgcttttggcccaagagggggcgcgcgctaggcctctttcccggcccaggcccaggttgcggcctagagaggggtgagagcccgcatgtgcatataccagggccgccagagtccaattttggtccctcggggccgaaagaaaaaggaaaagagtctatttttagtccctgtttcagatgcatttacaattatagttattaaatgtgtttatttctaagcaatttgagccaacgtgaaaattgtttagagaatagataaatgtgagaaatgcttctgaacatgtattttgtatattttcatgcaaattacaatagaattttgaattgtttttgcatgatttacctccgtttaagatttgaaccgaagggttaatttttacagagtgaataacagaattttgtcattgtttatatgaattttatatagatcttttgctgcaaatagatgaaattgatgaaaattagtgtttctaaaattaaattttgaaccaacgggataatttcattttaggaacattaattatgtgctatgatgttgtaattttctaaccaacgttgataattgtaatgttatagttatggctctatgtgttatgtctattttctgcccaacggtgatgtagacttaatacataataattttaatattaattttgttctcacaatacatgattatctcaggtggctactccttgatgggttacattaaagatattccgaccctaaaaggatatactatgaagaatggaaaagagaactcgaccttgcttttatcttgggagaggtggactgggtgttgactaccccatgtcctatagaacctgcggaccttgtcagaggtgaaaaagagtcagatgctgaatggcaaaagagagagagggacaatgctcccctcatcatgtcgtatgacattgaacatgtgaaatggtccttagccaacaagaactgtttggctgcggtaaaggacacgattgagccaacaatattgggctcaatcccagagtatgacaccgtctctaagtacctcgaaagtataaagagccagtttactggttcttcaaagttttatgcgacacagctgataaagcagcttgtgacagagaggtaccatggaggtggtgtaaaagaccacattcttaggatgagcgacatggcttccaagttgaagccaatggatttgggcatctcagatgcctttttggtccatctggttatgacttcattgccaaagaattttgacaactttgttgtcaactacaaaataagtccagagaaatggaatcttgaagagctcatctctaattgtgtgcaagaggaggaaagaatcaaagagaccaatggtgcctccaataaccttgttaaagataacaaggaaaagagccactggtccccccccccccctcaaaagcaaaacagcctcagcatttgcctcagtaacaacagttcacagttaagacaagatcagtgtccccactataagaagacagggcattgcaagaaagttcgtcctgacttcctgatagtgatcatggcaaagaaaggtgagaacattattacatttgtaaatgaatctcattatgattggttattctagatccacatgatggattgattctggagcacctattcatgtgtggaattgtttaaagggattccgttcgattaggactacgcaaagaagcgaaagatccattagagttgccaatggagttgaagcaaaagttgaaactattacagatcttcgcctagagctcgcgaatggcttcacacttttacttaaagatgttttttatgtcccttctttgcaaagaaacttaataagtgtatccaaattggattttgatagatatgattgccattttggaaatggcaaatgtgaactatggtataataatgcatgtattagtcttgctgtgttgcaagatgagatttatttgttatctctttctgagaatgtgaatattgggtcctcgttgacaaaagaaaagaaagcgaactcccgatgtctcatagaaattatggcactgtcgtttaggccatatttcgagggggagaattgagagactgattaagaatgtaattctttctccattggagttcttagttttagaacaatgcatagaatgcatcggtgcctaaaacaccgtatgagctatggatcctccgtgtgggggggagtcttgcagaggctaaagtatttaacctaaatcttgggaagttggaccccagaacaataggctgccattttattggctatcctgaaagatcaaagggttatcatttctactgtccaaacagttatacaaagtttgtagaaacgagacacgtcgtcttcttggattagggggagctcggtagttcgagaaattgatcttgaggagaggcgggtgtctgtacctgctccgtcgactcaggaacctttcttctctctacctgctgatgttgtgcctccaatgcatgacgttgcggtaccaacacatgttgttatctctcctgtggcaacaatgaatgaaagtgaggaacctattctacaggattcaacagaaattattgccacactagaggaggagctgcaacagcctcaaacagataatgtgccagaacaggaggcccctagaaggtctgaaatagacagaagatcggctatccatgatgactatcatgttcataatatagaagagtcgcacatggaggatgatcccacctcatatgaagaggccatgagaagcgctcgctcatctgaatggttggaagccatgaaagatgaaataaaattaatgaaattaaacaatgtctgggatttagaagaaattcctaaagaagccaaaacagtaggctgtaaatgggtctataaaaccaaatatgactccagagggcatatggaaaagtttaaagcgcgacttgtggcaaaaggcttcacgcaaagagaagggattgattacaatgagacattttctctagtctcttgtaaagattccttaaggattacaatggcactagtggcacattatgatttagaattacatcagatggatgtaaaacggcatttctaaatggagatttggaggaaaagtatacatggcacaaccgaaaggtttcgtcatgaaaggaaacgaaaatatgggatgtcgtctaaagagatccatttatggattagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcgaatttcaaatnntcagtgccgg

SEQ ID NO: 21553 - DNA, 780 bp, Oryza sativa
  unsure (1)..(780): unsure at all n locations
nacccttattggcaatcaagaagcaggctagagattatggttctaaacacgacttagtagatcaaacttanctgatgcagcnctaagtatgaaaagaaacataatatctaggtaatcaagccgttgactgagttttcagggtggtagatgtctaagctaatctaatctagcaacgcgatttagccgataccggcagaaaccctaaaacgaggagcagccgatagagctaaattgatatgctaagactagattaacagagacatatgataaataggtaggcaaatatatcatccaaactagagcaatccaagaggttgaatgtactgatgcagccttgaacgacgacgacgtaaacgatacaattgcctgggccgacggaacattagacttacctcttagctggagatcgaacaccgatgcagccccgcgtcaggtgccaagtcccgccggacgataaaataaagtagaaaaggtaaaaggtggcgatgcgccgaattgtaatgatcgtgaagatagtttacaatgactctgagtgtacatatttatacccatgggtagatactagtccttgtaggacaagaaagaaactttcctaaagataaaaggaaaacataaagtccttataggacactaaacacactttcctaaagataaaaaggaatctaacaaactattcctaattaatagatacaactaacttcttcggactcgatcagtacgtggcaatcatcatgaagcacgtcaactcaatccgacaatgattacaatatcaccttgcca

SEQ ID NO: 21554 - DNA, 1108 bp, Oryza sativa
  unsure (1)..(1108): unsure at all n locations
ccgtgcattgtaaatcttatnnnnnnnnnnnnnnnnnnnnnnnnnnnnnnnnnnnnctttttttctccgtgaaagcgttttctttttttttccagtgattatctcgtcgcatacgatgtttttcacgaaattttttattgtattttataaattgaatctgtcagggttatggataccacatacctaatagtagttgactaaatctcggcaggacccaccgcataccatgtcttatacggaaacaaccttcgcatataggaggagttccgcataaggaaggatgactagagttctacatggaaacgacaaggactactcggattgtatccatattggttttcctagttctacttggacaaggggatacccatgggtataaatacaaaaccccctaggaggaaaggggacacaatcaacatacagggacaacatagacgccacaaagccataagccaatacaagccaacatacgccaagacaagacgccggatatcgacttcagggataagcacggctagtcccctacagtgtctccggatactgtcaggagagacgaaagcgctatctctgatctcgtcgggcacagattcgaggaggaagactaccctgttgtcgactacgagtcggaacttcagacctccatgtcgacaacaattagataggctaccccaaatattgtactggtgtgattatggtgaataaagtggaacttcggcttcggccaacaggatgtagggctattacctgacaattcaggggcccgaatgtcacaccccgaagttctcctcccaagcctaaaatttaatttataaatgaccctaagaaaataccagtgcaaagcaagagtaaacccttttaaatcaatgcagataataatcggaattgacatgtggaatttttcttgagttctacatgtcgaaattcactaacaggatttttagtggaattttcagagctctagaaataattttaaccaattaaaattgagcaagcaatattttaattccagggaaaatcctttttcctttttctttttctttttcctccttttttnnnnnnnnnnnnnnnnnnnnnnnnnnnnnnnnnnnnnnnnnnnattaagncgcag

SEQ ID NO: 21555 - DNA, 1644 bp, Oryza sativa
  unsure (1)..(1644): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaaccatcacctcgctatggaactgttcgagagggaggcaaaatcatggtggtgctagctggctttgtggcttcctgggatagagctgtcgatggagaaagtaaggggcattttgatttatagaaaaaatgtagaaattttggaggatttcaattctatgaaaaaaaaatcctacgaaggtctttgaaacaaaagattgtatcctatctaatcctttaaaatttttatggaatgggtaatcctatgtatattttggaggaaagttagcaagagatctaacctcttggaacattttctctgagtctatctctcttatcttattcctgcgtttttcctgtgatccaatcaaacggccattttctctgagtctatctctcttatcttattcctgcgtttttcctgtggtccaatcaaacggccattcctgtgttttttctgtattttgcaatcctctgttttataattgtattcatgtcagaatcctgtgttttttctattcctgtgttttttcattcatacgattcaaagggccctaaaagggaaaaggataaggcctttcacagtgcaagcgtggggaatagagagactgagaagattggaataaacgagagatttcttctgctttccttttttccacttcccgtcggctcagcttttatttttttttatgtattttttttcttccggtctgtttggcttccatttttccccaagtataaaaattaccctatatttattgatatttcacttcaaatgaaatttacaaataaaacacaatactacctaagaaaaaaaaggaaaagtttgaattacacccctgaacttttgggtgagtacgacttacctctctagacctaaaatccagacatcttttacccttaactatcaatactagatgaaaaaccaccacgggtagctttgtaagcggttttgatcctacgtggtagtctagtcaataattcttttattaaaaagtcgatagggcccacctttagatctctctcctcattatctatttcgctcctcattatctatttcgcccctcagacccctcttttttttgtcagatgccaaggaagaaacgcgtcaacggctgcgtgcgtcccccggcggagggccaaggcagtggccaaccacaattaagaagccggaattaccaaaccaagccaagtgcattgttttaattcaaccctgtccccaggtaagcgttaagccaaattgtgcctccaggggggcggttaaccacggcatccccccgattcccattagttaaacgtgcaggttggtggtcggccggcccccatcgccccccaaaaaatatgaagttaagggtacgagctagctaatcaanttttcaagcccacg

SEQ ID NO: 21556 - DNA, 3325 bp, Oryza sativa
  unsure (1)..(3325): unsure at all n locations
tgatgggcntttgangatgaacttcannnnnnnnnnnnnnnnnnnnnnnnnnnnnnnnnnnnnnnncagagcttcaagccttcaatccagttagcccacaactgatccgggcggcttttttttcttaaaaaaaaaaagggacccgggggcctcgtgacgacgtggcttctcccaccaccgtaactcccgccccctcgcagtctccttcccaacaactggtccatacaccaccaacccccatacccccgccgtttcacctaccacactcccggctttcctgcaccgggcgcacccaattcacacccacaaacgcacgcccgcacgcgcgcgcgcgcgctcagagacctccgtcgccgcccgccgcacgccggcgacccaccgcgccgcacgatgccgccgacctcagtgagcccaccaagaacagcgccggggccggcgaacccgagcccggcacacccgtcccgcgtgcgggtgatccacccgggcggcgggaagcccggtgggccggtggtgtactggatgctgcgggaccagcggctcgccgacaactgggcgctcctccacgccgccggcctcgccgccggctccgcgttcccgctcgccgtcgcgttcgcgctgttcccgaggcccttcctcctttccgcccgccgccgccagctcgggttcctcctccgcggcctccgccgcctcgccgacgacgccgccgcccgccacctacccttttttctcttcaccggtacgcgcccttttctttttctttttctttttctttttcttttgtctccatccgtgacgatgacatgtgggccaccccgtcttgcgaaatgtgacgtggctttttctctggctcgctgacaggtgggcccgcggagatcccggcgctggtgcggcgccttggtgcgtcgacgctggtcgccgacttctcgccgctgcggccggtgagggaggcgctcgacgcggtggtcggcgacctgcggcgggaggcgcccggcgtggccgtgcaccaggtgagcgtggtggcattgctgtttgcatcaatcttccaagaaagttgggaatctttttggggatggataatgaattcgccggagaatttagagattcttgtggaattcttcgaatgcaggtggacgcgcacaacgtggtgcctgtgtggacggcgtcggcgaagatggagtattcagccaagaccttcagaggcaaggtgagcaaggtgatggatgagtaccttgtggagttccctgaattgccggcggtggtgccatgggacagggagcagccggagggggtcgactgggacgcactcatcgccagggtttgcaggtgcggatgataattctaaggtgtattgggtggtaattttgtttgtgtagatatggatgactattgattcttggttgtttgagcagtgaggcggagaatgtgccggagattgactggtgtgagcctggagaggaagcagccatagaggcgcttctcggcagcaaggatggattcctgacgaagaggatcaagagctatgaaactgaccggaatgatcccacgaaaccacgggcattgtctgggctttcaccataccttcattttgggcacatttcggcacagcggtgtgcgctcgaggcaaagaaatgccgacatcttagtcccaaggtgctgttctttaactgatttgttatgattaaaagagttatgatcctcttgcaatgtaataaattgttagatggcattgtttttctttaccgtgaactggctagaattcttagtgatgttgtttacctaatagatgtttgaagtaacatgtgttctgaaacagtccgtcgatgctttcttggaggaattggttgtaaggagggaattagctgacaacttctgctattaccaacctcaatatgattcgctgtctggtgcatgggaatgggcaaggaagacactgatggatcatgctgctgataaaagagagcatatctatacgtgagtaagttgccctttataatttattgtcacaattttaaccaaattatcttcctgacgatgttaaggtaaaagatcttcgctctaattggttatttgttaattgtcattttgttttggctaggagggaacagcttgagaatgccaaaacacatgatcctgtaagtgctattggacgtggtgtactctgttgctgatattgaagttactctaacacactgagttattttttttctaaatgattatcagttgtggaatgcatcgcagttggagatggttcaccatggaaaaatgcatggattcatgaggtaatatatcatgaccagactcttacaaaatcacgcaattataaaatgtttattgaacagttttttttttatgaaactgcttgttatatttcttctgtacccatggcacattctagttagttgcccataacctattggcccacttgttgacaacatatggttattttacccatcatactgatggtgtggtgctaacctaaaggcattggattgcccccaccccatctttgctgacataactgattagtttgctttgttggatagatgggaattttctgacgttgtggtttactttatcctatgtcagaaaatatgaagttatttgaaaaaaagcattccttaaaaaattagttttctgtagagtttgtgtagttccaataaatttatgatgatctatgtgatatgtctggtagcaagcctttggtgcacataattctctttgattctgggcaaaccttttacactatttttgttcaacttttgttttggatctggaaagaaagaaaagtaagttgttttggcgaacatcaaagaatgatgttatatctaattgattcttagttctgaaggtaacagtgcctgtaaggactttttcctttcctaatgtagtagttgtctgtagaatgtactgggccaaaaagattctagaatggactagtggaccagaagaagcactttcaactgcaatttatttaaatgacaaggtaagacctatacacatgtttgggaaatacagttgtgttattttgaatttgtcctttttatagttttgctagttgtagttaaaatagctatatttcaacacatggaacatgataaagaaacatggaacatgataaagaaactgctcacatgaaaaattgtaattgaatagcaacttggaagagtctgcccatgcttaaattagttcctgcgccgataaccgaaaagttggagtcacatttatcaaattaagaaatatatannnnnnnnnnnnnnnnnnnnnnnnnnnnnnnnnnnnnnnnnnnnnnnnnnnnnnnnnnnncagtnannccaannngcccatc

SEQ ID NO: 21557 - DNA, 1095 bp, Oryza sativa
  unsure (1)..(1095): unsure at all n locations
gtcgtaaagaagtggtcctcgttaggtcgctaggtcatcattggtgagagtcgttaagtcgttaagtcgtcgttcgtaaaattcgttaagtcgttaagtcgctaagacgtcgttctcgctaagtcgttaagtcgctaagtcgtcgttcgctaaaacgttctcgttcaaacgttccaccatgaagtcgncggtgaagtcggcgcncgncgncgaaggncagttatgtcgncgncggtggtgcgnncgncggtgaaggtgnaggtgnagttggcgcncancggtgnaggtgaagtcagcgcncggcggcgncgncggcggtgaagtcgncggtgncggtgncgncggcggtgaaggtgaaggtgnacttggcgcacgccggcggcggtgaaggtgaagtcggcgcacggcggcggtggtgtcggcgcccggcgacaacgacggccggcggtggagtcagcgacgacgatggcggcgaggtccggtcggccgacgcgtgtcaagatcgatcgagagagagagaatgcgagatcggaggcgcaagatttgcgcccctcaccttgagggaggcaatgctgccgatggcgttggcaagggcggatgagcgcggtgagcatggcgacgacgacggcggaggcggcggcgatgtctggggcggtaatggcgcgagaggaagaagatcgatcgtggagaagtctaagtgtggcgcggggaagccgatgcagtggatatttatacccggtaatcttttgtcctggttcgtggcttcaaccgggactaaagatatctttagtcctggttggtagtaacaactgggagtaaagaacaaatgtttactcctaaagatggttgttactactaaagatgtgtacacaaaacccatttatggccttcttaaattgtctaacaagtcgaaataaataccaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21558 - DNA, 2348 bp, Oryza sativa
cgaaattaaaataccaataaatccaatattaattagcacatggccgttttatatggtttcaaagtccaaataaataccaaagtcgtacataatttacgtatgacggaattaaatgttttcaaatttttactaaatagaaataaacaggatatgcctaagtaaatggtctcaaagtataaataaatagaaataatcatttataattaacataaggccaatttaattatattcagagtgtaaataaatagaaattatcatttataattaagatatgacctacttaattgttttcaaagtggaaataaataccaataatcagttataaataacatattgcctaattaattgtattcaaagtgtaaataaatggaagtaaccatttataaatatcatatggttgaaaaatagtaatacattacaaattaatcagttgtgaataatatattgatccaaattgttcgaccttcaatacaatacaaataatttacatcttccatcaaccaacttaggtcactgttttactcacgtactttctcctcactattgttccttcgctatgatcgttgcgtgagtacggcgtgtcctcctttgatagtaagatgctcggagtcaaccgtcactgcaaacggaggttgcccctcaaacagattgtaattttcgtcagtcttatcctcgactccaacgattttcctcttgcctaggagaacaacatggcgttttggctcatcgggccctttccccttctttggtttgctatccatgtccttcacgtaaaaaacttgcgttacatcattggctagaacgaatggttcatctgagtatcctaccttgtttaggtcaaccgttgtcatcccgctgtcatcaatcgttacgcctccaccagtcagcctaacccattggcaccgaaacagagggacctttaggggtctatactctaattcccaaatgttgtcgatgacaccgtaatacgtgctagttggaccatcgtgtcctatggcatcgatacgaacaccactgttctggtttgtgctctttctgtcttgggctcttgtgtaaaaagtgtatccattgatttcataaccttggaatgtagttaccgagccggagggtcccctagccaagaaggctagttgtcggtcaatcgtctcgttacccaggaggtgttctcgcagccaagcggggaaagtatcaatatgatggcgtgtaatccaggtatcggacttgccactgttttctgagcgaacaatcgcaaggtgcttatcgatgtaaggagcaaccaacgaagattgttgcaaaaccgtgaaatgtgctttacggaataaatcgttgtctacagtcataattgctctccttccaagtgtgccctttccccgtagtctcccctcatggattgattcgggtacctcgattggctcgaggtctttaataaaatctacgcagaactcaatgacctcctctgttccataccccttcgtgatgcttgcttccggacgagaacggttacgaacgtacttctttagaacgcccatgtacctctcgaaaggaaacatgttgtgtaggtacacaggaccgagaataccgatctcttttacaaggtggcacagaagatgcgtcattatattgaagaatgacggtggaaagatcaactcaaagctgacaaggcattgcaccacgtcatgctgaagggcggctaaactttctggatcgatgactttctgtgaaattgcgttcatgaaagaacaaagcttcgttattgttgcctgcacattatcaggaaggataccacgaattataacaggaagcagctgtgtcataagcacgtgacagtcatgagactttaggtttgtgaacttcttatccttcgtgcttattattctctttacattcgaggagtatccggacggtaccttgatgctctctaggcattgaaacatactctccttctcttccttgcttagggtgtagctcgccggacttaagtaatggcttcctttctcgttcggttccggatgaaggccctcgcgttgttccatatgcttgagatcattgcgtgcttcgagtgtatctttggacttgccatatacacctaagaagcccagcaggtttacgcaaaggttcttagtgaggtgcatcacgtcgattgcgtggcgaacgtccaagacctcccaatagggtagctcccaaaaaatagagtttttcttccacatcgccgcgtgaccatcttcgctttctataggttggctgccaggcccctttccaaatactactttcagatccttcaccatttcgaacactgctttcccgttgcgatgtttagggggtacgagtgaatatcaattcaatgcgcg

SEQ ID NO: 21559 - DNA, 8293 bp, Oryza sativa
tttcgtgcatccttgccgaagtctttaaatgttctgtcgatatttcgccactgcgacccgtcagcggggtgtctcagcatctcatcctgtttacgttcttctgcgtgccaccgcatcattctagcatgtgatttgttcctgaaaaaccgcttcagccttggtattatagggaaataccacatcaccttagcaggaattctcttcttcaaaggctgtccgtcaacttcacctggatcatctcgtcttatcttgtatcgtagtgctttgcaaacagggcatgcttccaggttttcgtactcaccgcgatacaggatacagtcgttcggacacgcgtaaatcttctgtacttccagacctagagggcagactgtcttcttagcttcgtacgtactttcgggcaattcgttcccctccggaagaatgttctttacgagtttcaataactcgccgaatgccttgtcactcacaccatttttagccttccattgcaagaattctaggatggtactcaactttttgtagcccttctcgcaacctgggtacaacgctgttctgtggtccgctaacatgcgctccagtttctgcacctccttttcactttcgcagtcctcctgtaagtcccgcaatattcgaccaagttcatcagcaccatcattcccttcaacatccagctccgcctcgcccattgtgttttcttcaaatccgccatactgagccgagtccggaatgttctcatcttctacttcatcttcttccattgcaaccccaacctctccgtgcgaggtccaacatttgtagctacgcatgaacccccattgaaacaggtgggcatgaatagtttgtgtggtggaatacttcttctggtttttgtacttatcgcatggacagcttataaaaccgttacgcttgttatcattggccacacccaaaaaataatgcacgccgtcaataaactctttcgaccaccgatccgcgtatatccattgccgattcatctatatgaaatacatataaatcgtaattatacaaaatccaagatttacaaggtaattacataataatacaataattgaatataattattcatacaattaatcattactattaaattcattgtacatatttttcatgttttaattacattataaacaaatatttaatatgtttttcttattttaatattaaattagcttagttttataatttcatacaaaattatatttaattattcaaacaagtatttataatcttctttattccctacacacactttctctctcatcatcttccatcacattttctagagggaaaaatatgtaaaaaaatagctccaaatgtagatgctaagcaaaacaaagaataggatgaagttactaaccttttgaagacctcaaatttgtatattaccacaaaaaaaatttgcttaaaattttgacggtacctccctccctcaaagcttaattttgaagcaatggctcgggctggaggaggaagaaggagtatataaagctgtgcaactttagtcccagttggtaacaccaaccgggcataaagatctcaaatcacattagtcccggtttgtattaccaaccgggactaaagatataatctttagtcccggttggtaacacgaacagggactaaagatcccaagccccccgacagaggtctgacatgccctgtcaggaggcgaaccgggactaaagatccctttgtcccgttgaagtaataaaccgggactaataagccactttagtcccggttcgttttggaaccgggactattgtggaaatcggctgaccctccaaagacttcttctctagtagtgaggcactccgcaattccgcatggcggcgttgatggacacgaaccggtgggggaaatagcattattagggatttgatggaccgttggtcatgaagggttgacagatcggttggctgattgattgttcttcggttctcatcggtattttcggtttaacaaagatccaaaccgagctgtgtaacgagtaccgaaatgcgtgaaaataaaaaccattcgcaccaccgaacacctgaacaaaccgctactttatatctcggttcggttcggtcttattgatgcacaagatcgacaatgacaattactcactgaaattgacttcagctatttcttgtgccctcaccaaatatattgtcaagtggatggatttaccattgtacgatttcctctgagatagaaatatccaaatcggtaattatctacatactatcaactattttaaatacatataaaagatataacatcaatgatcacgatcacacagataaacaatgccttaagaaatacggaaaaggtaaaactagccagaagaacaatgagcagagaaaacgtttcatagaaagaaaatcaagctgaacacttgtcccaagtggtgcaactgtaaacattggttgcgtgggtagattaactcaagatatgccattattttgtgttggtttccggagttcaaaaagattgaaaagtcaaacccgaaaatatgttttgttcacttctgaacacaacatattatcacagaagaggacaagaacatgattgaaaccaattgcctccgcctcgcctactaactagacctgacgtggctgactacaagggatggacaggactgtcatcacctaccacctatcgtcccctgttgatctagataccttcctagattacataggaattaggaaccgcaccgatggtcgatcttactactctaacttagttgatcgaagcagagcaaccacactagaagcctacgagttagaaatatattcattaaaactgcccgataaagataatatctaaaagataaatacttgaagtaaagtaaaatgtatattaaatggattcggcatttggctattgcgaccatgatattattgatgacgttgttcagcaccgagatcttgcagtacgtgaagccttgcggcacctcgagctgtgacatggacaccgccgactagcttgtgaaccaccggcgtcataagccgtacgtggagccgatgacgcccatctttgtgctgaaaagctccatcacacactggtggtaagcaaccttggccggccggatgtactgcctctactagaaaaaccatttttttgcagacgttaggtttttttttttcagacgggtatcacccttggagacaaatggctgcctacaaaaatgacatctgtgggggtgagattgttgtccgcctgcgaaaatacctctttttgacgatattaaaaacgccgctacccatcaccaaaatctctaagtcctctcctctcggcaccaaacgcctctccctctccgcctctctctctctctctccgtttctcccacctctcctctcccgggagctgtggcggtgacggcgcggagggcggtggcggcgcggaggtggcggttactagcgggaggcggagggtgtatggacagcggcgtctcccctccctcctccaagatccggtggaggcgccagagcggagggcaatggcggtggcggcgcggatgttgtagctaccggtgggaggcggagggtgcatgggcgacggcgtctcccctccatcctcccagatccggtggaggaggaggcgaagggaggtggcggcagcggctaccggtggtgatgacgaggagggtagaggcggcggcgtcggcggcagccctcccctctggatctggcgtggcgacagtgaccctcccctccgaatctagccggtggcggcgacctcccctccggcgacgactgtgatgctatgtatttgttttgattatgaactattttgtttctatgttaatttgtgatgtttatgtgaatttggtttgactggatttgatgggaaataggaaccgaattggatggggaatgggaactggatttggaaacatgaagctgcagccggccgaaacggcgtggctgccatttttttaacgctagaaactctttttgcaggcggaccaatcactatttttacaggcgttgcgttgcacgtggaccagttgtccgcctgtgaaaactgtttagcccgcgtgaaaaaatactttttctagtagtgtgctgtattagctagctgcgatgtcatatacaccgagatcgactacacacttcatcaccatcgacaaggcatagcccagtgcatgcatggtcatggaacttgctgtcgttgcagctagaaaatccccaaccaaacttgctaatctccaggagctgcattccttacagatgcgtgagccccactacctcaggactggaagtttatgccatttaattatgagagcctgacgatcacttatcaatatcctattctgcttttattctccgaagatccgaaacatgccagtcttaacacgtcgcagtcatatgttgatatgcattatatattcggaactttaattcacgtggccactcagtcgattgtgagatcaggggtgattgtgcagagaactaagttaattaactatctcaatgatctctattaacagctagagagtctcaagctaaatatgaaaaaaggtatgatgtaagattggatcgattgatatcgaattatatattacgatatgtcatctctccacagcacgagttgatgcatatttattgggtcgttgattctcctgaaactcatttgatagtgaagatcatgttcaatgcatgagtgcggtgattgttcagaaaaaaataatttaacaaccacaagactatatatgtttggacaaaataggacgaaaatatttcgattttaagttccccagggaacatgtgatgattttttgagaatttctccaagtcattaaataatgcagacagagttggggctagctagagccagatagtcgatgtaatagtataaatccacatagccagcaccaagagtttccatccatagacgcatcacataatcatctctctctggcaactaatttcacaagcacacattcttccatttccatcgaccatgcctggagcagctaccaccgccgttgttgacagccgccggggcacacagcacgcggaaggccccgccaccatcctcgccatcggtactgcaaacccgacaaacattgtgcctcaggatgagtttactgattactacttcggtgtaaccaagagcgagcaccttaccgagctcaaggacaagatgaagaggatatgtaagcagatcgatcaatctacttattatcactatcattaattagttttcattaacttcaatgaaaaaaaaatatgaaggcccttacatttcaaggactaccatgcaatggtttgtccgaaactgcacatatatgtccaaagaaagtagacagtatatatgtatccttctatatagagaggttatatccaccgtctcgaaatcacaaatgaacagcgttatatcatatattttagtttttaattttttttataataaatgtccaatgatatgttttaccgttgtacctcaggaatattaattactaactaatagagatcttccttattcattccaggtctgaaatcgggcatagagaagcgctacatccatcttgatgaagagatcatctgtgcccacccaaacataatcgataaacagcagccctcccttgaaactcgcgtagaaatagccgccaccgaggtccccaagctcgctgagtctgccgcgaggaaggccattgccgagtggggccgtccagccactgacatcacccacctcatcttcagcacctactctggttgtcgtgcccccagcgccgacctctagcttgcatcgttgctcggccttcgccattctgtctcccgcacaatccttagcctccacggctgctccggaggaggcagggcgctccagctcgccaaggagattgctgagaacaaccatggtgcgcgtgtccttgtagctctctccgagctaaccctggtatgtttttccacccctaatgaaagcaaaattgttggccatggactatttggagatggcgctggcgctatcattgtcggtgcgggctccttggccgatggtgagcgcccgctattcaagatggtagctgcctcgcagaccacaataccaggaaccgggcacgcacttggcatgcaggccactgatagcggcatagatttccacctgtccatccaggtgccgacattgatcaaggataacatccaacagactttgctcgatacctttcgatcggtcggaaataacaatcctaactggaacgacctcttctgggcagtgcaccccggcggccgcgcaatcctcgacaacatagagggtaagctccagctgcaaccatggaagcttgcggcaagccgtcaagtgttgcacgattacgggaacatgagtggtgcgacaatcgcgttcgtgcttgatgaactacgccgccgtcgggagaaagaagaacacgagctacaacagcatgaatggggagtgatgctagcgtttggaccagggatcacgattgaggcaattgtcatgcgtaacccccagctaagtggtcttaaagaaaactaattaccactatcaagaaaataatgcaaagggaatcatctgatgttccggaatttcacgccatgatgtttatttaacgggtgacattgaatcagttgttcacgcttaagtgttgtcaactctactagatgttgtaaataaaattttatcatgttcatgtctcctcttattcttaaactttcatgatttgtaacgaaatttggaataccctgtcacctgtcatctgtatgtataattaaattattacctctgtcaatgtcctgtaataaaactatggttaagtggatcttatcattgcaaatataccatattagaaaaatgttaccgttattcgagatattggctatgtcccattggaatttggagaaattaaaaccatgccactcccatccaatttagtcaacctccgtctaaccccaccgaaaagcgtcgtcacccgcattgagtggagttggatccattgtcgttggctccaggataagttcgccgtccccgagtcccgttgaccacgcagaggccaaccagtgagctctaggaaggtcagtcgcggcgatcggttggttggaggcatagttattaagaccggaccggaccggcggtcggactggaaaaaaccggaaccagagcctccaccggtccggtccaggtaaaagaccggcttacaatcaacccggttagaccgcccggttttaggtaaaaacagctattaaaccggcatgtggctgctgtacacgcgagcaagggtgtgttggaaatttggtcataattcagcatattttaatccaaaataacaagataataaacatgatatttacaatgggatttgatccagtgatagtggtgaatgtaatcaacatgagcatgcttaatgtagaataagcatcaacaatcacataataacacaatattgacattgcgatgaacattaacagtaaaacttctaattgaaataatgtaagaaggttataccccaagaatggtcctccgttggagtttgaggcagtgttgcctccgttggtattaacgggagcctccttctccttgtctccagtgttcgacatgttggtgaaggtgaagtagatgttgacgaacagtgagtagtcgtgtcgtgcgctccccaaaaacctgatcgcccgctcgtccatgcaaacgttgcagcagcgcgtggtttcagaggcctactctcccaacgcgtgtgcacacactcgtcgggataggattaccgtagcagcaacaatgcatccttcactacacaaccatcaaccaattaggaataattgatataagatttaaataatttaaatggatcaattacccaattaaatctaacagggtgttggtgggggaaaattcgcaaaaatatggctgtggctgctgtacacgcgagcaaggtgttggtgggggaaaattcgcgaaaatatggcttcggtgggctttgaacccaggaccatatgggagttagtaaactctccaaccactaggctacctagttccttgtgtttgcaattaataattaatatatttaaacggttattgaaccggattagaccaccgattcaatcggttgaaccagtgaatcatcgaaccgagagcctcaccggttcgattactagtccggtctcaataactatggttggaggggcagcacggtgggtgatgatctggatctcttccaccgccgccgcagccatagacaacgccagcagccctcctcgctagatctgggccagaccctttgtcttacacagctgtggaccaagaccgggtaccgagctcgaatatcaaacat

SEQ ID NO: 21560 - DNA, 2111 bp, Oryza sativa
  unsure (1)..(2111): unsure at all n locations
tgtgtgnnntttgtatannnnnnnnnnnnnnnnnnnnnnnnnnnnnnnnnnnnnnnnnnnnnnnnatatataaagctcaactagtcaagttataatatcccaaggtatcaaggaataaagtaatcaagaacaaaagggctataacaaacaataggttaactccacccaatgacattcgaaaataaatgcaaggccaatggtgaggaccatgattatgctcaaggaggaacggacatctagcatactcgggatgccatgtgataatgttggactagagcttaggtacttgagattcaacttcggtcaacactggaatcaagactatacttagggaggaggtgaggtcgagacagtcaaagataccgggtgatgaatttggaaacaaagtcacaaacggttggtgacgaaataactttgtaattgtcagtatatttcatcaacatacaaatgaactaggatttctactcctactttgagtaggaggtattgggtataaatagatgaaggattgaggctcgaaataatatagccgtaggtgactcttagagataaaagttagggtttgttttgaggctacaattctagttcatgagttgagagatgagtgctttggttgcattttgtaaacacaatttgatgcaataaagttaatctatcttcaatagtatcttcaatttgtgttttttttggatacgatagtttgaccgcagttcattgggcgattagactggcgggcaggttgactggcgacaaagagttctgaccgacttactccataaggattgaaggttctttttgttttgcaaaaaaaaaaattatgcttttgatgttcctatcattcacctcccatctggtttcttgtattcgatcctacgctgccctcggccccaaggtcaccaatggccacctctctgcctccctcgagatccggccacctcctcctccaccctccactccaatgtcatcatcgaccacctctttgccatccacgagctccaggccaccagatccggtctgcaggtggttggggaccacaggttctgaatgccttgagctctctacctctaccataaggtcatcgttgtcatcaccggaccaagcctatcgttcaaaactctatgaagactactgcaatggcagcgaccacagccaccaccatctccaacagctcatcaagaacctagcagacattctccctcagctcgtctatcgaccacgccaccatcgtctcttacaccaactacaacaagcacatcatcaggaattttgagccgtgattgtgatcattgagatccaccgatttttttccatagattttttgtctttagagattattgtgtgttagaataggtgttgaatatactagtccgtggttacagttgaacttggagtggtaatagctggtagggggtggagttagagtcggactctataacctggcaactctcttaaatagaggggacaccacaatgtatttttggggactagaatgcagcgtacacacgtagggagataatgggggccaggtctgggacccgttgtggctaggagctctattgtttggggaggagcgcccataactagagtctcggagatgtaggcttcggctttgaacttcgctaacaaatattgtgtgttactatattgtcatctagtgtgtcttgggtgatcgactactgaagcgatcaataaagttagttcacgttccactatattgacaaacttttataacaagtggtatcaaagccgtatgtttcagaattggattcagaagacatgtcgaggaggaaaaatgaggtgagatcgcacatcgacagaatatcgccaatcgtggcgaaaggatcgatggcgacaacgaggactttgcggaggcgatgacctcactcacgatcagactggcgatgtcggcacgtgacccgaagacgatgccggacgtggccaaatgcgaccaaagagatcggagggtgacgctattgacagcgctgaccattcatgcaatgattgtggatctattgtggtccggaggctgttgcttaagtgccaaacctgcgagtatggtgagtgaacaagaaggatttcactgccgagtgttaggggacccattggatgtg

SEQ ID NO: 21561 - DNA, 2766 bp, Oryza sativa
  unsure (1)..(2766): unsure at all n locations
cctacagatctatattttgcaagcgtgaagggtgagtagattggtggcaacagactggtcaggtcaaatatagaattatctggtagaaacatgatatatctagaactcggtgatgaggagttgagatatatggagttggaccagaaatgaagaggaagagcaagcattatggtggtaattttttcgagtgattagaggcaacggtgaacttctaaagttatcatcgagctcggtctaaggatgtggaaagcgtggatgttagatttgttagctcatttcataagactacaaggaagaaagggttgttcatcggtatggcgagtttgatttgtctatttggtaatgacacgagttgtctagccatgagttagataaaaccaaatttaagacataagatgaaggtgaacatggtctttaaggagtttagtatgtggcaactagagaggtgtccaatttcgcatggcaagatgactgcgatgataagagataaggttgaacaatgttgcaggaggagtccagtgaaagatgttatagggatagcggagtctcttgatagtggcgggtctagcgcagacttgtcgggcggcttgcagtgaagctgtaaagaagataacccttgtctggaggaccggtggatcagcatggtgattctactacttttgcttggcatatatttttcaaggtggagtttgttagaatatgtgtcgaatatactagtactatttgattacagttagacttggagttgtaataagtggtaggaggtggagttagagttggactctgtaactcggaaactctcgtaaatagaggcgagcactacaatgtaatcaatgcgactatgatgtagtgtagacacgcaggaagatgatattggttagggaggagcacccataatcagagcctcggagatgtaggcttcggctgaagttagttaataattatcgtgtgttgctatattgtcatctgacgtgtcttggctgatcaatgactgaagtaatcgataaggttagtcgttgttcctctatatcgaccaaacttttataacattgtgagtgatgagtccatgtagtttgaatgtgtgattgagatccattgtattttggttattttttgtctttatattttcttctgagttctgaatgaggtggcaactaggaagagtaaacattttttttatttcaccagtgatgggtggtgttgagtgcacccgtttcccattatccagacttacaacgggcatcaaaccaaccaatcgcaggtgactcacatgtgatggatggtaataacactcttcatacgtgccaacctcatcaatgaccgatctttttctactgcccatcagagatagtgttccatcatagatgaggctgagttatcactgaccattcatctatgacgagaggggtctacccgtcacaaacgactttatcgagcgtagtagtttgcgccattggccatcatcaacgttgaccatcgaactcgacccaccaatggcgcaaacctcaactgtggggcgtagcccagcgcatggtcatcgaacttggcaaggacagcgagcaaagtcctgcaggactcactttggccaacggtgtttcctttgccttgcctaccatggcttttacagaggatacggtgtgattagaagcttaattaattaggaaaactagagacgtcgctcatgcccattcccaggcaaacttgccaatataatctccacgacctgcattcttagagatgcgtgagccccactacctcaggagtgggaagtttatgactgcatgtcattgatcgatatcctccgaagatccaaaacataccagtcttaacacgtctcactcatatgttgctatgtactacggagtattatttattcggaactttattctcgtggccactcagtcgattatcagatcaaggtaattgtgcaaaaaaactaaattaattatctcaatgatctacattaacagctagatggtctcaagctaaatataaaaaaagaatactgccggattggatcgattaatatcgagttatatattatgctatgtaatctccacagcacgagacttgatccatatttaccaagttgtttgattcttctgaaactcatgtgattgtgaagtttaagttcaatggagtgcggtgtttgtgcagataaataaattcaacaacaccaagactaagttttaacaacatatatagaaacaatatatttcggttttaagtaccccatggaagagttggggctagctagtgccagatagttgatgcactagtataaatccagaggcagcaacacgagttaatttccatccatccatagacgcatcacataatcatctatctctccctcagggcaactaatttcacaagcacacgttcttccatttccattgaccatgcctggagcagctaccaccgccgttgttggcagccgccgtggcacacagcacgcggaaggcccggccactatcatcgccatcggcactgcaaacccagctaacattgtgccccaggatgagtttgccgactactactttggtctaaccaagagcgagcaccttaccgagcttaaagacaagatgaagaggatatgtaagcagattgatcaatctacttattatcactattatttaatttttattcattaactctagtgagaaacaatgcanattatgcaagcccttacatttncagtactatcatgcaatggttttgtctaaaccacatatatattattctatctccaaagaaagctaagtg

SEQ ID NO: 21562 - DNA, 722 bp, Oryza sativa
  unsure (1)..(722): unsure at all n locations
ataaggtgnacactgatgacacaagcagcatcgacttcctcaagttcttgagccaaataacgcgctagataattatgtgcaggcaaaggactaccaggagggccagagagagatgttccatgtcttcgacaaggactagaaaacaacttcatctttgccaccgagcctcgccacgttatgtccaatgcatcaagaaaggctcactgataaaaagggcgtccgaatgatccgcgaggctgatggtgacaggcggatcactacaaggagtttgtacttaaattcagaaaaaaataaaagaagcaatttgattaaaacacatacaaaaattataaaatcattaaaactataaaaagaaccaagattccatgtagaatataaaatatcaagagtccatataaaagtataagttataaatatatggaatttggaataataaaagaagtattaaaagaagaggggcggcggggagatctccgcctccgcggcggcagcgggaggcatcgccggagctagggtttgcttaggtttttgctgttctgattcgcaaattcgcaaagggtagaaaactgaattccaatctttcagtatccaagcgcctgttaaatttgatgctaaaaaaaacctggtaaggatttcttatatagttaacaaaatttggcagcaaattaaatgtnnnnnnnnnnnnnnnnnnnnnnnnnnnnnnnnnnnnataggtctcatat

SEQ ID NO: 21563 - DNA, 1437 bp, Oryza sativa
  unsure (1)..(1437): unsure at all n locations
cgcgccttgaaattccactctgtacccccctgcccagagcaactctaccgcaccagcgccaaccatgttactgctgcagaagctcaaggtgctccagatgtgattttgggtacgttccttgttaactcagttcctgcaacagtgcttttcgattctggtgctacacattcatttttatctatgagttttgcgggaaatcataggatggaagtagaagatcttagacgtcctttgatggttagtaccccaagtaatcaagcactctctttgcaacgtagcccctctatcagaatagaaattcaagaagtaccatttctggccaatcttaccctgttagaatccaaagatcttgatgtcatcctagggatggactggttagccagatataaaggtgtgatagactgtgccaacagaaaagtaactctcaccagcaatgatggtcgagttgtaactgttcatgcattgtcttctgagtctttaaggtcaagtctgaaccaaatgactttggaagagattcctatagtccgggagtatcccgatgtgttcccagacgatttacctggtatgccgcctaaaagggatatagagttcagaatagatttggtaccaggaacaactccgatccataagagaccttatagaatggcggccaatgaattagcagaagtcaagagacaagtagatgatttgcttcagaaaggatacatcagaccaagttcatctccatggggagctccagttatttttgtggaaaagaaagatcatacccagaggatgtgtgtggactatcgtgcactaaataatgtgactatcaagaataagtacctgctgcccagaattgatgatttgtttgatcagcttaaaggtgccactgttttctccaagatagatcttcgatcagggtatcaccagttgagaatcaaagaggaagatatacctaagacagcttttaccactaggtatgggttgtttaaatgtactgttatgtcttttggacttaccaatgcccccgctttcttcatgaacttgatgaataaggtgtttacggaataccaagacaagttcgtggtggtctttattaatgacattcgtatctactcccgaaccaaagaagagcatgaagaacatcttcgccttgcactagagaagctacgagaacatcaactgtatgccaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcctaggcctcgcaggatattatcggaggtttatagagaatttttccaagattnnnnnnnnnnnnnnnnnnnnnnnnnnnnnnnnnnnnnnnnngttataccatntgcattcaatccag

SEQ ID NO: 21564 - DNA, 1863 bp, Oryza sativa
  unsure (1)..(1863): unsure at all n locations
acactatttttgttcaacttntgttttggatctgaaaagaaagaaaagtaagttgttttggcgacatcaaaagaatgatgttatatctanttgattcttagttctgaaggtacaagtgcctgtaaggactttttcctttactaatgtagtagttgtctgtagaatgtactgggccaaaaagattctagaatggactagtggaccagaagaagcactttcaactgcaatttatttaaatgacaaggtaagacctatacacatgtttgggaaatacagttgtgttattttgaatttgtcctttttatagttttgctagttgtagttaaaatagctatatttcaacacatggaacatgataaagaaacatggaacatgataaagaaactgctcacatgaaaaattgtaattgaatagcaacttggaagagtctgcccatgcttaaattagttcctgcgccgataaccgaaaagttggagtcacatttatcaaattaagaaatatataatttgacattcttttcatgtaaggcagaaaattgtatggttggtgctcttttcattatcttatcttcccttaagttaaaaacatcatccttctagggacaaccagacaataaatcagcttcacggtcgcctcggataagctggactatcctttttcttggttacctgtcagaagaaagatacaaaacagtaactggggaaataaattttcaggaatgtgaaattgctcgaagatattttcatagttgaacctacaattctttccccagctggattgttctcgttctttaataggagtagttgtttgcattgaagtacttctacgcattttatttatgctttacaaaaagtctaacagcacagatcttgtgtcagtatgagatagatggcagggaccccagtggttacgtgggatgtatgtggtccatatgtggcctccatgatcaggtcattgtgttatcacttctcacttcacagggaaaaacaattttgcttttcacaagcattagattgttggtgacattctagaagcgagtattccttacaccactgctgttttctcagggttggaaggagcgtccagtatttggaaagatacgttacatgaattacgctggctgcaagagaaaattcgatgttgacgcttacatttcttatgtcaagagattagctggtcaatccaagaagaggaacgctgaggagtctccaaatcctgtagtcaagctttccaagtctcagcactaaatccgactaggaaaatatgaacatttctttgtgtggtataccacgagctcggaaaattgaagaacagtgctaacttgaggtagatcatgtagggtatacactgtagatctgtttgtctgatatccttgtaggcttctaatcattcaaaatttgctagcattgttaagactttaagacatacagtgtcacaccagttgaattcaagtgtacacattgatctaacactgaactaaagtactgcttactgcctaacaaacagtacttggcaaacgatgcctactgtgtaatgagaaagataaaagaaaatgtcttgcaggtagtgacgtttttttttaagtaaatttcacaaaactatatgtattttgtacaatttatcataaaactaaagatttaagagctttcacaaaactacagatttagtgtctccgtttattataaaattataggtactttgtacaatctatctcaaaactatagatttaagaatttatttcacaaaactatagatttcgtgtatttgtttatcacaaaactacacattcagtgtcttcatnnnnnnnnnnnnnnnnnnnnnnnnnnnnnnnnnnnnnnaggatnaagcaattcaatggacccg

SEQ ID NO: 21565 - DNA, 1810 bp, Oryza sativa
  unsure (1)..(1810): unsure at all n locations
atgctgcntttgaacaaggatcacanttagacaattgttatgcgcaaccattggcacgtgttcttaagcaaatttagttacactgttcatgaaaataatgcattcggattcatctgatgcttcgatatttcactacactatggaaattaattaatgggtgacactgaatcaattgtttatgcatgcttaagtattctcaactctactacatgttgtaaataaacttttatcacttccatgtgtcctctgattcataagctttattgatttgtaacaaaatttggaataccctgtgtcatgtgtatgtataattaaaatactacctctgccaatgccctggtaataaaaagaacaataattacaacacaggttacaacatcggaatttataaaatatttatgctgaagtttgtacccatgattgcctaatgggtttgtcttcctcctttatcattcgagaacttttacggtgtttgcattccaaaagggtaaagatccaacagttctcaatcacaggtactatgtaaaggtatttaaatattagtatagatacttaggtactaaggataaaaatataattttgttaatagagaaaaagggtaaaattgtccctccccccaaattataataggtaccacgtaggtacgactgtacgagttaacatctacctggtaccacatgttcttatttgcgtctcttttgtgtgatttcctgtagatttacgttgtgtttgagttaggtcatttacctggcactagtgtaacatgttcttaattcattttctctagatttacttttttgtattctttgatgttctcttttgcgtgatttttttagatttacatattgtgttcttataacatgtttctggccttgggctagcaattggtgacgaatgtactcgaaatccatataattttcattttcgtcatccatgaaagcctcattttcatcaccaatcccagcttcagtagtatccatgtcatcctcatttaggtcatttgcttgctcatgaactagttcccgcaagaccaacaaagcagatggagttataaagagaggacctttccgtagatctgtagcacatgcgtgaattgcactcgcagattaggcgaccgcgtccatgtctagcggcaagccggtgagtgccattaatctggtcgttagcgccatgtccaacctggggaagaggaagatggcaacgggtcctcaccgacaatggcgatgggagagacgcaggttgcgctgccgcaccgacaccggtgtgggcgatgggagggacgtaggtggcagcggaggtggctgaactggttcaaaccctagaacacgaatgaaacaaaagggagagaagaaatgagacacgatttactttttgatataattgaatcaatcgctaaatcaacggagtatccttgatttacttttttctctacagcgatactgatagctactacaatacaccgatcactggaaggatatattcaattcaaatgtattgcctatgttttactagttaattactcaaatgccatcatgctacaataattttgttccgtaccttgcccctctctgatcaacggtgcacattatttcaccttcaagtaccttgcaaacaccgtaaaagatctcttatcatttacatatgcagagtaatatctttcttaaagttggttctcattaagttccatgaagattattattgttaaaaatataataatttcttatgatccatatatgttccaagtaagaatggcaatagacctgaatgaagaagggttttccaaacttattttttgatgtcaaatcatatt

SEQ ID NO: 21566 - DNA, 2087 bp, Oryza sativa
  unsure (1)..(2087): unsure at all n locations
ccatgtgcactgaatgcccncngttganaancaccttcgttacncattacacacatgcatatatgtgtgcactatatgtatatctatacatatatataatgcaattatacatatagtgcacacatatatgcatgtgtgtaatatatatatatatatatatatatatatatagacctagggtgcgtaatagctaaaatgctcctctcactttcccctctctctctccgctttttacggatctagcggcgcagcggaggcaaggaggagagcgatggctgcggcggtcgatggagcagttcaacagcggcggcgtgccccgcctactgccaagggtggcggcgtccaggcgacgggcggccgacttaatcaccaccctctcccgccgttgctcgaggtgtgttgcccggggttgtcgtcgggtcgtggccggatcggcatgtggttctttttggttagatatgtagtgcacccgttaccggtgtccgcatccattgtctgctggaggtccttgtatatgctcatcatcgttggatccattcgcttcttgggtttcttcgtgccggttcttgttttcttggtattgctttgctcatggaggttcatgttttgttgatgcattgtcatggtggtggatgctgcatctcagccttttgcatgattaatttcagattgtgctttcctttcttgtgcagtgctgctactagcatcttacaaggtcattaaactgtatgatggggggattggttcaattaagtatctcgttgattctcagagttattttctatatggaaaaaaatatgtttgctttcttttatggcaaagcaattcacaacagcaatattatggctatgaaatactaggtttaagtgaaatcatatttattttgctgatttgtgatacttagaagtaaccttcattttttttatccagatggctatgagaatgcctctccagacggccgtggtgacagatatctgtcgacagggaggacttgagaatatgcagcacttcgtcggctccatgtcgatttgttttattggcgttgtcttgcttgttggattcgtgcatgcatagatggatcattgaccttgatctacattgtcgtattagtcttggcatcaatcttcatcaccgtatccttcagtggtgttgctgttgtgatttttttactggagctgttgtgatctttaattagttctgtttattctaccaatgtaccacattgcatgtgtgatcacatcgttgatgtaataccgaaattaatttactcgatcaaaatttttttaatctaacttgtgagtaattaatttactgatagaaagcgggctataagttatgtctacgcatagagtaattcatctaatgacataagaccactagaaccggaacggaattcttgctagattcaatatgttctggcaatagtaatttctttacataaaagccaaaaccaaggaggggaatggatcaatatatttcgtcgacagtaatttctttacttagaagccaaaaccaaggagaggaataaaataaaccgggagtaatttttttacttaaagccaacacaaaggaggggagcaaaataaaccgggagtaatttattttaccgaagaaaatttcgtggcagccaacaaaataaaaataaaccaccggaaataatttatttaccgaagaaaaaatcatggcaatatttatttgttgattatacgtaatttatttactaaaagaaaattcgtggcaagattaatatgttgattagtaatttatttactaaaagggaagagaagcagtgggaatcaaaaaaagggtgggaatggaaggggtgggtggcggttggcggacgagagggaagtgggggtgggagcggaccaaagggaggtgggttgnaatccctccctgcngtttggtgggggttgggggttgtgttgggttgggtgtgtgtttggtgggtggggttgtggtttnggnttttntgggtttttgggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21567 - DNA, 4498 bp, Oryza sativa
  unsure (1)..(4498): unsure at all n locations
agtcgcagtcccccggtctttgtctccttttaacagggactttgtggttcaaaatgcgggtggcaggagccagcccaaaaaacaagtagtcaattaggaagagaccgcgtaccaatcgttttatctggcgcgaagcgtttcggtttcaattcagggttaatgggtttttttcgattttttttcaataaaaaagtgggcgggtcgcttttttttttgtgtggtcccccggggccccccccacagtttggtaaccttagccggtttgttaccccattgcacagaggtgtattaggccaaacgcagggggttcccaagggctatgagcggatggcagcctagaaatccctaggggggggggacatagtggatcctgcccgctaacaggataagatagcatttgatctactcaccaatgtggtagtagcacagcatatagggcttagaccatcatgggtgttggccaggttctctggtttgtgtccctcngggttggttgtgaggggagcgttttagttattacgcaccttgggtgcggtttagcgctgccatatatatatatatatatatatatatatatatatatatatgtatgtatatacaaatatgtgtgcacttaagtaattagaggtcatatgcatatatatattaacaaaatatgagtttgcaagtaagtaaatatacacatatattaccataccaagtacacaaaagtaaatgcatgtgtgcatatatgaatatatagatatatattccaattcgttcggacgttgtaatctttgtttctgctactacgacttggtggcatcggaagaagaaggaccggctttatgaatagtcgatccatcgtaatagaattctcctgtgggatcaagaatatgcttgttgatgaatcccattatcttttcttgaacagcccttatgaaatcatcgtgggtggtgttatctatcaggtaaatcatctgttatttggaaaaaaaggggattatatatatgaaaccagtaagcaataattgacgaaagaataaatttacgtacttcaaggtcctggccagtcctgatttggtgtgctaagcagtgcatgtaatggcatacgtaatagccgcacaagttagtccccttttcctactttgcacactgaaagagaaacaacgagagatttagtatgcatatctgatttagaacaaagaagtgattcaatacaaaattggagctagcatgtactaaccggaaaattgaacctccgggtgagtttttcattccagatcccgcggaccaatgtacggaaccgaatccatgctctatttagagttgttaggaaggattaatttattatccgagacctagtagttatacaatgattcataatgacagtgcaatatctgacaatacctatctatcacttcgaaaatctttgcgaaagttttctctggtttatccattgaatcgtagacatgaactttggatttctcaagatcgaaaagaagaaggacccaatgaaatctgcaatttgcattacatgatacatagtatgattgtaggaactttgtaggaacaaaattgaagaaacaaaattgaagttaattatgattgtaggaactcacgatgtgttgtagggaagtagtatgaacctcttataatgctgttgcaccaggaaatggacgatattgtcctcggtttgtttctcatattgttgtatcatcagcgtgttcactttgcgtgggtccatgaatccagtattgaatttgttgtgttgacggcacaactgaatctccattctacaacggggaaaaggaatgtgtgtgagcaacactcaaaggaggaacaaaattgaactataaatagtacttacaaaatccacgcgttgagaatagagacgtcgagggccttcaggtggtataagtcgaagacttccttgtgccggatccaaataacatcttctccttggtaataatttgagtttcgcaccctagctctgaacatctctctacccatcgctgatttgtccatgtaccattgatggaaccggtacatctgtgtaggtagctctctgatcttatcaggcgtgactagcggttcaccgagtttaaacgtgtacatgaccggagccgtttcaataggtccgtcctctagcaactgctccatactcagtcccgtatctttcaagaagttgcatatctctagttgtgccggttctacgactaacggttcaacctcttgtcgtggctgttgccccaactgagggacttcctttccgcacttcactgctgaaggcttggctttaagagccttcctcaatgttcgatcatagtcagaaacttcgaccggtttgcccggttcggccatcttaataaagtgatcctgaacatccggggctatagggatcttcttttccggactacatggcttcaactgctccctaacttctgctctaacggcttcatcgagctcctccggagtcaagtcgtacgcccttttcttgagagcggggagccgtggctcgtcagatctagctttcttcttcggccttgatggtgcgggttcatatgggcgggaccttgacggtgtagacttggcagcaggtgcacgcggaggagtagttgcccgcgggcccgacggtgcagacttggcagctggtgcacgcgtaggaggtggtggtgcaggggaaggagccggaggagtctgatgaggcggtgatgtcgaaggagactgtgcttgcggcggggaacgaagagcgggcggccgttcttgcccggaaaacacgatgtacttcttacgccagagtatgatggcgtgggctgtgtctccaagtttcttctccccgtctcctccggggatgtcaagctcgagatcctcgtaggttcattccaccagctctatctcgaccttcgcatatccatgtggaatgggccagaaatggtatgtactcgaagggtccgtgggtatggccatgcccgacacgaccttcacaagaaatatagttcattaattactaatcaacatatatatgtaacaaatttcgcatttcgcataccttgatagacaagttcctgaagggagtatgcatatcgcagggtgttcgctgcgtgatatcatcaacggggaagtgggttgcttcgtgagctgccactgcctcaatgccctctgatccaacttggcccgttgatgcatagctgctgcggttgcccgaggggctcaccatgacgggtgcttgtatttccattccgcgctactcggccaggcattggtccacctgtcttgtcacctcctcttgcatccttgcctcgtaggtggacaccctatactcaagatcgatgaccttagcctctgtatccctcttgctcctcatctgactcctatacgtgtggatgtcctctttgaatccatatttccaaggaaggacgccttttcctcgcgttcgtcctggatgctcaagattctgtagtgcgagggtgagctcgtccttctctctgtcgggccggaaagtcccctgcgtagaggcttcaattgcatccgcaagtcagcgtgctgcatctcgaatctcatcgccgaatatgagggagccatcacctggattgagcgatccaccgtgtgcatagaaccagttcctcgatcgcgcaggccaattagccgtggccggcttgataccccttgctatcaagtcagcttccaaacttgtcccacttggggattgcctttccatatccgcctgacccaagccggtgatggtatttcttcttagctgcattggctttgttcttttctatctgtgcttgcccttgcgctccaatcttgtatgccacaaacgcatcccagtgatccctaagcttgttatgcacgttgaaatcagttgtcaagcccttgaggatttatctcttgtacatatctgatttgtacctctggaatagttctgccattttcttcagggtccattctttgcatctgggacgatctacctcagggatcgtgaatgtctccagcatggtggtccacaacatgtccttctctgtgtcagggagaaagctatcttcatccccgcgtgacctagttcgacgccagtacactatgctgatagggacgttgtctctcacgacccaaccacaatgatccacaaactttcgtcctatacccgccggggctactggttcgccgtctggggcaatctcagtaacgatgtgccttccctcaagcttcttcgcgggacctcttttcctgcgtggcctcttctgtccggccgacggttgactatcagtcccctcctcggtcccctcctggttagcctcctggttaccctcatcgttgccctccttgttcaggtattggttgggatcctcgttcccctcatcatccacccagtactgactactgccctctgcgatcgtgtctaataggatttgttcgtcatcgcggtctgccatctgtgcgtgcaaagaaaaaaagacagtgaggtcatggacatcaacatgtacagggtaccgagctagaatgtacaacaacctcg

SEQ ID NO: 21568 - DNA, 2165 bp, Oryza sativa
  unsure (1)..(2165): unsure at all n locations
gtgtgcttttgattgcagatcnnnnnnnnnnnnnnnnnnnnnnnnnnnnnnnnnnnnnnnnnatatttttatccttagtacctaagtatctatactaatatttaaatacctttacatagtacctgtgattgagaactgttggatctttacccttttggaatgcaaacaccgtaaaagttctcgaatgataaaggaggaagacaaacccattaggcaatcatgggtacaaacttcagcatatatattttagttttgtaattatttgcaacagagatataaatctgcaatgatatgttctatatattttttctatcctcaagactactaggtacaacctaattaatagaggcattggttcttccttttaattataggtaaaaaatcaggcatagagaagcgatacatccaccttgatgaggagatcatccgtgcccatccagagatcattgacaaacaccagccctcccttgaagctcgtgttgaaatcgccgccgccgaggtcccaaagctcgccgagtctgctgcaaggaaggccattgccaagtggggccgtccagccaccgacattacccacctcatcttcagcacctactctggatgtcgtgcccctagcgctgacctccagctggcatcgctccttggcctccgtccttctgtctcccgcacaatcctcagcctccacggctgctctggcggtggcagggcgctccaactcgccaaggagcttgctgagaacaaccgtggtgcacgcgtccttgtagcactctcagagctaaccctggtatgtttctccaccccagacgaaagcaaaattgtcggacatggactgtttggggatggtgccggtgcaataatcgttggcgcaggcccgttttctgatggcgagtgcccgttgttcgagatggttgctgcctcacagaccatgataccaggaaccgagcacgcacttggcatgcaggccactagcaccggcatagatttccacctctctgtccaggtgccaatgctgatcaaggataacatccagcagagcttgctcgaatccttccaatcggtcggatacacagatcctgactggaacaatctcttctgggcggtgcaccccggcggccgtgctatccttgacaacatagagggcaagctacagttgcaaccatggaagcttgcagcaagccggcaagtgctacgcgagtttgggaacatgagtggtgcaactattgcattcgttcttgatgaactatgccaccgtcgggagaaggacgaagatgagtcacagcagcatgaatggggagtgatgctggcctttggaccagggatcacaattgagacaattgttatgcgcaacccattggcacgtggtcttaagcaaaattagttaccactgtcatgaaaataatgcaatcggaatcatctgatgcttcgatatttcactacactatggaaattaattaatgggtgacactgaatcaattgtttatgcatgcttaagtattctcaactctactacatgttgtaaataaacttttatcacttccatgtgtcctctgattcataagctttattgatttgtaacaaaatttggaataccctgtgtcatgtgtatgtataattaaaatactacctctgccaatgccctggtaataaaaagaacaataattacaacacaggttacaacatcggaatttataaaatatttatgctgaagtttgtacccatgattgcctaatgggtttgtcttcctcctttatcattcgagaacttttacggtgtttgcattccaaaagggtaaagatccaacagttctcaatcacaggtactatgtaaaggtatttaaatattagtatagatacttaggtactaaggataaaaatataattttgttaatagagaaaaagggtaaaattgttcctacctccaaattatatagataccacggatgttcaatatggcgaggtaagctctagctgttaccgacatgacttatttgcctttaatattgtgagatttcctgagatttacaatgtggctgaggtatggcaaaaaaaagacactagtgacacatgtgcttaaatcactttctctagaggtaccttcttggaatctttgatgttctcttttgcgggatatttttagaactacatattgtggtcttataacatggttct

SEQ ID NO: 21569 - DNA, 822 bp, Oryza sativa
  unsure (1)..(822): unsure at all n locations
atgggnnntttgatattgtataacnnnnnnnnnnnnnnnnnnnnnnnnnnnnnnnnnnnnnnnnnttgttgttgaagaactgacgctgcggacgaacaacaaacgaagaacctccctgtgacattgactgaggtcccaaagtaagacgcggcctctgactattcccctgttgtgccttgaagtgagcaatccggcgtttcttctgctccatgcggttgtacttgtcctcctggcgaatagccttatctactaacttctggaaatcatgataatccccagtcatgagtgggtaagaaagctcatcattaagtccttccaagaacctctcctggcgctcttcatcagtgcgcacatcttccggagcataacgagccagacgattgaactcctgcagatactcggttaccgtgcgagatccctgggtgagcgacctgaattccttcttcttgagagacaccactcccgatggtatatgcgtcttccagaaagcagcggtgaattcaaaccaagagataggttcagcggtagtcctgttaaggcggaagtgatcccaccactcagaggcagggccatgcagttggtgtgatgcaaatgagaccttctcctgatcagtgcactgaagcaaatccaacttcttctctatggcgtgcagccaattgccagcttcaacaggattagtggtgctagagaaagtgggcggcctcacacgaagaaattttgctaacttgttctggggaggtgcatggttatttccctcgttctgctggttctggagttgctgcatcatcatgttcataagctgtgcctgttgagcccagactt

SEQ ID NO: 21570 - DNA, 1977 bp, Oryza sativa
  unsure (1)..(1977): unsure at all n locations
gtggcttgaatttgctanatcnnnnnnnnnnnnnnnnnnnnnnnnnnnnnnnnnnnnnnnnnaggatatgaaaaaagttacagatatgttactgttgacgaaaaaattgaacacaccggcctgggagatttgctaagctcatgtgcaggtccaaatcttagtgagatgagggcgtgccaatcagtttgatcctacaactgacaagatatgcaaatagtagatcaaaacagccgatcggctgacaagccgatggaatagttccagtcgatagccgataatagccgatgccgatgccgataccagccgatagtgatagggtttaaacaatcggttgtatgtctaatgtagataatgatatgaagacaatcggttgatgatgatgtaataaaataacaatataatccagtataaaccaatcggcaaataatgatatgataaataagcatcgatctgaaggttaaagcacacatcggctggagttccgatgtcatgaaatccacaagattagattaaacagtgaaacctttgttgtcatcggataaatccaacttatatgtatatgcaattcttatgagccgatgcaacatccagataactcaccggctgaaaccccgatgaaacccttattggcaatcaagaagcaggctagagattatggttctaagcacgacttagtagatcaaacttaactgatgcagcgctgagtgtgaaaagaaacataatatctagacaatcaagccgttgactgattttcaaggtggtagatgcctaggctaatctaatctagcaaggcgatttagccgataccgacataaaccctaaagcgagagacagctgatagagctaaattgagatgctaggactagattaacatagacatatgataaatagccaggcaaatatattatccaaaccagagtaatccaagaggtcgaatgtcctgatgcagccttgaacgacgccgacgtagacgatacaattgcctggaccggcggaacattggacttatcccttcgctggagatcgaagacgatgcagccccgcgtcgggtgccaagttccgtcggaacgtaaaaacaaaagtagaagtaaaaaagggtggcgatgcgccgaattgtattaatcgtagcgatagattacatagaccccgggtgtacatatttatacccatgggttgatacaagtccttgtcggacaagaaagaaaccttcctaaagataaaaggaaaagataaagtccttataggacactaaacacactttcctaagttaaaaggaaactaacaaactattcctaattaatagataacttgccataccgtattctctttgaactcagtctcttctgcataagcctccttaagtagatcaatttccttaaccgaatatagtaagaatccgataactgacgacttgacaactctcatcggctaatctcaggacttcgaagccgatgctgactctaagccgatgactactccgggcttaccaaatttcactattaacagtcaccctttttattcagctatctagtatgtgttttgcgtcgtttgtgacagatcgagatgaagagtccagtacactgctgcacaaacccttttagtcccagtttgcaaccccctatagtcccagatagcaaatcggggatacgaatccgggactaaatatcgctatctttagtcccggttcaaatattcgggactaaagatcaatctttagtatctttagtcctaccaaccgggagtaaaagattttttttctttttatttccattgtttttatgctgtttgcacctcgactatcaccgtcacacccaaatccccacaaatcatacataatcatccacaaaaccatcaacaaatcatacacaatcatccacaacacatgcccatccacaatccacaaatcaatcacaaatcaataaaaaataactacaaatcattcattacaaatgggtaccgagctcgagtaactaccat

SEQ ID NO: 21571 - DNA, 15686 bp, Oryza sativa
  unsure (1)..(15686): unsure at all n locations
aatcaattcacaaaaaatctacgaatcaactccacagccaccgcctggctgcctcccctcccgaatcccgcggaggggaggccgccgccgccctcgcgcccctcgggccgccccggcgccaccgccgccaccgcacggccgcctcccctcccggatccggcggaggggaggccactgctgccctcgcgcccctcatgtcgtccccacgacaccgccgccgccgcccgccagaagggagccggaggggaagaggggagcggagtggaggaggggaggggatgggaggaggccggaggagaagagaggaggagaggggaggaggagatgagggtgagtgaatgacgggaggtgtcacgcccagaaatttagcccaaatttccagactattttgtgtattaaatccctgtccaggaatcagccagggtacacaaaagacaagtaataaacagttccaaacgtaaataaagagtaaatacttacagaagaggctcttagtcctcacaccgaaaagaaagcagcagcagcggaaaaaggcgatcctagcggggcttcagctccactcctcaggcaaaacacaactggggtttgagccttggtcttctaacttcgtcttcagctcagaagcactacacttctgaaaaggggaaaataatagcaaaactgagtacaaccaccgtactcagcaagccacaccaatgatgcagacgtgcaagggaatacaaggacagtttgttgctatttgcataaaggcggttgtaaaacattttattgagaaaaagggtaaaactgttgactaattagagtaacattaaatctccactgatcaacactacaccacgttgaacaggcccaaccatcccacctgaactacagtgcattgggtcgatttattaagtgtgagactaatcacggtgaatctggtcaatcgcccataaccgcgggcacggctatttcaatagttttactctggccagaggtgcactactgtacccacatgacacaatccatcggcatgtcaccgtgccaggccagacacgtcaccatgtcgagtaattgtgacaagacccttcatataaccccctctgaccaagcacaccacacctcaggtttcacccctgcccccagcaggcaacaggcagtcccctctcgtgcctaggcgaatcagaaagccgcataggccgtcgcagggcccatccgaactccatcacgctcacccttgcctggatgcatcagccagcggaaagctatacttcaagtcaggtagttacccattcccggttgtggcaagcgctgtatgtcttccagtgcatcccgcgaaccggtccttaattgccatgggtgcgaccagcaaaaccatgcacccacagcccaccattcagtcgcattttagttggatagttacgaccaatgaaacatggtcatatgtctcgagcacgcagctcgtaatgatactaaaaggtctaattctgcaattatcccatcaactgagctagtgataattaagcatggtaagcatatagttctagctagatcaacataagtgacacaagctagtcgaattatcacccacagttgacaaaggacagatatcaaataatatggtacaagcaagcagataggtaaaccctattcccatgtaattagcaaaacggtgcatatttatttgcaaacaataaaacatttataaattgggatcaacatgctcaaggggaatgtgtgacttgccttgcttcttcaaacaatcttccaaactcttatcctcgtgaccacgaacttccgaaacagtgaaatctacacgctggcacgcaaaacgaggaaaaactctaataaagaccaagcaaacagtacaataaaagtaaacaaacatgtagagcccaattttagatgaattttgcaagttgaatggctcaatttggagttcgaatgaatttgatatggattttagaagttctgaaccgtttaaatgaatttctagaattattaacgaatttattgcgcattaaattgattaatttctcaaaggacaagggacgcgttgagtcatcaaggggaggccgacgccgacacgcgagccccgcacgtcagcggcacaaaggggcggcgcacggtggaccaagtccacacgtgtcctcgggtgcgcgtccaccacatggacgacccagatcggcccaagccgatcgggcggccgaggggagcgccggccaggggcacgggtgcggcacaaagccggcccggccaagccaaggcgcggcgtcggcacccgtccactgtcggtagcaccgggcgacgcggaacggcagcgggcggccagaggacagcggtgcgcacggaggatggcggcgcaccccaagaggcggcggccggcaagaaagggggacaggaaaaaaagggggagggaggagaggtcctcactggaagcggcggccggcgcggaggatgatgatggcgacgacgattgcccgatggcggcttgcgaggatggagggcggacggggttgcccttgacctgcggaaggagaagagggagttagggaggggaggaccgatgcggggtgactggaaatgaaggacgatgacgacgacaagaggtggagctcaccggcgaacttagtggatgggtttgagcggcggaagacgacgaccgagcagcggacgaggtgcaggcgagcactgcgaacgcgccagcggcagcagcacggctgggcaaggtccccctcactggcgaggagcgactggagctctatggaagtggaggtagctcggctccgcggtggggaggtggttccggtggtgaatgggagggatgaggcggcgacgaaaccggcggtggatgcggcgcagtacggcagcggcgggagcggcggtagcgcgcggctggaggcggcggatggcgatggcggctcgggttcgcagtgggaggatggctgcagtgatggaatggggaaacagagcggaggccggggtgcggcacggcgaggcgaagccgaaggaaccaacggtgcggcgcggcggtggctacggcgacggcggcgtgcagccggagctcgccggcgggcggcatcgcgcggagcagcgtggggagagcgaggaggagtgcagtgggttcgggcgaaatgggggaaacgagagaggatgctccggggatcgtttatatacactcgtggagggggaatcgtggccgagtggggcggcaacggccagtgaagtggcgaggcatcgtgggatcgtgggggccaaatcggcgccggtttttggggaaaaacgagggaggaggtggaggagaggggtggcttccggtcccacgcgagagagggctcgaggaggccaggaatggcggcgacgtgggcggtttttagcggccatggtggcaacggcagttgccgacctaaggttggggatgataggtggggtccatgggtcccatctgtcggccaaagaggagagggaggccggctggggaggcaaactagacttctgggaggagagggccgagcatggagctgggttgagggaaagagagagagcccgagagagggaggggcgcgctggccgcggggaaggattcttgggccgaaaatagcccaaggaggaaggggagtttttattttgtttttcttttcatttaaattgattaaatgaactttatgcttttaaaattaattcctgagctccgaaaattcacggaaaaatccggagagtatattagggcacaaagaatattacaaaatattcttggtcaatgatttttaagggaaatttttaattttcccattatttcacttgattaaattgctttaacttttctaaaatatctagaagatgcattattaattgatttttaatcccgaccgtaaatcggggcgttataggaggagaggaggagaaaggagataaggtggaagtatcaaggaaggacgcgatcggacgagtagagtgtggctcggggccgatttgtagtcccggttgtttaacaatcgggattaaaaatagatctttagtcccggttggtgttaccaaccagaactaaaaatagtgaaggggtctaacaccgcctgccatgttttgagctggaactaaaaatgatctttagtcccgcttggtaacaccaacctagactaaagatcaaaaagtacccctgaccttttgaaccgggacgaaagatattctttagtcctgattcctacacaaaccgaggttattgtggattttagctgacccgtcaaagatggtttctctacactattacaatacccatttttccatgcggtggatcagcccgcctgcaacgccgcgtttgggaaaatcgatattttcgcgtgcgggagggctgaccgcacgggataatatattataaattagccaaaaattgaccgagctcaattataaacatcaaattacgtagaatgtatagtgtttgtaatattacaagtttcccccgcgacaaataaaccttttagaccatagcatgttccctctcccacacccttaggttcttgaatttggggtccgtagcaagttcactatgaggatcgtggaactctcctagatggttacagatgtcgcaacgaatgaactggcacaagtccatgcataagttgatcagcgttttctgatcgaaccggattgcgttataagggatgctcgggagctatggaaagtaaaagacaaatgatttgtgttaaaatcaacttaaatgaaatatttgcaatatctaaggagcatgaggacttacatctgtaaattcagttctgtatctcccacagaccctgagcatctcgcacacttaatatccgcataggttcgacaagctcggttgcttgtaacactgcattagaatagtggacacgtcagtagtaagaattgacaatcgtgatatacataacgaataaatgttgtcataccggccagcgtccccttatgtagagtttgtctctatttggattctttccaaacccaccaagtttcctataacggccgtgtgctctacaaagataaattaattaattatgctgactccacttattacaaatgatatttacagaatattgggggtttgtttcgaacttacaagttcagcaagcataggaactccatgtacgcttgcttgtcatagtctgccggatcaagaactacgacggtttggtccgttggatagacgaggaatagtatatagtgattgctgcgaacacggattattaaattatgtaagacatatttgaatgtgcggttattaatatgtgaacggaacgaacaggtagttgcttacccaaagtgataggggaccatgatgactcgtttgtcagagtgagagagcattgagtgggccaagtaatttgccacctcggccatctttctcttatgcaaacattcgacgtaatcttttttctcctcgtctatcttattctttagtaccgtactattctccgatatccgcacagtgtgggtcgtctcgcaaaccatcattgggtttacgtatgcaattgaggcccccattctttgggcgtctacccattgtgacatgaggaaatttggaagttagaaagactatgatgccccttattaaatgatgtataggtaagagtggaagggcagtagagggtaaaatagcgagaaatttgaatgaaaagtgattaatgggaccattagtactctattgtgacaattgttttgggataaattcaaatcctagaaatataattattttgggacagatgtagtaagaaagaacatccgaataggcaaactggaaacctaaggagaattcatgaggaaaaaagtttgaagagctagcaaaatcattagtgaagtatcttccttgtcagtctatttcagcgacatcttttaggccgatgttgggcgtatcagctgcgcctggcttgaatgaggagaggaaggacccgacctctagctctttacttttactgcccttgtaagggcgttgagaccatagcgtgttacacaaaagcgccaggaaagacgaatatgtgtgctcagcagcattctagtagcaaaaaaacattttttttcaaacctttgcacgcctccgttaccttttgggaggcctacgccgaaatagtgtgagttactcgctcgttatttttgtgcaggattgactaaacagctttcgtagtgcccattttcgttgattggcgagttaatacaggaaaagaaaaggctgtaccaatcatgagtagtaaagcggtaccagtgaattttttgctttttcagtgaagtactcttgcttaacttttgtccataaatcccgtgtaagcagtaaatctcgtaattctcaataggccccctttctgttaagtgaagtgaggcggggtcgccgaacgaacgacgttagtttacttgcacgcaattaattatcatctttgaccacgagccattctagacagtgccgtcggcaaagcattttttaatggttttggtagttcaatttcacgtcatgaaagattagatagcaaccggtataggctctagttttcctagagggggttaaacccaccccaggtagagacactcagtctaaatgcccccccccccccccggtcnnnnnnnnnnnnnnnnnnnnnnnnnntcctcgttagaaaatacattctaggagtaggagactcatccttctatacgttacctgcctggaaacatgtaagttcatgtcccgcaagttagcgaggttggtcgggcggagactctcgaacgaggaaaaggatctcttcgaaagaattgaacgaggagccgtatgaggtggaaatctcatgtatagttctgtagagggacaggaagggagacttatctgtcgacttttccactataaccccaaaaaaacccaactatgccttacggaaaattgccagagtacaattaaccgtaggatttgaaatcgctgcttatatacctggtattggccataatttacaagaacattatgtagtattagtaagaggaggaagggttaaggatttactcggtgtgggatatcgcattattcgaggagccctagatgccgtcgtagtatagaatcgtcaacaagggcgttccactgcgttgtagattcttatccaagactttatcatttgatgatgccggccaagaagctgccagctgactgcgccccttcaacccgacctttattcactatgcgtccaagctcttggaaccaaaggtatgtatgagcattctgggaaggtcgcaagaagccggttttagaaggtttggagcaatcgcaatttatcatcatattattacccgtttcaattgatgactggctaatatataagtgttccatcacaaattatttttggttcctcaattacagcttattctttttttcgaggagaagggaatatattactcaactaaagagtcctcacaaacaaaatgtgagatgaaattacatttatcatccggtcaaaactcagtaagagattcacaccgggctctgttagctagagtatggctaacattattctgattttgctgaatcttcgcgatgatcacttccatgtttcctgataacagttcttctatgtccctgacaatgaatgcaagttcagagcgccctttcatcgcagattagatgaggttcttctccaccaaacaatcagtctccactataattggaaggagtgtccactgaagaaccaagttaataccttccctataggcaaggagttctgcctccaacggactgctgcaccggtcaagaaaaccacaagcaaaaaaaaaaaaattaccatccccatactgttctttgactactgaatcgagatccatatattatttgtttcatgctggacatgtggactcgagaatattatctccgggatcagatcagataataattttgtgcattttgccttatcgtgacttatatcttggacgtgcgtgctgtaaattgttaaactactacgagtcatggtgtttttttaagggtttgctgccagcttccacagatgatacggatcggatgctattaatatgttggaaactactaccgccgggcgcccgattgggggtgggaaaaaaactattttttctcttaaattatttatccaaatcatgatccgattgcaccattaaatttgttgcaattaaatatttaaaacaagactacacatggatatattccgatgaaaaaattagcttattattgaaatatttttaaatattgcacgttgttccaccaagtagatcagaattgtttcactgagtagatcgaaaatgtttcaatcgtttaaatcgagcgttgtttcaccttatataaaaataatatttcagcaaatagcgaaagaatgttttaagtccctgcaatatttgatccatacatagtgaaacattataagtacactaggtgaaacattttttgtggaacaaaaaataaaacgaattcccttaatagagggtttccataatatgtgggtgatttgttgcaaaagaatgttttaattcactgcagtattagatctatatatatatagtgaaaaattatgattacactaggtgaaactttttggtggaaaaaaaatgaaacgaattcccttaatagagggtttttaaaatatgtgggtgatttattaccctcctcccatccatcccaaccgagcgaccgattgttgatggtccttatcgatcagtttcgaccgtcaatattactaaaataggagagaactggtgatgcttgcaatgcataaatatgttagagtaataatattccactagtattaggtttactaaccttttgcagagaatgatcatgtagtagaggagaatcgacatcaactcagacgataaatcaatcggacgatgtcgagaaccagacttgtgtatgaataggccaagaactcagaattgaaacgatgaattgggccaaaattcataagtctgcggagtagagcaatagaggaggccaccagccgaaactgggctggatagggcagccccaggttcggccgaaccaatcctggcaccgttggatccagtttttggcatggacattcaggattgcatcccaatgacggttggagggcacttaggacaattccccttccacaaccatcataaccacctgggcacttaggacaattccccttccacaaccgtcataaccacctctatataaggagctcactctcttcacttcaacacacacctcaagcaatagctctctcattcctctcaagtttagtttagtagtatctagctggtagaatagaaatagaatgggagtcaggagtccggaaaccttcggaagagttcgggtatggccctagcagctttcctttcctcttttgtaagctttgtacttttattagaatactcttctatatacatttatggtattgaaatactttccgagtatatgagtacctactttacattacgttcatgttatactgaatatacggctagcttatctgggagatgctttggtgcgggtatagtgtttgcttatgcaattactctatgtcatgacgatgatattagagtagtacctagtagtttagacgtggtgtctagattacgatatatcattatttggggttatatattgcggatgagaggtgggccgctgatggtgacagctcaatacgggtattcctccgcgcctatatataatcctaagttaatttcctagggagggttttcctccgtatttagccccggttggatggtcatgatgggctgtcgtaaggaactcggcagtcaggggtggcttttcgaagtaccaggagggcatcgaatagagggtgttagctagtatatcagttaactagaatggatgtatactatgtatattagaagtataggaatagatttcttttctcttttctttccacctagcttagattatttattatgaggatgagcagaaatgcttgtgtgtcactctacccttggattatcttaacccctgcttagaatatgattatcacaagtaatatataaattattagttgagttctctctacatgattttcccacggaataaaataaatacgacacccttagaatactctcgggtgaaatgctacaatggtataaccataatatactagaagtgtttctgcaccattgctgggaattatatttctaataatatcgttaagaaatactaacaccgattcggaggattcccgtaatatgttggctggcgagtttgattcattaacttcatcctaaccacgttttctaaattgttaaatgttaaatgatttatttttgtgaaaaatgttatatataaaaaagtttttaaatataataaaacaaatctattttttaagtgttaaagaaataatcattcattagttgttagtgatttatcttgtttctcatgaagcaaattaggcaagtgggacagctcaaacgcattctagccatacgagggtggcgcctcctgctgacggcacaactgctggcggacggccggtgtggtcggcgcagggaatccacacggcggtgccagcacggggaatgctgcttctgcgctcttagtggttggaatataaatgtaacggtgatgataaagtaggataaaattgtatataggatggtatctccgataactgacttatattgagtaattaattatgtgcttctcgatagcaaaaacatatatcttctaaaaaatagtgaggttttcttacatttatatatgtatagaaagtattaatctgaagcaggcaatcagtgaaaaccggcccgtttggctcgttggaggcagtcaagtaataccactgtccactgccaccaccacttctggagttctagtggctcatccaaatagcggattgatgtttgttgttagtgaatttattcgctcaagcaataacatgagctttgaagaagccattgatgtcgccgcagtcgctctgtcattatagatataggcattggtgatgcagaggttgagagtcggcatgaggaagtcctcggcgaagtgcatctttgagttagtgaagtagcgaatgtcagtgatgcctatgatcagcaacctaaaacaccggtcaaggaaaatgaaacactggtaaaataggatcactggagtggaaatttccttcgacctccctttagcgcttggttaggatcggaagggtttagggcttgtgaggaacaggaaccatgtcgagagagtagtcattttctcgtacgaggcttatttctcttattcctcttaattccattggagtttagtgcgagtgatccaatcaacgcgcatgttgtgcgcacgagtccatagactcataccttttctgttgtagagatcgtcgaactcacgtgggccatgccgcatgcctccatcttgctcggatagccagagatcatgacctagcatttgcatctcatagaaagaataagaccgaatcaatgatccgacgtgaccggcacctgtcttaaaaccggcacttatgtgtgggacctatttggatatcgaggtgccggttttaaaaaattttgcgcgtgggtgcaagggtgggaaaggcattatacgtgtcggttttacatactccggcacctatagtgccgatacctatttacctttctgtagttatgggtgcaaacagcgtggattgacaagaaaaaagtcaaacggaattggtggaaaatatgtgacagtcttttcaccaagtatttcaaatttatattcatcatatagattgaagattcaaggataactgaaaaataaaaattgcataacccactcaggagtgagaatggaacccacgccatagagttatcaacttgcggcgctagccatctgactaattacgagttttgaaataaaactaggaaggtagcccacgcattgcgcgggcatgtattttatattgcgtttgaaaagcttatataaacgaaatatcaactggatgaaactaccatgtttcaaaagtactatttctccataatttttctcatgcatttcttagataatttatccaaactttttgttaccttttaaaacatataatatttaattcattcatataaacaattatctatggtccgtataaaaacctgccatgtttcaaaagtatctatttaatttgtttggaaaacaatctacaaattaaacgtaaattaaaagcttgtttaattgaatgtttagtggtatttttcaaaaaatcctaaagaactattgttgttagtaaataaaactatttgtaccatcaagttagttctctttttagttggttcagattcacgcaagttgttacatacatataaattaacaaacacatatcatatagatcctcacttccttgtaatatttatgatctatagtatctcttctataagaaaatatagtcaacatgagtccaaaaaatttaaatgtaatagtaacaaatatgtaagcattaatatgtataggatagatgcaaggccattaatatgtaagcatttaaaaattattataaaaatggaacatgtaatggttggtccaattttagtgcaaagtacaaacttatttgatttttctccaaatagttcaatttagtgactattgatatgttatttttttagttttattttatatcagctcaaaacataggggttatggatctttaaattgttggtttagttatgaatagagcaatagttagattagaaatcatatgtgcaacttaaaaaatatgcatgttttaataacattattgattttctcgctataaaaaaaggagggtagaggagagagtggagaacttgaggtgagaggggagaggacgggtagtgctatgttgtgcacatgtgaggggagggtgaagtgcacgggaatatttttttctaaatgatttaattgaaaaatgaagatccttattttatcaaaatttctaatttccttttttttcaaaattttaggatgtaacacatgatggcttaagattcgggtagtattgtgttgtgcacatgtgaggggagggtgaagtgcatgggaaattttttttttctaaatgatttaattgaaaactgaagatccttattttgtcaaaatttctaatttccttttttttctaaattttagaatgtaacacatgatgccttaagattctaaaattatatctattggtttaaaataatggatccacctattaagtgaaacttatgagtagatatattttcttacaatttctaaggttttgtttttaattaagacgtacatgtgatgtacgtacatgtgatgtacgtcttaagtgcgctgcagagaataaacaatgatttgaggtgacatattacttattgtaattttttataatgctttgtttcttctatttggttatgatgcataaaggataggtgtgcaagctcaggtggtgtttatttttatacagtgaaatatgagtaatatggatcttaacttatttatttataaatacattaacaattcaaataaacttttaaaaatcagatataacataagaatcataattatttagcttttgtaattattgatcatttttatattatgctattaattagttaaaaattataagacggaagagttgagtgggagaagagaagaagagaaagtacgcacacatataattatgttttatacattttatagtgtttatttatatgttatagttagctacaaatttagtcataaataaattgaaagatataagcggattaaaaattagtggtataggtcgtgtttagttctttggccaaaatttttttgagtgtatggacacacatttaaagtattaaacgtagactaataaaaaacacattactgattctgcctgtaaactgcaagacgaatttattaagcctaattaattcgtcgttagcaaatgtttactgtagcatcacattcttaaatcatggcgcaattaggcttgaaagattcatctcgcaatttacatgcaaattgtacaattggttttttttgtccacatttaatgatccatgcacatgtgtccaaacatttgatgtaacatttttgtaacacccgtatttctgttgcttttatttaaaaagttgtcatttacaaatttggagttaaatttggttcttaattgatttttgtgccaaaatggatctcaaatcctctcctagaaattcccttcaatttctgtgaaaccctagtccaaattcaaattcaaatcctttcaaaatctcctcaaaattcaactctacaaatctctggaaaaaggtgaaagttcactgttcaactgggccgccctcccctttcttttttctcggcccaactcccctccatcctctcctctgttcttctccccttagcaggccggcccagcccagcccgcaactcctcaccttcttcctccttgagccagcctcatccacgcacacaaggtgttcgacagaatgccgacccaagacgccgcaccgttttcgtgtcgtggcagcgccgcgtcgcactcccgtgcaccgcgtgtcgtgccaagaccacctccgcaccaagccgaggccgcgccacaccaaaatcgcgtcgcgccaagccgtcctcgccccggtttctgttgacggtcattatcgatcagtttcgaccgtcaatattactaaaacaggagagaactagtgatgcttgcaatgcataaatatgttagaatagtaatattctactagtattaggtcttctaaccttttgcagagaatgacaataaagtggaggagaatcgacatcaacaccaacgataaaacaatcggacgatgtcgagaaccagacttatatatgaatgggccaagaagtcagaattgacacgatgaattgggctaaaattcacaagtctgcggagtggagcaatagaggacgtcgccagccgaagatgggctggtttgggccagcccatggttcggccgaaccagggggttcgggcaaacccccatctccaccgttgaggccagggtttggcatggacgtccaagattgcaccccaatgacggttggagggtacttcagacaattcctcttccacaaccgtcatacctgcctctatataaggagctcaccttctcacttcactcacacacctcaagcaagagctatctcattcctctcaagtttagtttagtagtatctagctagtggaatagaattagagtaggaatcaggagttcggaagccttcggaagagttcgggtatggctctagtagcaattactctatggcaagggtagagtgacacacaagcattactactcatcctcataatatattatctgagctaaatggaaagaaaagagaaagaaaatctattcctatacttctagtatatatacattctagttatctgatatattagctaataccctctatccgatgacctcctggtacttcgagaagccacccctgattgccgaattccttacgacagcccatcatgaccatacaactggggctaaatacggaggaataccctccccagggaattaacttagcattatatacacacgcagaggaatacccgtattgagctgtcaccaaagcatctcccagataagctaacagcatattcagtataacatgaacataatgtaaggttggcattcatatacttggaaaatattccaatgccataaatgtatatagaagaatattctaataatattacagagcttacaaaagagaaaaggaaagctactatagccatacccgaactcttccgaaggctctcagggtaccagctcgattcaaaaagtgaattcatcacact

SEQ ID NO: 21572 - DNA, 4879 bp, Oryza sativa
  unsure (1)..(4879): unsure at all n locations
gcgcgcnntttagaatcctcatcttgcatgcctgcacgtcgactttatatgaacccctttatttaaccctccaatgacggttgtaacggttggaatagtcggaaataccctccaaccgtcattgggagctaatccacaccgtccagaagaagccctgcatccaacggcgacgagggccctggttcggccgaacctggggcttgcccaactagcccatggtttggctgggggcctccttttgtgttcttctctacagacttgtgaattttggcccagtttgtcatgtcaataattctaagttattggctcattcatacataagtctgattctcgacattttctgattgatttatcgtctatgttgatgtcaattctcctccactttatgatcattctcaacaaaaggttagtaaacctaatactagtggaatattattattctaacataaatatgcattgcaagcataactagttctcctctattttggtaatattgacggtcgaaactattcgataatgaccgtcaacactcccgtcgcctcgctctgaaccctaccacccaaattccggctgtagccaccgtcggctgcgcgtcacccacgtctcgccaccaatcccgctctacgtgcgtcacttcgtgtcgcgtcgccgtcgaatcgccaccagtgcatgacgccaagtcttcacgtcgccgtcccctcctcccaggaatcccatgtcttctcttccgaccgccgaggagtatctccagtagcaagccgagtatgaagacttctaaatgtttcgtgcctagcccaaacctcgcctgtggaataagttagttgcctaggttagttgcctagtgcttagttgtttagtcgcttagtctttccgcgctgttcgcttctgcgccgtcgtttttatggttatttctgtaatgattgtgttgtttatctatgggcctgtccatgatgacaacttatgtaagaactactacccggtgatgtaataaagtagtttactttgattcatttattctgtgtgtaccagctagtgtatcctgggactggtactatattaaaggtaatgcataacactccggtgtaagttagctgtgtttatggctaacgaatgtcaggcgttataattttttgtcaaaatttttgggatctaaacacacccataatttagatgttatagctgctgaattgtttaacagaaaaaattcttttctaactaataaagtatgataataggagaaaaaaatatgtgcaaaaatatgaagacattgagagaagaagaggtgaaagtaacgtgagtatgtactatccttaaaacaaacatacatacatatagtaatacgtacggctcaaggtgaaaaaaaaaacgttcgtacatacatatagtaatatacgtacacgcccaaggtggacctcgtatggggttaggcagtttgttttcttttgataaatctaatggtggtaaataatggatccaccaaatttaatgaaaagcaatagctagagaatttttagaaaattctctaatttattataatactacgtggcggtttggaaacgtttgtagtgtatcctgggactggtactatatcacaggtaatgcataacacccctatgtaaattagttgtgtttatggctaacgaatgtcggggcgttacaatttttggccaaaatttttggtatctaaacacacccataatttagatgttattgctgctgaattgtttaacagaaaaaattcttttctaactaacaaagtatgataataggagaagaaatatgtgcaaaaatatgaagacattaagagaagaagaggtggaagtaacgtgcgtacgtactatccttaaagcaaacgtacatacatatatagtaatatacgtacaggccggctcaaggtggaaaaaaaccgttcgtacatactatataatatacttacacgcccaaggtggacctggtctggggtcaggcagtttttcttttgataaatctaatagtggtaaataatggatccacctaatttaatgaaaattaatggctagagaatttttagaaaattctctaatttattatagtgccacgtggcggtgtaggaacatttgtaggatgacacgtggcgacttaggagcgtttgtaggaaatataatggacttttagtatataatagataatagatagatagatagatagatagatagatagatagatagatagatgatagatagagaaacatgttaattacatgagcattgctctagtccttcttttttaccacaaggtactagtaccgtgaggtactgaaatcccgtccgttgatgatggcagatcgaacggtcgcgattacatggtacctcggggtactagcttggtcatggggtggcaatcgcgagtgagccatggtgaaagggtataatcatattttctcgtttggaaggatgtttggatcggtggtttgtttggggaagtgccgcagagtagcaaaaccctaggcttcctcctgatggtggcgcgtggcggacaatacgacggcgacggctatggcggcggcatcagttggtctcgacgctggcgtcttccacttgtcccgtcattttccccttcgtggcggtgcctcatccattcctctcgacaccgctactcctgcgaccatgcggcggatagggtcctggagatccactgcagccacagcccttgcaacggcgtcgagacgactcctgcgactgcgacgatgactcctgcggctgcggctgcgactactcctgcgaccgcagcgataactcctgcagcgctggtgaggacacctgtgggggccacgcttccagaacgattgaggatctgcatctgcctgcggccgtgcggccgtgcggcggatagggtcgaccttcacctcgacttttttctcccgtgcagtgcagcggcgctagatgcaggagaagggaaagcgagagatatcgaggcgcgcacgctatttggaccacacgcgatagctccccatcgtacccctcagcaatcaacggccggatggagactggtgcctcatggtaccagtaccgcgtgctacaaaagtgaggacgggagaaaaactctaattacgtatattgtaattatagtgtgtaatataattatatctcaaatataaaatatattgtaattatagtgtgtaatataattatatcttaaatattttatatttggaagttttatgacgtgttttgagctgatagcccacgcaccgggactgttatctgccaacccacgaggtcacagctcatctgtagtcttgtttttacctgttcagacagtcacgtgatccattcatccaaggtagtaggaagataaattctccatccctcccatcaaatatcaatataatcttaacacattcaaattcatagtattacaatgtatcatatctaatattgttgagtttttataagatggaaagagtacaagtgagatagacgagataatatagactagcctattgaaaacttttactttgccgtacatgtagtattagttttttattgaaaataattgaagctaagcattgaccaaatttctctcgagatgttacgtataaggatcccatataatctaggagttcttgctaattaactactccctcattaatagaatataaaaagttttaggattggacacggttattaagaaaatagatagaagtgagtggtagagggttataattagatgagtagtgaagataggtggaaaaagtgaacggtggagggttgtgattggttgggaagagaatgttgatcgagaagttattatattttgggacagatcctgagggctattttgggacggaggaagtatagtattcctctgcaacagtatattgatgaacagtgtttggcaatttggaccactgcgttttgatgcacggggattaatactactactgctaaagttaatttcagttatactggcggttgcaggtgatctccattttcgtcatgtcacacgcatgcaggcaccacaccaacatgatcaaatccaatttcccaatctccattcttgattgggagtaagcagtccactccaacagacacaattttatacattcacacacagtgcttcgttgttttatatacatatagttgcaaatatcccagtttcttccacactattgcttgtcaaccccagtagtgctaccaatggcgtcggctttgttcctttggctttcatggcttgtgctctccctcctctccatctacctcctcgatctcctggcacactcccgccgccgcctcccgccgggaccccgccctctcccgctcatcggcagcctccacctgctcggcgaccagccacaccgctcgctcgccggcctcgccaagacgtacggcccgctcatgtcgctccgcctgggcgcggtcaccacggtggtcgtctcctcgccggacgtcgcccgcgagttcctgcagaagcacgacgccgtcttcgccacccggtccgcccccgacgccgccggtgaccacacaaggaactccgtcccgtggcttcccccggggccgcggtggcgcgagctccgcaagatcatggcgacggagctgttagcgacgcaccggctcgatgcgctccacgagctccggcaggaaaaggtgtcgaagctggtggaccacgtcgcgaggctggcgcgcgacggcccggcggtgaacgtcgcccgcgtggcgttcaccaccagcttgaacctcctctcgcgcaccatcttctcgcgcgacctgaccagcctcgacgaccgtggggcgtccaaggagttccagcaggtggtcacggacatcatgggggcggccggaagnnnnnnnnnnnnnnnnnnnnnnnnnnnnnnnnnnnnnnnnnnnnnnnngttcacccg

SEQ ID NO: 21573 - DNA, 3552 bp, Oryza sativa
  unsure (1)..(3552): unsure at all n locations
tgcgaacgaccgcccttcacttgaatccagtaagggccgctgccccacgcaccgatctgcgnncgacggtcgtccacagcccggatcacaagacggtgtcggcctcagcggcatgcgcgcgacggcgacgaagagcggcgggttcagcggcgcgtgcgcgcaacgtcgncggtggtgacggccggacaggctcggacggtgggaaggcaccggatccggctaccgcgacggcgacggcgacgatgacgatgacggagaccgcgatggcgacgacgacggcgaccgtgaggagggttttctttttttggatattttttttggttttttatttttgcgtgcgggcgacataaccaccccgcacgcgaaaatcgcgtgcgggtgcgccacccacacgtaaaaatagtgattttaaagacacttggttccagacagttggaagatccgcacgcgaaaatcacttttgaccgcacagaagaatcatttctctactagtgtgtttagggctgtataggtccaggacctaaagttgtgactccggttggtcctatggtagatcaggcccaatgtgacctggatggcccacggttggtgggccaggctacgcactctaataagtggtatcatagctcaggtttggaatccgcaatgatttctatgggtcacatgggttgatgtgacggaaaagattgttgacaaaagtatgatatttacacaaatatcagatggctacctcctcgtgtgcaaagtagagttttcacaaagtttggaatccgcaatgatttctatgggtcacatgggttgattgacggaagagattattgacaaaagtatgatatttacacaaatatcggacggctacctcctcatgtgcaaagtagagctttcacacgattattacgcgggtaatgctgcaggtggcttatctattctattttcctttctcttctctctcttttaaccactttttaaaaaaaaattagacaatttttccttctaaattaattatacgattcatgattcaatttcatcattacgttcgtcataactaaatctttataaattgattctgcttgattatatttatgagaaaatatataatatgattacagatctaatttaaacatttttatattatacacgaaacaatgagatgtaaatgttggaatattagaaaatactcaatgaaacattcaaagtacaatacgtgcaatatttctgaataaataagtaaaacattagaaaataatgaaacatccgatgacactacatgcaccattaacaaataaactattgaaacatcacaaaataattattgaaacattaaaaaacacacccggtgtgacatttaaaatagatccattataacacaaaacttaaaagatgcagcatagtcaaattctaattgtaacatttatttctcacacgtcaaacttttgttggagaaaagaacggtacaggtacaactgcactgaacccgtcccccaatttcttcttgtaaatacatatagttgcaaatatcccagtttcttccccagtactgcaatggcggctttgtttctttggctttcatggcttgtgctctctccctcctctccgtctacctcctcgacctcctcgcacaatcccgccgccgcctcccgccgggaccccaccctctcccgctcatcggcagcctccacttgctcggcgaccagccacaccgctcgctcgccggcctcgccaagacgtatggcccgctcatgtcgctccgcctgggcgcggtcaccacggtggtcgtctcctcgccggacgtcgcacgcgagttcctgcagaagcacgacgccgtcttcgccacccggtccgcccccgacgcctccggtgaccacgccaggaactccgtcgccttgctgcccaactcgccgcggtggcgcgagctccgcaagatcatggcgacggagctgttctcaacgcaccggctcgatgcgctccatgagctccggcagaagaaggtgtcggagctggtggaccacgtcgcgaggctggcgcgcgacggcgcggcggtgaacgtcgnccgcgtggcgttcaccaccagcatgaacctcctctcgcgcaccatcttctcgcgcgacctgaccagcctcgacgaccgtggcgcgtccaaggagttccagcaggtggtcacggacatcatgggggcggccggaagccccaacctgtcggacttcttcccggcgctcgccgccgccgacctgcagggctggcgccggcggctggccgggctgttcgagcggctgcaccgggtgttcgacgcagagatcgagcatcgcaggcgtgtcgccggagaggagcatgggaaggtgaaggacgactttctgagggtgctcctgaggctcgccgcccgcgacgacgacacggcggggctcgacgacgacacgctccggtcagttttcacggtaaggacatgctccctctgaccaaaatataaaaacctcgattttctagtgaatctgaataatctatccaaaataatggtaaatgtcttgtagaattttaggttcttatattttaccacgaagagagggttcagctttttcacatgctgaaacgtctagcgagttccattgtagctactgtaggtaaacagaaacagcaatagttaaattaggtttgctgtcaatgtcgcatacttccgttttttaacccatattgttgttaacttatcgttgttgaatttagttccacgtcggtaattgataatgggatagcacaacttaaaaagtgagggcagtaattatccaagactagtctcactagtactagagaaacaattttcctgaatgagctatttagtttacagacgaacccttaagaagcctgtaggtgaaaatcgcatgccaaaataaaccgattttcttatttttgcatgcgggcattgttggcctcttaaaaatatacttacaagtcaatccttcatcctcttttccctcctctacacttcaaaattcaaaatttcatcctctttttcctcctcaacacttcaaaattcaaaatttcaccttgcgggcctcttgaaaacatgcctacaagtctatccttcctccacttatccctcctcgacacctcaaaattttatctcatccacccatccacgtcattatcctttctatcctctctctcactctctatcctcttccactctctcacctctctctcccgcggccggcgtgggcgcggccagcggcaccgcgcggcttggcggcgtccttagcggcagcgaccgagagcggtgagctcggcagcgtgtgcgcgccgctgcggacgaccgcccctcacctgaatccagtagaggccgctgccccacgccccgatctggcggcgacggtcgtcccccgcccggatccgaaggcggtggcggcctcagcggcatgcgcgcggcggcgaccgagagcggcgggttcagcggcgcgtgcgcccancggcggcggtggtggccggcgggcaagcttcgacggtgggaggcaccggatccggctccgcgacgggacggcgacgatgacgatgacggagaccgcg

SEQ ID NO: 21574 - DNA, 1729 bp, Oryza sativa
  unsure (1)..(1729): unsure at all n locations
gagcaatggaggggaagtgttcacaaagccgggttcnacggtatcaattagcccgaaaagaaaaaggtggagaagtgttggaccaattcgccggactggcgagaaagggcctgacgttaaacgcggccggagtggggttcacaagaagaataaccctcctctcccacacaatcttctcacgcgacatgaccagcctcgacgaccatggcgcgtccaaggagttccagcaggtggtcacgaacatcatgggggcagccgaaagccccaacctatcggacttcttcccggcgctcgccgccgccgacctgcagggctggcgccggcggctggccgggctgttcgagcggctgcgccgggtgttcgacgcagagatcgaacatcgcaggcgtgtcgtcggaaaggagcatgggaaggtgaaggacgactttctgagggtgctcctgaggctcgccgcgcgcgatgacgacacggcaggcctccacgacgacgcgctccagtcaattttcacggtaaggacatactccctccgtcccataaaaccccattcctaccatctgtggcgaatccaggcctatttcgtggagtcgactgacccacaactttttaaaaaacatcgtataaactttgattttcatgtataaattcaaaagaatttagagaaatgaccccacttaaatacgaatcattagtaattaacccagaagcttaaatttttagctccgccactacctaccatctcaagaagagattagtgaagagtaaaaaattaaccaaaatacgtctcattattgaaaaaagtagtaatgttgatggtagataaagggtatttaagggagaaaatttctcgtcttatgtgccgaggttagatagaatattagaagttggtttttttgaataaaattcaaatttcagaagttgagttattttaatggaggaagtacatggtatttcctctgtccaaaatataaaagcctcgatttttttagtgaatctaaataatctatcgaaattaatggtaaatgtctcatcgaattttatgacgaagagggtgttcagctttttatgtgctgaaacgtctggcgagttccattatagctagtgtaggcaaccacaaacagcaatagttaaattaggtttgctgtcgatgtcgcatactccgttcggttttattttaattgacattttggacaatgatacggtctacaaagataatatatctttgaccttatttttctattataatatatacaataaataaatgcatgtataattttattatagtgttttgaaagacaaatctatatatgttgttctagtttttttaaacaaaatatttttaaagttattgatggtcaaagttataaaagtttgacctcaaccttgtccaaagcgtcaattattatagaatcggagggaatactcgttccttttttagccgatactgttgttaacttattattgggtttagtcccgcatcgataattaatgatgatgaagcataacataaaagatagggggtagtccttacctatcagatagtcttttgggctgtgtaggtccagaacttaaagttatggctttgattgggtctgtggtggaacaggacgatcatacatcaccagtccttaactttttcaaatcgttcaatttacattccttagttcaacatcttagttctaagaaatacgcatgtagctcggaaatcttaattccgtatctcttcaatatn

SEQ ID NO: 21575 - DNA, 5912 bp, Oryza sativa
  unsure (1)..(5912): unsure at all n locations
cgcgtgccattgaattgactaacctcgttgccngcacgncgactctagaggatccccaaacccattaccaatggctaaagcatgcgatgaactgcaacgagttattggatccacaagaagaattgaagaatctgatattggtcgactgccctatttgcaagctgtcatcaaagaaacatttcgattgcatccacctgttccatttttattaccacgtcaagctacaacaacaattcaaatattgggctatacaatacctaaaggtgcaaaagtgtttataaatgtctgggctatgggtcgagataaagacatatggccagaggcagagaagtttatgccggagagatttctagaaagggcaactgactttaaaggtgcggattttgagctcattccattcggagctggaagacggatctgccctggattgccattagctgttaggatggtccatgtggttcttgcatcactactaattaatttcaagtggagactcccagtcaaggtcgaaagagatggagttaatatgacagaaaagtttggtgtaactctagcaaaagccattcctctatgtgctatggccacatcaacttgagttagaagccaggcagccacttcactggactgctcaaaaacattgtatcaggtatgacaatattttgctgtccagtggtctcttttaccaatcatgatggaaacggattgtcaggtttctctgcagttgcttcagtccaaggagaaggataggtctgatttggcatatgttatcaatgcagtcaaggatcttatgggcggtgacagggaaattctctttagtaaagtctgtcgtagtcaaaaccgggttagccaatgtttagcgaataaagctcggtgtgaatctctgtcaggcctgtggccggataatagttgtaatttcatttcatggttagcgaataaagctcggtgtgagtctctgtcaggcctgtgtttgagtaatatagatccttttccccgaaaaaaaaatgtatggcaatattagatgattaatgtggaatattgtaataaatcattacgtgtatttgtggggatatattgttccaataggataaataagctgagatttggatatttactttttcttccacttgctaggaaagcaaaaaacaaaaaccacaagaagatgaacacgacattaaactaattgtataagtggaacgacacggcaaaagaaggccaacatataaactatacagtgtagctctgaatattattttttacaagattaacaggcagctctgaatatttttcgagattaaagtgtgcacatagtccttaaacttattcaacattctaatctatctccccgtactcttaaaaaacggatttacgtatcacaacttgttaaaatgcatcattccgttttgaattgccataacttctctgcgattctacgtggggttgagatgacatgccacacaaacactaaagtggtatcatcactaagtctacactaaccgacaaataagacccgcctagaaaatttctttttatttttttccttctatgttttttcctttctttttcatctcctttttctctcttcagctgcagccgccaccaccgccaccaacctcaccatccttccttctcctagggtgaggaaatccaagtgtgaggaagcccatgttatgcccaccaccgcaaagctccacacccccgccaccacaaagcacggcctcaccgattatgtcgctagttgtgataatgaagcccacattcaagataacaagtggccacctagctgagctcgagaatgttggccctcggtgcgcgctcggttgattggcataagtccgtcgacctctgctgcctcagcgtactcggcttggtgcctaacgagcatctcctgctccagtttgtctatctcctcggtcgtcatggcaaccttcgactgtagccaccagagctcatcatgcccgctgcctatctcaccattgccgaacacgaaagtgtagaaaccctagctcaaccgccagagagaaattgctaaatctgtctgtaccgttggcctcctccaaaactaaaggtacaatcactttctttataacacttccaccgtttcccatctccttcccattgtaactgttgttgaatctcacctaatcatcgcgaggccgtgtcagggggctccatgcatgaatattttccatgtcactcgtccatgtcagcgccggagacaagtcagacacgtgggtcaccctgtatttctcagtgattttgcaaaagcgccccactcttattcacattttgtttttttttctcacgatgaatcagtcacctgaggaattgagggcaaaggtgaggtggagtggttgcctgcctgaggaatcaacaacgaagtaaaggacgatggcaacttggcgatgccttgaaagtggacaacggaaatatcgctccactgagtggcgttgacgtggccaatgtggtggtgtcacatatagcctacaagcagccagtaggcgcacgcatgggcggggattaccaggaggccggtggggaggtgcccggtagatgaaactgaccaggcggctgcgtggggcgtgcttcaatgtgcttttgctgaactagtggtcggagtcgaattgatcgaacaggcaatctctgaatcttcttttgatttgcgaagtaggcattggccagaatctttttttatttattcctaattaatacacgaatcataattacctctaaatttattcctagttttgaataaactagcagtatatacatatttctagatggttaattctatttattttgaaagatacttttaacaccacaaaaaattacttctatttttctagagagttacttcatctaccaatatagctacttctgaaactgtgaagaattacttttaataccgtgaaaagttatttcgattcttctagatttagagtgaagagttagttctatttttatttttcttgattcagttatttttctttagtaatgtacttctaatactgtaattattttcttaattctataattattttcttagagttatttgtcctttgctctataggtacttttaatatcatcaacattaattattttcttaatactgtaattattttcttagagttatttttccctaggtatttctaatatcgtcaacggttactactattctcttagagttactttcctatattatgaaaatatttttttcaaaaaaaatatattttaaaataaagataataattgcatttactcgtgaatgttgtcaacattgtacttcacaaagtttcttatttcaaaattgtccttattttcaatgaaaagaagtaaattacttttgaatgtttaaatatatttaacattgaactcgttttgtcatatattttgaatggagagctatactttaaatggattttacaataatacacgatttaaaaattataaatcatggaaagttgaaggaagccataaaagaaaggagctagtgaattggttggtgttagggcatgtacaacctaaggcacgggtagtagtagcctcatgtgggccataccacctaggctacacaaaggaatctctgtctccaatggaggatacactcaaataggtcctataaaatcaaagggtactataggaagatattacatcccacaatgggtgttctagcccacaaaaccaccagtgttgttttactctcctaattttattcggcgatgcctccgactcatctatttccacctctttctcgtcgcctctccacctgccccagaacgccgcctctgacttcgtcggttcgccccaccgcgccaccgatgacttcgccacactgcgccaccgctgactccgccacaccgcgtcgcccacaagcttccgccgctctctctctccctctctctttcaaagtgtgggagcagcggcggcgaggcccacgaggagcacgagcaggaggaggacgcggcggccgcagcagcggcggcgaggcccacaaggagcacaagcaagaggtggcggagtgagatccagtcggtcttcttctccaagtcgtcaccgtctctctctcccttcgcccgtcatcgccggatctggtaggtcacgcctcctactccccaccgtgctaccgccaactccgccccaacacgccgctgagggtgaaaggggaaactaccactgcgagagcgggaccacaagcgcaaggcttcgccacatcatcacccaacgcgaagccccaagctgtggcttgacgaaaagtagtcgaggagcacgtcccaaggagaggaggaggcgaaaagaagtcaaggagcacgtccctcacaaagacgtcgtggctctacgctggccgctggggaacacctccagctcgaaaaggtacggcatttgaacggcgtcgccagggataggcccttggccccatatccccatcacataaataggcatcctgtggaaggttagtagattgttggtgttagccccatgccccatcacataaataggcatcctgttccacactagagcttctcgatacagaagatcacatgtgcccggtacaactaagaaaatagctataggccgtgtttagtttcatttaaaaaaaataaaaatttaaagtatactgacacatcaaatgtaattagactcaagatgtgcaattgattttattttcaccatgcatacgtcaaatatttaatgtgacagaaaagttaaaaatttaaagggaactaatcacagccataataacaaaagccatactctctgtattaaagatccaacaggttcagagaacacgcaagctcagaactacacatcaccaaaattggagcaagtttgggggtacatatccgctcatacagtggaggatttatttctcgattctacgagctttttaactagagttcgaccgggaagtcaattacggatagaaatgagcatcctgtcttcaccatcaagtttagtagggctccacgggtgcgcggaacttggcaccagcgtagacagcagccgcaccaagctcctcctcaatcctaagaagctgttgaaataagaaatagcatgaattagtataataattttacccctttttaatgactagcttaagcatatgcatggattcgttaacgcctgaacaaaaatatgcatgaattagtggacagtattaactgaactacccattaacgcatgaaagcatctgagaacaaaaaaaatcatgcttgggctaaagtaatcattcaagtctttcagatctaaacagcacgtaagaaatgcagatagaggttggctgggtcagctgattggttttatacggtacaaaatatgaaaaactacttgcctggttgtatttggcaaggcgctctgatcggcagggtgctccagtcttgatctgaccctgtttcagaatgacaaagatatattcagccctcacattcagtacaagagtaacaactaatacaggatgccgtaaagttcactacagtgaatgtagagcacagaatcttaccgtggccaaaccaacagccaaatcagcaatgaaggtatcctcagtctcaccactgtggcaatgaaacacaagtcaatatacaaatggttggtagtcagaccaggtccaccaggaataaagacaggtaagcatatcagtatacctcctgtggctggtcatcacaccccagccagcacgctttgacatcttcacggcctcaatactctcagtgacagatccaatttggttaacctgttgaaagacaagggtgatatattcgcacatggaagataaactattaaacgtgaaggaaagaatcaataganccataccttcagcagaagagcattgcatgacttctcctggattgcctttgnnnnnnnnnnnnnnnnnnnnnnnnnnnnnnnnnnnnnnatacgattcttcaatcccgttgccg

SEQ ID NO: 21576 - DNA, 4634 bp, Oryza sativa
  unsure (1)..(4634): unsure at all n locations
gcgcggcttttgattgcgattttgagatcagctcggnacccgncaataaaaaacattaacttatgcaggaagataaacaattaattaatcaaagttcacaaaccttggcagggtatccagcctttttaattgcagncttcaagagctcaagaccctccttgttttcctgcaatatcacacaacacaaacgattcaaaccacatgctaagtatattcatttagatttctaattacggattagcttcatacatcaaaacagaagttatctcagcatctaacatcaagccaattccaagcaaaacagggaaacattattgaagggaagcacttcacatggatcaacagcatagtggaaagaaagataattgaattcactgctgcaggcataagtacctgaatgttaggagcaaaaccaccttcatcaccaacattggtggcatcctgaccatacttcttcttgataacagactgtacagataaaattaattaattttcaatgacgtaagatggggaaaaggtttaaaatgaagatgaaagaattaccttcaggttgtggtacacttcaacacccatcttcatggcctccttgaatgaagcggccccagtaggaaggatcatgaactcctgcaatatagagcacatcattaaataactttatgagcaacacatagaatgagaaaatcttagttcagatcactgcctgcatggcaagcttgtttccagcatgtgatccaccgttaatgacgttgaatgcaggtacgggcaaaaccagttgcttgtttccagcaaggttggcaatgtgctgcaaaacagaacatattatcagttggcaaattcataaacgaatagataagagggcaataaattgcacatcttaacatgcagcaaacctggtacagaggaatcttcttgatgatagctccagctttgcaaatggccagtgacacagccaggattgcattagcaccaagctgcacatattgataaaagacttagtagaatccacttacaaatggtacatctacaattttcatgactaaggcccatgaccagatggattagataataccttctgcttgcaccacccccactcatttttggttccatcaagctgctgaaccatgaagttatcaagctcagcctgtgacgtagggtcctgcagaagaaatagagcatataatgaattctggatttagtctcaaaatacaacagaataggtgaaccatgagacaaaccttgccaatcagagctggggcaataaccgagttcacattgtcgacagcctgaaacaacagaaaaaaaatgtgaagaaacaaaaacaacaaaaataaaacattgtaacaggtaccagaaacaaattgattttttataacccatgaaacaagtatacatcatgatgcaataggaccagtatagcaagttgactaatttatttaagcagttaaaaggtggacaagtcataattgatttgactttgtctttttttagtttagccaagacaatatgactttctcatctgccactaattatttgatagagagaacatagaatctgaactcttgagtagtttaaattatagcacagcaaggaatgcaactaggaacatgctcccatggctacaaggaatttaaccaaaaatagcatttgtttggattcaatctccgatgctaaaatagatattatcaatagactcactttaaatgctaagagagcttgatgctggtgaagcaataacattgaataagggcaggatgttttatgttaaaaaatcaactgatctcttacatagttaaatatctaaaatagtttgcaacataaaaagtatcaaaggcaaaccttggaaacaccctttcccaagtaatcagatccaccgtccctcaattcgagagcttcatagacacctgtagattatgaaagagatgagattagcttctagccaaaccataatcacatcatttaagataatgtgaaaccatggttatgagcaaacaaagcaaaaaaaagaacatctaaataacccaccagttgatgcaccactgggaactgcagcccttgcaaaggttccatctgagcagcacacatcgacctgatgcacatatgtatcataaattatactagcaaccaaataacattttgtcgcaacagcatgaaaacaaaatgaaacatttactgtatacatggtaagagttggatttagaactatcgacccacatcacaattaccacacccacggtcaacaatgcttcgacaataatgaagccacgagcaagtgcaggacccacagatctgtaccatgcatccttcaaatccgtagaaaaatgtatgacaggtgggggaattcgtgcacggcgcagcatctaattgatctaggcgataaatcaatattcgcattaaatctaggcgataccttaaccctcgctttaaatccaacacaacagtcgttcactgtctccagatcccacctaccctccacaaaacccctcgcgaaaaggggttaaaccctgcaccaaattccgcaaacaaccccgcaaatcgcctaaacccccaaacaacctcgccggaaaaaacgaatccacggtcatcgcgacggcctcagcgccccccaccccgcgagatcgacggaatcaccacaccggaacggcccatctggccagatcgaagcagggaggccgcgagaggaggaagagatcagatcggcagcgggagggagagagaaagctcgtctcggcggcggtacgtacctcgacggtggggttgcccctgctgtcgaagatctggcgcgccttgacggacacgatcgtcgccgccatgggaggaggaggagagcttctagaaggttctagcagcggaggaatggaggaaggagacggggttggtgctaataaagtggggtttcgatgaatgcgagacatttagggcagaccgcccatttataatggagggtggtgagttggaagcagccctaatagttacggtcacgaggagggtcgacgtccagtgtcgctgacagtgggcccggtttggggtgggattggggtgtggtcccacgtggaggtggggttgtcgatgttctcgatgcggaaacttgtgggcgtgatggaaatcggcgccgccctcgcgtcgcggcccgccgatggaaggaggtcttcgccagccgtcggattttgaaaagttgggagagagaggagagcaccggtttcctggctggtctcgttttttttttcttgcttctaagcggctgagggggtcgtgccattagtacggtgggtccagccagatgaaagcgatggacgcgaaagccgaatgaagccctggcgcattgggcagttgacaagggattgagaatttgaaatactcaacggtatatttcaccgcgcttttatcacatggagccaacaacacattagacttatatgttagtgataaaagcacggtgcattgactatagaggatcctgattcgttgacaaaaagatttaagcattattagggaaacaattttaatcatcaaatcaaaaggaatgttcccttgtcatctgaaaattttgataagaaatattaatgattccacgtatactcaaaagctcttatattttgggacagagggtgaatgtgaatagtttttttattcatgtgtttggtcatggccacatattttttagacgatcaacaactaatcagtgtgttcgtttattagcgcatgagtaaatagcatcattgcaatctccacctatgcatgcgcctaacaccgaagtgactccacacctttatcgatgagatttagtttcaaaatgaagagggttttgttgagttggtctcagcatgatttgtgaatagaccgaagggagagttgttgcgtttgttgacaaatgaatcaatataacataggttcgaatggtatgtaaaggtacatccaactcctgttagaacaaataagactagaaaagatgtctaataacaacccatggaatgttttaaagagtgaagtaaatgaacagtacataaacttaagcgggtgtgatatctaggtcctgaactctcaaaaatatttttagtgcctaaacatgttttgggtgttatgcaagttcaaatgggtttccgtaaactaacgtggggtgccacgtagcatctacatattagtgcgatccacatgtccgtcacaaattgaacggttatacttcatatcaaagtgggtccagtagttgtaaattgatgataacatggaaacatgtggccatgtggggagaaatagaaattatttaatactccctccatctacttttctacttttgatagttatatttccaaatctgaaaaatttatttttgataggcatatttcaatccaacaacttatcatcttaatggctttcttgaatttaatgcgtgactcttcattcttccacactagattggctacatgggcatcgagaaatgtaaatattaatgaatcgtttgtttacgaggaatgactagtagcatatttaaatggatgataagtagaatcacttattcttggtctatgtgctaaaatgaaatatgactatcaaaagtagatggagggagtataacttagnnnnnnnnnnnnnnnnnnnnnnnnnnnnnnnnnnnnnnnnaggttaggcatcaagggcag

SEQ ID NO: 21577 - DNA, 738 bp, Oryza sativa
  unsure (1)..(738): unsure at all n locations
actgtgacctctnnnnnnnnnnnnnnnnnnnnnnnnnnnnnnnnnnnncattcaggctgttctggctcttgtttttccttctcccgacactggcgtagttcatcaagaacaaacgcaatcgtcgcgccactcatgtttccgtactcacgtagaacttgacgacttgctgcaagcttccacggctgtagttagagctcaccctctatgttgtcaaggatcatgcggccaccggggtgtaccgcccaaaagaggtcgttccatttaggatctgtgtttccgaccgaacagaatgaatggagcaagctcttctggatgttatccctgatcagcgtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21578 - DNA, 3902 bp, Oryza sativa
gcgctgagacctactttctcgcctgcctgcaagtcgactctagaggatcccccatgtctctttgttagcttggggttataacatgattagagtttggactaggaattacttagccatgcttagttcaactagttcacaatggggaagatcttattaatgattagactgttggttctaatggttttgttggattagtgccaccgctttggtggtgcatggttttgctggtcgcacccatggcagttaaggaccggttcgcgggatgccctggaaaaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggacttgcccgctgccttgcgaggagtgggggtgaaacctgaggtgtggtgtgcttggtcagagggggttatgcgaatggtcctgtcacggcctctttccggtatgtcgtggtggcatgtcggcgcacggaaatgtgtcgtggggctgtgtcttgtgggtacagttgtacatctctgatcagagtaaaactattcgaatagccatgcctgcggttatgggcggtcaaccagattcaccgtgattagtctcaccctagtgtaatcttttgaaattggatagtttaagtggatggttgggcctgtcgcaacgtgggatagcgttggacagtggatagttaatattaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctaattttcccaaccccagagcacgagtatgtgtcagacgaaggtttctccgaggagtaggcttcgtccgtgccgtcgaggatgcctgtggagtggtgttcccgctgcagttctagtcaaggcttagcttctgttgtctttctttctttccgctgcatttatgtaagacttttatgatgtttgtaagacgtggatctgaatgtcaacattgtcgtctgtgtaccccggccggtcctggacggggattttaatgcacattctgcttggaattctattcgggaatttctgggcgtggcaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaaacaagtcagtccagggttttagtaaaactgttgagatttattcgtcagtcagttgggatttgatgggtgaaatgcattaggtcctagctcaagaacatgggtagcaaggtatttatgctcttattgttattatagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccactcacccaaccaccgtggagaaggcatgatcgactttgtggcagagttggcacgtatgacactggtggtgggctaccccaacgcgccagagtacacgacggttccaccgctcagtggcgagcttcctcaccgtgttcgcttggaggtccacggctacgtgggtacctgcctagctaatatggtggttgaggcatctggaggcacagcagatcacgcctgtcaggaggcagcatacctgatgatggccagactacgggagcgccacaactacatcttccacgacacggcgtaccgatttcaccctcgtcgagccagtggtgatgatgtcagtaccttccgtccgacagccggcgagaacgacaccacctttggtcacatgtgtgctgtgatgagaggattggataggatgcactcggacctgcacaaggcgaccaagggccttgaatgatgggaagctcatgaggatcgtcgctctgaaggacgagatagcgcgcctgaagagggagaatgctcagttaaagggtcttcccgcgccaggaggagacgtggatctgaatgtcaacattgtcgtctgtgtaccccggccggtcctggacggggattttaatgcacattctgcttggaattctattcgggaatttctgggcgtggcaccgaacctatataaaaatccatgtctccatctcttttacctcaatctcgcatatatcctagtaccaacgatccccatattatgcaaataccggaatcgcgacatcaaacgtcgatagaatctttcaactcaaatttaagttgaaagtttttgaaatttaagttgaatgcttttgaattttgagatgaaaattttcaaatttaaattgaatgctttgaattttgagatgaaattttttaaatttgagttaaaagttttcaaacctgagttaaattttcaatctcgacttgattttttttaaatttgagtttgatgttttcaactctgagttaaaaattttcaaatcttcattgaaagtttttaaatcggagttgaaaatttcaaaaagttcaaaatctttagcttgaaaattttcaaacccaagttaaaagtttcaaacattaatttgaaactttttaaatcctgacttgaacgtttaaatttaagttggatgtttttaaatctttgacttgaaaatttaaattttaacttattagttttcaaatctgagttgaaagttttcaacgagtgaagagaaagtagattggataaggtgtacgctgcttcgctcacttccgtatgtctccttcaaatagaaacccctataatcgcagctactgggatgagggcctgtttagatttcttggcaaaattttacaccctatcacatcgaatgtttggacacatgcatggagtattaaatataaatgaaaaaaaaaactaattacacatattgcgtgtaaattgcgagacgaatcttttaagcctaattacgtcatgatttgacaatgtggtggtacagtaaatatttgctaatgacggattaattaggcttaataaatttgtctcgcggtttataggcggattctgcaattagttttgttattagactatgtttaatacttcaaatatatgtccgtacattcaatgttacaagctaaaactttagcagcatatgccatgctagccttcgtactactactttgtaaggaatttttttttcagattagagtttctatctagactctattttgggcctgttcactttgatgccattttcaaccttaccaaattttagtaaagttaccaaaaatatggctacatttaatttgctgccaaattttgttaactatataagaaatccttaccaggttttttttagcatcaaatttaacaggcgcttggatactgaaagattggaattcagttttctaccctttgcgaatttgcgaatcagaacagcaaaaacctaagcaaaccctagctccggcgatgcctcccgctgccgccgcggaggcggagatctccccgccgcccccggcggccgacgggggggccatagcggataccgcggaggctggtgtcgcggctgaaaaggagagtgacgggatggaggtggaggatcgcggcgaggtggtctcccaggaggccacggcggtgaagccggatgaggcggaggagcccgaggaggatcttgg

SEQ ID NO: 21579 - DNA, 6517 bp, Oryza sativa
  unsure (1)..(6517): unsure at all n locations
agatgggnntttggannactgnnnnnnnnnnnnnnnnnnnnnnnnnnnnnnnnnnnnnnnnnnnnnnnnaattatatatggtgattaattgctgcgcgttagattttacatgccaatatgctagtctgcaacaaacaatccatccctaaaaaaagaaaaaaacaatgaaagaatcttaaagcggaattgctaggcctcttggctgttactaagtaattcattatctgataaaaaagcaaaagcatgaacttagcctctaatatccatttatttgtaaccacagatttacctcgccactataatttcgattcctaaaatcttagcatgttatatactccatcggtctcaaaataagttatttctggagttcaaaatttgtcccaaaatatgctgatttctatccatatttttatactgggtccacaaatagggcatttctatctattcaataccatttacctacctaccgtattaattctcttcatactaatttgaatcccgattgataggaatcaatttattatgagaccaagggagtacatcttgtgttccgccggtgataaatggtagacgaaaaatactatattgtccaaatatagatatgttgatatgatttgttatccatggaaaatgattgaaatttccatgtattgtcatgctaaatttctactatcatcgtcagtcggtatgtaaggaatgttgccccctgcatgtttaaatcctggctctgccactgactcgtagttggaactgataaggttgaggggctattcagttgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttgttcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattgtttcttgtgccctaccttctatgtccaactacccaatagttatagatgggtcaccttttttcctttgatactccagacatgaaggaaatagctgacaaggattctgaagaagctcaagatgaagataaacatggggataatcataagggtgaagttgctgaccaattgagcaatgatgaggatgttggtggacgtgaaaatgatgaatcaccaaatgatgaactcgacacctcattgcttgtgctggattcagttccagatgggaatgacaaaacccttgaattatttgtcggtggcttgcctaaggactgtgttgaagaggacattagagtggtgttttctcaatgtggagaggttgaatctattagaatagttaaaaagagaaagcgcattgcattcgttcgttatgcagatatcagtgccacaaagaaggctcttactgaatttaaggatggaatcaaggttttgattttatgatgctttcagtcctttgaatggtttgactttgaatcagtcgttgcttatggagtaatgatcgtattccctctttcatgttttcgttaggtaaatggcaaaagtgtcagagtatctgttgctgaacctcatagaaaatctagtgagcagaaggctcttacgaaggtaataatccagtgccagtttagcatattaaagttgttctctgaagttctatttttcttttccttattttattccttcaacgtttttttactagcacctatttgaaccattcaatggactaggctttttagtggaatcctgattcagaaacaacagttcaagcgtcatgattgatgacggcatagaaagccatgagagcattggtggggagaggaatgttttgtacttaaataaaacttaaaacattctttctagtgctttggcttggaagttattttgcgcttaatataaaacataaagcatgctattttttcttgctcatattgctatttctgtaggttaaaacagtatatctggaacattttcctcgttcttgggatgagagaaatatcgaagaatgctgtgaaggatatgggaatattcaaaaagttaacattttgcggtcaaaaaagaaagttgtttcttttgttgaattctcatcacggaagagtgcgttagcttgtgtcgaaggaataagcaaggccaagatcaatgatagggaagttaaggtattttatatctttactcataccactgttgaatccaatccaagtaccacttttgctttctttgttttacctaatttggctgacatggcttttctcactccatatctagttggctgcaagtcttgctcgaccacaatctaaagttcaactggccaatgagagtagtaagggtggtttcaatgtccacagtggtgcaacttctaaaagtcctgataaatctaaaatgaaaaaggaccagacagacgagactattgtgaagaaatcacagcttaaattgttgaaaggtgatgagagcaagctgccctccaaagatgatgtggaagtgccacaaacatcaacccattccaaaggaaaagcgaaagttggaaagcgtcaaaatacatctatagatgaaaggccatcaaagaaatcacgggagagtggtatgttctctctgtcaattctatgatgtgaattataatgtgaaatagaactcaccacgttaatttctgaaaggtgagagcaagctgacctctcaagatgaaggggaagtcgggaagagcaaaagtaaatctgtaaatgaaaggccattgaagaaagcatcgaaaaaccgtatgatctctctgtcaatttcgattttaaaattatttgattaaggaagtggttatcaataataattcaccaatgtaaactactgaaaggtgatgacgttaagctggcttcgcaaagtggtttggaagaaccacaaacatccaaccgttctaagcgcaaaaagaaagtccggaagaatagaagtacaacttgtaatgaaagaccagtggagaaaagcatgaaagaatcgtatgttctttctgtcgattcttcgtttaataagtgttgaataatggattgtatttctgatactttatattctgcaggaaatattaagcattctgcaggttctcgatatgtaactagccaccaagcttaccccactgtgggtgcaacttccagatctaaaccacattcccatgatttggtagtatagcacttcaagtttattgatcttgagttattgacattcttaattctaatgaacattattcttgcatgtttgttttggtcactgacgtgttcatgtttttaggcacctcatgctggattcatccctccttcaagtcgtgttcaaaggactcctgcacgtgatcaccaaaggttcattttttttttcagcttgttacttctttggttctgatcagatctaagcctcttactaatcctattatttccatgtttttgcagaactgcaccgtacaatatccgtcagatcagtggttctccttatgctagaggtacattgttgaaaatgattcattctgtttacatatgcatgtattaatattttagtaattatcccacatagtatgcattatcagtgagatgagttgcatctgttttgttatctttgtaataatctttgttttagttttatctggtgttattttcgtaattctattttgttgacaaaacttatcgtgggtctacctggcatatggtagactgtttgacaactgcaattatatacctggaataatttacgctatggagtacctacttctgtgtcatgccctctgacattccttttgtgctcttgtccacaacctgccttgccatggtcttgttgtggccattttgcttaggctagtaccagagtctttatcagtcacacatatattgcaattgaagtcttacaactgttcagtgtacaattttttgcttagtctggctactaagtgtactatatacataaaacagatgttcagattctgtagaagtttgcaatttatacaataattttagaagctagcaaagcttgtggcaccatctaggtttgtgaaccctcaagttacccttctatacaatgggcccttttgattaatcgtaactctagtttaatactctatcactgcaagggtcatatgaaccataatcatggaaattttccgctgaacctagcatcaaaagaaaggaataagtacatttattccctccttttgtttgagtggagttcacccttaactataagcagtcaaacttccatctcataactataaattctgccagtgtattatgtgcacaacaagatgggactcccagtttggtactagtgaattgatattacttgaaatctttgtagtctgtcattagttgtcaagaagatgctgcctaagttataactttttcacaactcttataatttgtagtttaattttcgtttgttccttttgccagaaagagtagctccgcgaccagcatattctgttcacacaagcaatgctgctggatacgaggtatgttgattactgatgttggcatgcttgtttaatttacactagaatatgagctagaattggttaagagtcaatatgaatacagatctctagtgcccacatgcacctcgtttgaaagtttatacgtgattataaataaaagatacctcctgaagaagttactaacatttatagtttctactttctggaaataatctttactgttctgcagtaaatgtattgcattccaacacaggaaattgcatttaaaccagatgagagatacagttcttgttacctatcaacttctaaataaggacaaaggctctctttggatgtttttttttccttgaacacgcaagagactttggatggttattggggctataaaaacttcttatgccacgttagaaatttctgataactttggtgatgcacatttaattattcttttacagcacgctagtaatttttctaaatcagctttgacaatcttttggaaattatatcatcatattggccatgctgatttttcctttttttttgttttttttttgtgatgcccttgcaggctggatatgcatacacctaccttcccccaccaccaccaccttcacctagtatatcttatcatccacctcctccggcaagtatatcttatcatccggggagtggcccatacatcatacgaagatactactgactgaaaatccaggtggctacagcagtcaacatgcctcaccatggtctcatggtaacatactttacagctcagtggcaaccttgatgctggaaatgtacaagtttaattgaattgtagatagttttgtttgtttctttctttgtgaaatcagatgtacatgctttggttgttcagttcaaaaatgtcgttctagggaaataagaacctgtgccttgtctcgttggctattaaaaaaggggtgaaaataataagaaatgcagaatgtctgttgttaagcatgatttcttggagggggcacagcgtggaactatttgtttgtaaattaatctttgactgtacgaaatcattgtccactaacagtggtcaaattagcatatactaccaaaccacgccctatcaacacagtggtagattttgtttgtggaatatgactactcaccattaaaaaaaaagaaaatactgattggattgctacgtatacgtcacgtaggataaaaccgctctggattgaggtaaggggggtaatttgtccggaattaaaagttcagggtaaatgatgtctggttttcgagtttagggggtaattcgatcaaccacgatagtttagggggtaattcgtactttttcctataaaaaaataacgttactacgtgcaagatattttcttttatccttgtcatttactttaatataaaaaaaagagagtaaatttcataaaactgcaaatattttgtacagtctattataaaactacatatttaagaacttttccacaaaattaaagattcagtggcttcatttatcacaaaactacaggtactttgcacaatatatcacaaactacagatttaagtacttttataataaaactacatatttaatatcttcatttatcacaaaactacaagtttagtgttttcattatcccaaaactacaagtttgagcattgttaaaaacatgtagttttgtgataatagagacaataaatctgtagtttcgtgataaatgaagaccctgaatgtgtagttttgtgataaacaaatacccgaaatctatagttttgtgaaataaattcttaaatgtagggtacgagctggaattcaaaccacgcg

SEQ ID NO: 21580 - DNA, 706 bp, Oryza sativa
  unsure (1)..(706): unsure at all n locations
atatgagacctatnnnnnnnnnnnnnnnnnnnnnnnnnnnnnnnnnnnnnnnnnnnnnnnnnnnnnnnnnnnnnnnnnnnnnnnnctgagagatcccctcataatttccccaaagcgtaaccatgtgtgaataaattttgagctagtagggttgcagccacgagtaagtcttcccttgttattgggtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctaaaatccatggctctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgcn

SEQ ID NO: 21581 - DNA, 1900 bp, Oryza sativa
  unsure (1)..(1900): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctcattctatgtgttgctcataaagttatttaatgatgtgctctatattgcaggagttcatgatccttcctactggggccgcttcattcaaggaggccatgaagatgggtgttgaagtgtaccacaacctgaaggtaattctttcatcttcattttaaaccttttccccatcttacgtcattgaaaattaattaattttatctgtacagtctgttatcaagaagaagtatggtcaggatgccaccaatgttggtgatgaaggtggttttgctcctaacattcaggtacttatgcctgcagcagtgaattcaattatctttctttccactatgctgttgatccatgtgaagtgcttcacttcaattatgtttccctgttttgctttgtatttgcttgatgttagatgctgagataacttctgttttgatgtatgaagctaatccgtaattagaaatctaaatgaatatacttagcatgtggtttgaatcgtttgtgttgtgtgatattgcaggaaaacaaggagggtcttgagctcttgaagactgcaattgaaaaggctggatacactggcaaggtttgtgtactttgattaatttattgtttatctttctgcataagttaatgtttttgattgactgaggcttgagactttttttgcaacctgatatggtaggttgtcattggaatggatgttgctgcttcggaattctacaatgacaaggacaaaacctatgaccttaacttcaaggaggaggtaggtggcaatctgtttcatttttgatagtagggattggctcactgtttgatatcatgtagatgtatataatgctgtgaacttattgggaacatttgtgattctttttgttgtagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacagtgagtgcatagttttctattacttctaaatatgatctctctttcagtgtggttgataattaatattaatatatgttatgcagagggtggcaaaggcaatccaggagaagtcatgcaatgctcttctgctgaaggtatggttctattgattctttccttcacgtttaatagtttatcttccatgtgcgaatatatcacccttgtctttcaacaggttaaccaaattggatctgtcactgagagtattgaggccgtgaagatgtcaaagcgtgctggctggggtgtgatgaccagccacaggaggtatactgatatgcttacctgtctttattcctggtggacctggtctgactaccaaccatttgtatattgacttgtgtttcattgccacagtggtgagactgaggataccttcattgctgatttggctgttggtttggccacggtaagattctgtgctctacattcactgtagtgaactttacggcatcctgtattagttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21582 - DNA, 720 bp, Oryza sativa
  unsure (1)..(720): unsure at all n locations
aggttgatctccactcgtaccaaatagagacaaactctacataaggggacgctggccggtatgacaacatttattcgttatgtatatcacgattgtcaattcttactactgacgtgtccactattctaatgcagtgttacaagcaaccgagcttgtcgaacctatgcggatattaagtgtgcgagatgctcagggtctgtgggagatacagaactgaatttacagatgtaagtcctcatgctccttagatattgcaaatatttcatttaagttgattttaacacaaatcatttgtcttttactttccatagctcccgagcatcccttataacgcaatccggttcgatcagaaaacgctgatcaacttatgcatggacttgtgccagttcattcgttgcgacatctgtaaccatctaggagagttccacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 21583 - DNA, 1769 bp, Oryza sativa
  unsure (1)..(1769): unsure at all n locations
gcacggattgtttatctnnnnnnnnnnnnnnnnnnnnnnnnnnnnnnnnnnnnnnnnnnnnnnaacaacctaagtggttcagatggccacattccagggttcataggatcttttaggaacttgagatatctgaacctctctggcatgccgttcatcggcgtggtgccgcctcagcttggtaacctctcaaagctgcaatttcttgacctctcatcttgcatagggctagaaatgcagtcaagatcaggcatgacatggttaaggaacatacctttgctacagtatctcaaccttaattcggtagacctcagcgcagttgataattggcttcatgtgatgaaccagcttccttccttaagggttcttaatctctctaattgctcacttcaaagagcagaccaaaagctgactcaccttcacaataacttcacccggctcgagagacttgatctctccgggaaccagtttaatcatcctgctgcttcttgttggttttggaacattacaagcctcaaggacctcatactttctgggaacagattatatggccaactccctgatgcactggcagatatgacatccctccaggtcctcgatttttcgattaatcgtcctgtacctatctcaccaataggtctgcttccatccagccaagcacccccttcctccggtgacgatgatgccgccatcgaaggcatcactatcatggctgagaacttgagaaatctatgcagtttagaaatcctggacctcacacagagtctctcatctggaaacataactgagttaattgataatttggcgaaatgcccggccagcaaactgcagcaattgattttgaaatacaacaatatcacaggcatcctgccaatatcaatgggagtgttttccagtttagtataccttgacctctcacaaaactatctcacaggacaactgccttctgagataggcatgcttagaaatctgacatggatggacttaagctacaatggcctggttcatttgcctcctgagataggtatgctcacaaatttggcctatatcgacctaggccacaacaacttttctcatctgccttctgagataggtatgctctcaaatctaggatatttggacctaagcttcaacaacctagatggagtcatcacagagaaacactttgcgcatctagcaagcttggagtcgatatatttgccttataattccttggagattgtggttgatcctgaatggttacctcccttcagactaaagtatgcatatttttattgttgtcaaatgggccccatgtttcctaaatggctccaaacacaagttgatattattgaacttgacatagcaaacacaagtataaaagatacctttccagaatggttctggacaacagtttcaaaggccacatatttggacatctccaacaatcaaatccgtggtggattgccaacaaatatggaaaccatgttgtggagacattttatctggattcaaacctaataactggtgaaatacctgaattgccaataaacctcgaaacactggacatctccaacaattacctatcaggacctttgccattcaacattggagctccaaatcttgctcacctgaatctctactccaaccaaatcagtggacatattccaggatatttatgcaacttgggagctttggaggccttggacctaggtaacaatcgtttcgagggannnnnnnnnnnnnnnnnnnnnnnnnnnnnnnnnnnnatagagatgatcaacaacgcgtcc

SEQ ID NO: 21584 - DNA, 4422 bp, Oryza sativa
  unsure (1)..(4422): unsure at all n locations
tggccccctttgnttnnnnnnnnnnnnnnnnnnnnnnnnnnnnnnnnnnnnnnnnnnnnnatgataggacaaccatatgaaggagctgatcagactcctgcagcatcaggagtaaactatacttctcctgtggccacaaaagggcaagagcgccaatataatgaggaaaatgtggaagtggtgaacattgacttgtcttccaatttcttgaccggcggaattcctgaagacatagtctctcttggtggattagtaaatctaaatctatcaaggaatcacttgagtggacaaattccatataagattggggccatgagaatgttggcatcgcttgacctatcagagaacaagctctatggcgaaatcccagcaagcctatccagtttgacatttctaagttatttgaacttgtcatataatagtctcacaggaaggataccatcagggtcacaacttgagaccatctacaatcaacaccctgacatatacaatggcaacagtggtctctgcgggccgccacttcaaaagaattgttcgagtaataatgtaccaaagcaaggtcatatggaaagaactggacaaggtttccacatagaaccgttcttctttggacttgtaatgggactcatagttggtttatggttggttttctgtacactattgttcaagaaatcatggagggttgcctacttccgcttcttcgataagatgtatgataaagcatacgtgcttgtggtcgttggttgggcaaggcttaccagaaagactgcaacaatttgaggttactaccaagaagctgatgtggttataacatcttgcacggcgcatggcatttcttttctgaatgagatactataagtattattccagtttgtatctctacgagaggggagaaaaccaagaattttaagatgccgatgtctttattatgttttgcaaaaagatgtcaaccattggtcttcttcgaacacatgagcctttgtagcatttgtaaactgctttcctaatttttcccactgtaacatgttccccaagcatggttaaaatcttgagtacttgcctacataagacttatatagttaacttatatatgttgtcatcttttgggggaaattatcaagttggacagccaatgattaatagtagctttagctgctgatggagaaagggatttcaaagattcaggcactttttgctaatttcaaatacttcagcatttcacatgtatgcccatagatttattaattagcttccttttgggagatattaattagcttcctcagctcggtagcctttcaaatctcaaacaccttgacctcggtttcatatcgaatatgtgcacaacagatatctcatggttaacccgtctgcataagctggagtacattgacatgagctttataaatctcagcacaataactgattggcctcttgtggtaaacatgattccatcccttaaggttctcagcctgtacaattgctcacacacacacacataaacctcacaaaacttgagcaccttggtctatcaaggaactactttggccatccaattgcttcaagttggttttggaaagtaagaaccataaaggaacttggtcttagtgaaacctatcttcatggtccatttcctgatgcactagggggaatcacatccctccaacagctagattttaccaataatggtaatgcagccacaatgacaataaacttgaaaaacctttgtgaattggcagcactatggcttgatgggagtctatcgtctgggaacataacagagtttgtggaaaagttaccgcgatgttctagtccattgaatatattgagtttgcaaggcaataacatgaccggaatgctgccggatgtgatggggcacataaacaacttatccatccttgatctttctaacaacagcattagtggatctataccaagggggatacaaaatctgactcagttgatttcacttactcttagttctaaccaactcactggacacataccagtgctaccaacaagcctcacaaatttcgacgtcgccatgaacttcttgtcaggaaatttgccgtcacaatttggcgctccatttcttagagtaattatcctatcgtacaatcgcattacgggtcaaattccgggatctatttgcatgttgcaaaacatttttatgttggatttatcaaataattttcttgagggagaacttccccgctgttttacaatgccaaacttatttttcttactcctaagtaacaacagattttctggagagtttccattatgcatccaatacacatggtcattggctttcatagatctttcacggaacaagttctatggagcattacctgtgtggattggagacttggagaatttgcgatttcttcagctaagtcacaacatgttccatggaaatattccagtaaatatagcaaatcttggcagtcttcaatacttgaatttagcagcaaataacatgtcaggatcaattccctcgactttggtaaacttaaaagcaatgacactacatccgacgagaattgatgttggttggtacgaatctttaacgtattatgtcctactcacagatattctgtcgctagtgatgaaacatcaagaacttaactatcatgcagaaggaagttttgatctggtgggcattgacttgtcacaaaaccaattaactggtggaattccagatcaagtaacttgtctcgatggattggtgaatttaaatttatcatcgaatcacttgaaagggaaaattccagacaatgtcggggacatgaaatcagtagaatcacttgatttctcaagaaacaatctttctggtgaaatcccactgagcttatccgacttgacatatttaagctccttggatttgtcacataacaaatttgttggaagaataccacggggaagtcaacttgacaccctatatgcaaacaacccatccatgtatgatggcaacagtggtctatgtggacctcctcttaaaggaattgttcaagcgttaatgcaccaaagcatgggaaacaaaacataagtgtggaggatactgaggctgtgatgttcttttattttgggcttgtgtcagggtttgtgattggtctctgggtggtgttctgcgccatatagttcaaaagatcatgaaaagttgcttattttccaccaaggcggcaacttatacgacaaagcgtattgttttgcacctgttacttgggccagggtaaataggcaggcaactgcaaattaagcacttcaaatcatatgcttgttctgcttcctacaactgacaggtttactggtatgaatgaataaatgaaggtggaaaagcactcaaaagaaaaaggcattctggaaacctttggttcctgtggtagtggtgtgacagtcaatgttgtctgatagttgattaattttctgcccaccactaaccatatgtaatgtagtccaccatggtataatttgtatcatcagttgtggatgagcttggttagttctttgtcagattcantgtgtttgtgttaatcggtcttactttcagagattccctaaactgtaaggggattctcagccatagtagtatatacccgggatcaatattttcagagaaagcacccccactcaccaaaatttatctgaatcatgatttgggtccggttcattcacccattcttcaatttagctgtctagtatcatctcattgctttactgcacgcatatgcatataatagattaatcttaccggaaactaattttgtttccttgaactgaccattctcaccacaaaagcagagcaaaacagaggacaaaacaggggataagaggaaaggaggggaggtatcaccagtttgctccaagaggacaaggcttcttcaagttcttcgccgtcgccgcctgcatgcaggagcggatttgatcccgctccgcatccggggtagggtggccgcgccatgcgctccacgattctcctcgccgaatcgaaggcaaccacgcgggaagagatgagttcctcctaagtcaacaccgcgagcgcggccgccaccgctgccgttggccaaaacgcggccacngcngttgccctctccttcccttttctccgtaccggtaataggagtatgagataacccaagggcctatataaaaaaatctcaatctttgcgcggtttcacacctgtttttaccttgcatctttttattaagtgacgatttcagagctgtttttagcgctcgattaagcttcctgtcttgtaaagtcaaactgtatagaatgtttaaattggtgggagcaataatgtaacagcaaaattgaatggagtagttattatgttagtgctcgttgttgctgtactgctgatgtataggggatcctctagagtcgacgtgcaggcatgaaagagtagatctatataagcacgc

SEQ ID NO: 21585 - DNA, 720 bp, Oryza sativa
  unsure (1)..(720): unsure at all n locations
cgcggcttggatatctnacnnnnnnnnnnnnnnnnnnnnnnnnnnnnnnnnnnnnnnnnnccgccgaaagttaacggtttgcccaggctcacaactgaaagactttctacggtgtgcgcgtgcgatgcgcgtagaagactgatttatcaacctgtctttatatcaggattcattacctgactatttgtgggtaaagttcgtagtgcgctgatcgtgcaaaatgattttagttgggaacagttcgcaactctgtcccataaaaatcagcatattcccatctatcccatatccagcgcattgaccatcgggatactgaagggagattccatcatctcttagaaagatcaccatctcttttgtttcaatttgcatatagctacctggaggatttatgaatacaaggattttcatggactattaccatgagattgattttccatctttattcgcgagagcagtggaaagcgatgacgatgtgggtactacattgcgcattcacctactttgtgagcgcatggtcgaagcatggatatgcgcatgctgtgactgccaagatctctttggaagagataaaaacaaacttttaatcgaatgtaatactaaaatatccatggcgggaaacctgggaatccccccggaacttatgaaatcacttaaaaccatcaactcaatgcgtaatgaccctgcacacaatccatcaatacaaagcatttgttgttn

SEQ ID NO: 21586 - DNA, 970 bp, Oryza sativa
  unsure (1)..(970): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatagtcatgtaccgcttaatctttgcttggctttccttgtcatgtccttttggcatcagttcagacctaaatccaggtatcatagataaaacctgcaagaaagaattacacaatgcatgattaaattcgtaaaaaaagatttccttatgttgcattggctttcagtgttgatatctcgatgaaatactccaataaaaacaagattaaatactgaaaataaatctaacctgtccaataggacccatgttaagaagattctggaacagctcgtagaatactctgagagtaaaggttccttctatcagtctctgcataagctcaggttgttgatcagcaggcatagcatctttgatcttgttcactaagccagacaagtctcccattcctgacagttagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21587 - DNA, 728 bp, Oryza sativa
  unsure (1)..(728): unsure at all n locations
cgatggtttgatgttgtacaacnnnnnnnnnnnnnnnnnnnnnnnnnnnnnnnnnnnnnnnnnagcttgaataagggtagcgccttctctcccagcctcgatatgaaccgacttaaggcagccatgcaaccggtgacgcattgcacatgcctaagtttgttgggggggcgcatccgctctatagctcgtatcttctcggggttggcctccatgcctcgggcagagaccaagaacccgagaagcttgctcgcaggtacaccgaacacgcacttatcggggttcagttttatgcgggcggagcggagactctcaaaagtttccgcaagatccgagagtaaggtctcttggttgcgcgtctttacaaccaagtcatcgacataagcctcaacgttacgtcctatttggctacccaaagaaattcaagtagtacgttgaaaagtaggacctgcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgcggtggagtcgacaatctgatctatgcgaagcaaggggtaagggtccttatgacatgccttgttaaagtcggtgtagtcgatgcacatccgaagcttgacgttcgcctttggaacgaccaccgggttcgccagcca

SEQ ID NO: 21588 - DNA, 1080 bp, Oryza sativa
  unsure (1)..(1080): unsure at all n locations
aaataccccggggggaccccccccccccaaaaaaagggggcccgcacaaagcgaaatttacaatgaaaccaaggaaacccgaaaaaaaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataagttcggaaagatacataccagtatactccctttataaaaaaacattttcgttatattaggagggatcaaatcccgttgtttttttttaaacggagagagtacgtataccaccagggttatcgttgctatgggggatgtccggtccggtgtcatcccgcaacgaccccacctcgcgcgtcatcagtagccaagggtgtcgactaacgactgtactggcgccgccacagtgccaccgggcacccttgcacaaagcatatgtatgttaggccaggctcccagcagcggcagcgcactcaggttgtgggtcgtgggaagaaagcgcggggccgccgccaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagccggccccctttaaacggggcccccgggggggttttttcccccctttttttttttttttcggggg

SEQ ID NO: 21589 - DNA, 757 bp, Oryza sativa
  unsure (1)..(757): unsure at all n locations
gggcatgttgnntttcttgatattcgagctcggtacccaaactgtttgtcattgcagctacatggaatcagacccagtgaaaattgctgttgagggtgtggagaggttcaagaaggagaagtctgatctcatcattgttgatactagcgggcgccacaagcaagaggctgcactcttcgaagaaatgcgtcaagttgcagaagcaacggtatttacattggcacaaccattggcaaagatcttttgatcaaggcacattccactgttgttactgagaatttaacttgtgtttctgtgtgcagaaacctgaccttgtgatattcgtgatggatggtagcattggtcaggcagcgtttgatcaggcgcaagcatttaaacagagtgcttctgttggtgctgtgattgttacgaaattggatggtcatgccaaaggaggcggtgcacttagcgcgttagtatttcctacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctggtcggtggcccccaaancccttttgtgggccaaatttttttttaaaaaat

SEQ ID NO: 21590 - DNA, 848 bp, Oryza sativa
  unsure (1)..(848): unsure at all n locations
gtgaaatatgctgaaaattgtcttgttatattccaactattgttaaaaggtgtncatagagttaagggcttcttctcgtccncccccccccccaaggagntttgttgtttgacaaccactnggnacccaacgaatgnnntccatatttggcggcaagcctccatcaatttgattctgcgacatcttcaaaaacgtggtccttcgaaaatgttgtagagaaccagcctggaaatgcatcatggattccagcatttggtcatagcaaggtcaagaatatcgacttgtgattgaagccatgagggaaatgagggacccatcgaagatgatgcaaagtatgccttctctaatctgaagggaggtaaccattcaggatccactacaagtctccaagtcattataacacaaatgttttgacttcaagctcgttagattggcaaagtgctcctctgtgatgacaccatccaggcaattggtaatggaggtacaagtttgtcaaatttgtgagcatacctatctcagaaggcacttgtccagtaatgttattattaaaagaggtcaagagtgactaaacttggtagcctccctaccaattttggtaaattcccagtcaaattgttattagccaaatgaagttccttcagttttttgggtgaacactgtggtaaactctcaaatatttttttgaaatctctccatatgccagtctataaatcaaggtcaagaaactttcccattggcacagaattcttcaagtttcgccttcatgaaggcacatgtttacctttctctcgaaaacactcatggttggcccagaaaatcaagaaactcggagggacaataatgttttc

SEQ ID NO: 21591 - DNA, 757 bp, Oryza sativa
  unsure (1)..(757): unsure at all n locations
ccggaggttgacnactcctgctgcctgccngcaggtcgactctagaggatcccctcctatatgcacattatattatacaaaactaaggtcatacgctatcaagtgtacttttcgatgaattttaacacagcatttgcaagcatactggtgcttatgagaaaaaacaaggtgctttattaccttgaggggtgaatatcaggaaatgaaacagggcgaagttgatcattgtctgaaagagaattgcagttgctgtgtatccaaggatatatagtccactcattggtttcttgcgtgctgataaaacatgaccaaatattattgtgtgatgaacaacttgataatgtaaggtgctagttttttttttaaaaaaaatatgtatagcttagattgacctactggtttagaatgaaacttgaacaaatcatcatgtaatacgagaactcgtttccctggctcacaaaacctgttcaagagttaaaacaagggtaattttcaagaatatatgatatcagctcattcacaatttatttgagctttttttcttttacccagagtggatattttcagagccaatcttccaagcccagcaccaggaactaagcatgaaggaggcctatgaagttcaacaaatacacaagtcaatgattgatcaagaatgaagcttcaagcaccttccatttgtatatgaggttaaagggaaatgcttgcataaactatccacaagtaatgtgtggtgtgaggggtaccgagcttcaaa

SEQ ID NO: 21592 - DNA, 5365 bp, Oryza sativa
  unsure (1)..(5365): unsure at all n locations
cgctgggtttgannnnnnnnnnnnnnnnnnnnnnnnnnnnnnnnnnnnnnnnnnnnnnnnnnnnnagtctcttgtcacagttgtagctacaactaacaactggcaagataatcaaacttgtctaactttaagtgtagcaaactgtaataaaatatggcttgtaaccgaacactccccaatagtgtcttgccttcaagcaccaagcttcactttactgcagtgattggcttaattgctcagtccggtcagccagctctcgtgcgtggatcggaggaagctcgtgatgcgggaagaagcaccgccggagatgagccagcggctcctccttgccatccatcgcacatttgcgcgcgttgctcgatatttgggtgattttcacgattagctaccttgttaattacactatgcttttgttgtccgtgaaccctttgttctagtgccatgctaagagcatgccaatacttccccaccttagtgttggactacacaaactttttccccctgcttggtcaataatttgttacatattataccaaaataaaaatgatatgttagatatgccaagtctgtgcttgtttggatattggagataatgatgccttgcagtcttgcacgtatactgctactccctcttgatattccacgatcggactgacaggacaacgttatggtttagtagaggttttgccaattgccgtacatggggaaaataagaatgtattgccttattcaagaaatgaagcacctaagtcggtgtagtataatggggagtattcccgcctgtcacgcgggtgacccgggttctatccccgggaacggggaactctttttttttttttttgggtcttgtagagctcaagggctcaagcttttcgttcaacggggggaggatgatctaacctctttttagtagcagaaaaactattaatcgaaaattatcgtataacaaagaaattagtgatatctagtagagcctctcgtaggcaaaattgctatcgcaaattcgcagctacaccagtgaaggcaataacaaagaaattaacagtatacaatacagtccaaaaaagttgagctctttgatttgccgtttactaattcagtgtcattgtacagttcgaacacgtaccatcgaacttattaatataccttagtgctcccattggccaattgatatacatcgaactggaacagtttttccctgtgccattcaaatgttttggcagacggagattggttttatcgcagtaatggaacgcatgcactatcaatctatccatatagtttcatatcatggtgaaaaatggtggcgtgaattggatcatccgtattgtccgtctccaaatctgataggcatcaccatagaatgactgaaatttgatctatagccagtaagcctgtgccaaccgttccaaacagagtatctccacctcactggtgtttttgagcttttgatcgagatgcattcttcctcatcgtccaaaatgctgcgcggtaccgattctgcaactcaacaacagtataaataagaccattattaccaaatatcaagaagattggcaaaatgcacaaacaattcatgggtattgaactagtgatgttagacgtccaacagaattcagtacagctgaaatctcaagtattggaagctggcagctttgaaatattgcatactagcattgtgaacatccgctgagagtactgagtcaggcagaggcagagccctcgctgggaccaaagagggcattggtctcccctttcttagcaaaaaagagcatttaactgctcgaatagtcagatgcaggttgaactggtcctgtgtcgtagtaattctgtaaattgtatcctttagattggcctttcatgtattttggctcacgctccaccactaactgatacattcaacaactgaatttggacaactagtctcctagcactcctaatacacctgttgaatttactatgcaacagttgaacactatatgagcctacaagggattgaggaacaagtggacatctagaagtccaaatgaccaagtttccaactgcagcaaacaggactatcacctttaagctttcactgtgccattctaaatatttgccataaattcaatcacttcctagatatttgaagattaaaccacagtgaagactgttgagattaaaagattacctgcatcattgatttcatatttgcagtgtatgtggtatctatcattttctccacctgaaaaccacaaatcaaagtaatccattcacatatttttgcagtgaggtgatgcactttctgtctaatcataacccttcactcttttttttttacaacaatgcatatatataataaacatgtattgcacttttttttgcaagatacaagtgtacaaatccaacgtattggtgcactatgcatatgcatatgcatagtttggagtttcctcaattatagcccaaaacttttttttttttgcaaaacactcacctccatcacaaatccataatggtaagcaactcttttcacatcttccaaactcagttcaatagacatatcctgtgtttaaggagataaattaagttcctcaagacatagtagcaccttcaaggattcaattagcatagcattcattcatttaactagtataataaggggagagaactaattacatcatctggtccataggagtcagcgaagtgatacagaagcggacccaaatttatccagacctgttggttgaaattgcataattatcaatgacagataagaaacagtaaataaacaacatataccgaattataaatttccccgtaaactgactcaaaaaaacattagcactgattcatcaagaatagtttatcagagtttaatcctataaaaagagactcaccccaccatccttgagaacttttgatatgatctctatatattcaacgatattgtgtgccgtatccaagaagaagcatgttacaacagcatcccatgaagctggagcaaaatatgagtattgtgagaatgtcaagaaggcaaaaaacccgtagttaccaatcatacatatctgaactaaaagcagaacaaattaacacatcaaggtcagaattaaagtattagacttcaaaatgacttcaaccaataatcatcagtttcagagttattgcattgcatgcctcaatagcctacaatattaatttgaggagctcattccttctccataatacataaaatcaaggacctggcttgcaactgcctcctacttcatttctaagaaaatgcctatcgtttgcaatttagtttttgacgaacgttaaagcaatactctcaccttgatttatttaatgagcattacaaaataaatccaagcaagctaacaaatgaacaataacagtaattaatatccccccttaaaaaatgtacttcgtatgtatgacaagaaacaagaccaccacaaaagaacaactcttttcccttgttggccatgatttaaaatcgaaacaatctgacagaaacaaaaccagcacaaaattgtcctctttttctggggttccatcagaacacatccattctcattgtgaattggttctgtacaattgtcactctatttatatatgctttagactaaccccaatgcaaaaaatctgttcgaaacgtatctgtgtttttgaattgttatttaatcccaccgcttccagtttctggcatgctttcattgggccacacaagattcaaagggcaaatggtactacaatattacaatttaacaaaaagagctaagttgagtgatgcatatccctttataaggaagccaggttaaaattaattaactcattttgattagtttataaggaaaccaggtcatcttacattcttggctttcttcattgtagacctctacaaaatcaccagcacacatagaaaatccttctgtgatccctgagctgtcaaaagaaaagaaggcaaacataagataaatatgtagcataacaagagataacggacagtttctctccttttgcaaggaacataagtaaacatttctacctacagcacaaatagtactgaatgactgaaacaagctgaagcatcaaacttgaattctagaattgaatgaagtttagattcaggattcaaacgaaactgcacaattaactaatcattcaaatattacaacatccaaacatagaatatttgtaggttctgcaaatagtccagatttaaatagggtgtttcaatttctctaatcaaatgctcttacatagccatttttgttgatttcatatgaagctcttgtaaatatagaatcataaatggtaaattacctataaatgtaatcaatatatttatgttttcatcaaccgtgacgtcctatatgcacattatattatacaaaactaaggtcatacgctatcaagtgtacagagcgatgaattttaacacagcatttgcaagcatactggtgcttatgagaaaaaacaaggtgctttattaccttgaggggtgaatatcaggaaatgaaacagggcgaagttgatcattgtctgaaagagaattgcagttgctgtgtatccaaggatatatagtccactcattggtttcttgcgtgctgataaaacatgaccaaatattattgtgtgatgaacaacttgataatgtaaggtgctagttttttttttaaaaaaaatatgtatagcttagattgacctactggtttagaatgaaacttgaacaaatcatcatgtaatacgagaactcgtttccctggctcacaaaacctgttcaagagttaaaacaagggtaattttcaagaatatatgatatcagctcattcacaatttatttgagctttttttcttttacccagagtggatatctccagagccaatctcccaagcccagcaccaggaactaagcatgaaggaggcctatgaagttcaacaaatacacaagtcaatgattgatcaagaatgaagcttcaagcaacttccatttgtatatgaggttaaaggaaatgcttgcataaactatccacagtaaatgtgtggtgtgagaggggacgagatgtcctaatatttatccaattcagaatcacagggcatgggcatggcaggcggccatagccgcagcggtttttctttcatcacagcccctcgcatcgtgtatagccatggaatggaaggcaagtcgttcgaaaacagcaggtaggaagcatcaggtgggcccactggtcggacggcaggggcgagtggtgaacagcggaggaaagtcgctgcagctgaggaaagcgtgtggtaaacagctgcgccggcccacaccacagtgagacgtggtaaaaatgaggatgacgtggataacagcgggatcaaacacgccatgctgaaa

SEQ ID NO: 21593 - DNA, 3142 bp, Oryza sativa
  unsure (1)..(3142): unsure at all n locations
agagcnctttgntnnnnnnnnnnnnnnnnnnnnnnnnnnnnnnnnnnnnnnnnnnnnnnnnnncttatagcactcatcacgttccttttgaccctacaacaatttaagtaacaaaaggtaatatttcctttcggattatatcattactttcagacagaagttccacttcaagccaacccaaaattgcacagaaaatacctcctgagcccaatccctgacaatatttcttatgatgcatctaacctgaataaaccagaataaaatggattatagaagctataaaccagacagcatccaaaaacatgcaagctgaaaaacatgtaaaatgtaggcaaaggtgcaagaaactacatcagcaaaatatagcatgattgagcacttcccattatgaggccaaggggaaaaaaatgacaggaaaaattaacatatgatagaaatcagtaacaccacatatcaggaaagatgccagctttggtaacaaggccaaggtgcaagaaactacacacatgcatacaacatcagcaaaatatggcatgattgagcacttgctattaagaagttaaagggaaaaaagaaaaatcagcatataatgaaaatcagtaacatccccatatcagaaaagatgtcagctttggtaacaactgtggcggtcaaccaacatgaacctttggctatcttcttgacgcattgcagtatgctttctgttcgaaatgtgtcaaatgagaagttgatagaaacacttaccttgacaacatcaattgcaggaacattcaactgcaaggatggagccatgaattgctgcggtatcacctaaaataagataccaagaattaaatagttcacatttatttatacatatcgttatctccttaaaagtatgagaagaccagataaacagagaaaaatcaatgcttgttagactgaaaattatgtgtaaatattgtgtgatgtactttttttctcaaaaacacaggagggttgcatttcatttcattaagaaggaagaaaacacttattgcattctgccctttattgcaaccagaagataaccgaacgaacagctagagatagcgaagaacaaatgcattctgccatttattgcaaccagaagataacaagaatgccacatccatgtattactcctttagattcatagtgataaaattcaagcatgaaagctaaactatgttctgcatcatgcaattataaattataaggaatacacaacagcttacatcttgcaggtggagcttacattctcatcagcagaacatgcaacacaatctgtatcttgacagttagctgctgcatccatggctttatcaccattacatgatttatcttcaacctgagatgcccccaatttgtcaccaaccggccgggagcaactttccatgtcaactacctcgtcctgtttgatacttacatcagtcaaaacgtgtgatatcaccaattttgtactccctccaggctgataatacttgtcgttttagataagggtgaggtcaaactttagaatctttgattatgaatcatttttaaaatatttgtctttcaaatatggtgactacatgtatagattagtcttgaaaagtactttaataaaatcatatatttattaacacttttatacatattataatagaaaataatggtcaaagttgttttttggagaccgtgtccttgtccaaaacgacaagtattatcaacccggagggagtagtgtatatggcttcaacatggaagcagccattatttttaaaattgaacaaaaaggatcaagacaagacataaggcctaccttgttgtcagtttctcttgagagttcatgagtcttgtcgtctttcctggggcaaccgtctggttcatgcaactcggaattgcttacagagatagaacttctaaagcaatcacccctatcgacagaatgagcacaatctgcatgacaatgtccatgcatgttctctgcgcaatcatgaccatccatatctacatgctgactcatgtcgaaaggaggctcaaatgcctgcagtaatataccttttaaggatagcatcatgtacattaaagttttcacctaacgtacaatcttcccaccccgacaacccaaaccacatatacacaataacacaaacatacctcaagcatgtccatgatgaatgatgcattcatggatatacacctgtgaagtaataaacaattaaaaaacaataataaagtccatcacagtaagcaaaaggagtggccataactagtttaagcagcatgcattgatttttcagaaaaatccggcggagaatttaagatagaacatcattggtagaactaaaaaatgttgactaaataaataaagtacagtgcatcagatatacaaaatgctttagatgatttcaaacatgacaaatagatctactgcaaaactgtatttcacaatatttaagcacaagcagtggaactaataagtattggccactactacaagcattaagcccataacattacttaccatctcagcctttggtacttcagaccaaggttaaaaagaagttcctacacaagaaaagacataagatatgtgaatgaacatacagagtaagataacctattacaagtcaaaatgaaatccaaaagtgattagccaagaggaagtggtggttgaatataaaaaggtaaaacgggtatggtgactcaaatacaaaccttgtgggcaggaggaagccttttgaatgatcgctcatatctcttgacatccctttctgcagcatcgtggtagctatcacaatagccatacaaaatattattatttaattagaaaaacactaatataagttaaatggttcccatgtagctatgttccacatacaccatttcacatttagattttccataccaataaatgttcaaattcagaagccattgtattgcctgcattcttttcttatactccctccgtttcaaaatgtttgacaccgttgactttttagtacgtgtttgaccattcgtcttattcaaaaaatttaagtaattatttattcttttcgtatcatttgattcattgttaaatatactttcatnnnnnnnnnnnnnnnnnnnnnnnnnnnnnnnnnnngnntncaagagtgngntacttattntcacatcc

SEQ ID NO: 21594 - DNA, 2219 bp, Oryza sativa
  unsure (1)..(2219): unsure at all n locations
gcgttgatgtcaacttcattnnnnnnnnnnnnnnnnnnnnnnnnnnnnnnnnnnnnnagggagtaagtcatttcaacactggcacagtcttcgctacacttgttttgtccccatggcccccaccttttccaattgtgttcatatgttggacgaaaatttcaaaatacaattttatgttagaagttttgaaggtaaatctacccataccattgccatgtaccaagtcctaactattttagagtgtactagggcaatagcactgcgtcccggctcatcaaggagcccaagcatccacatagggaaaaagtaaatgaggctccatctctcccagtacgcatagctttagatggggtccaccattaattttttttcaggcaggccccaccacaaaaaatcgtcatttcctccttcggagaaaaatcgcttgcacctcccattttccgccgctccttccccatctctctctctctcctctccctcaatcggctcccatggcgccaaacccccaccctcctcttcgtcctctcccacggcggcgcacggcgacgactcctccgcccccctcctctcccacgggggcgcacagcggcgactcccccacccccttcttttccaccggcggcacagatctggctccccctccccattccccaaacaccgccggcgccgcttgggagaaggcggtggtggaagcagctcgacagcatcgggcacctctcccctccctttccggcctcctccctcggctaccccaagcccaagcagcggcggcggcatccccgagcccacgcagtggcagcgagctccctgagcgcccctactccggcgaacttctctcttcactcttcagtcatccaccgttcttctcctttctcactctcgctcttactttcttgttacgcgtggaggagcattttttctgacaaagttgctgcgaggttcttgtgaccaactctgatcacgcgaagctggtgagggaacagtctccactcccctctctcctccacacaagcgatttgcctacgtggaccaacattgccatacgccacgtgtgtgcactgtgaatggccttagtggtaaatgttttcaaatgttaactgcaagcgttctaaagaagataggtaaaacatagggagtacttctgcaatatcaatgctaaaacttgaaaagaaaacaagatttgacaaaagtacaagtgttgatgcaataatactttgattatggaatttctaaataaaaaatagcaattccaggagatatcacttgctcacatcacatatagtaacttttaagggtcacgcctatgagttggtttatcaagattttcgtaaagacttcaacggggaaaaaagaaatgttctctcactccaatcaacaacgttcatagcatggttgtagtgtagaactccccaagtcccaacgaagcctaccgcccttcgcggatgggtaatccccgtaaccacagatcaactctatccagaacctcacaccaccctcgaatcggcgactactcctaaaccctacaactgagaaacaacaccaactcgaactaagttgtaacccacacacacccccacaagcctcggaacaaagcggggggagcctgtagaacggagctacgcgcctctacgcgaccaaccaaccgccgccccggcgagcaaggagagtggcgtggcagacgagacgagctgggaggggaggggagggggacgggatgggggttgacgtacttggcgtaggcggcgatgatgcggcggagtgagctgatctcgagcgcctcctcctgctcggtgtaccgccgttcggccatcctccccggcggcggcggcggcgaggcggaggagcgcagctttctccagatgaattggtgggcctccgaatgatgggtcgcgtctcgcgtcgcgtgggggaggtctttgcttcagttatgctcaggggcaaagcccactaggaattttgccgggtgaaccaagccaatatggaaaagaagaaatggaatttcataactcaaatattcgtctcagaaattaactactcctatgatgataagtctcatcggtaagcgatgatattaactactcctatcacatcaaactaagcatggatcatcatattttgatatttatatgctggcctaaactcttgaagatcttcatagaaatagagtgggtaccgagctcgaatcggccctatagtgaatggtgtactcacttcacagg

SEQ ID NO: 21595 - DNA, 1234 bp, Oryza sativa
  unsure (1)..(1234): unsure at all n locations
naagaaacaaccctggtttcattacaaagaccttttctgagtaaatattttagtttgccgagtcaatacacaaaccacaagccaccctttacattaaaaatccgcattgaataatattttgaaggaattttcttgggttgaaaagtctgaacctttttaacctgaattttcctgggcacaaaccatagaagtagctcctcgcgattaaaatctattgaacatattgacacagcgatttatatatctcgatcttcatttcgccctattttagtataaaatataggttgcaggtttatatctatttgatttttgtagacgcatataaagctaacacgaacacacgatgcaccgagaacgatatgtatggcttttccgatgagatgaaacactatatacgctgctaaccatcgaacgatgttacttgatacggtctgtgacgaccatttcagttagtactccttccgttttaagtttttgtttgtattgtttgaccactcgtcttattcaaaaaatttgtgcaaatataaaaaaaaaaagttatgcttaaagtactttgaataataaagtaagtaaaaaaataaataataattctaaaattttttgaataagacaagtggttaaacagtgtaggtaaaaactcaaaatccctttatattatgggacggagggagtatgttacaagctaattaagagccctgggaaggcagaacaaaagaggggtgaatttaattgcaatacacatgcccgtcagaaatggtagcaagtatacactagctgtaacctgagacccatcatcaccgaagctgtaacccaaacacacggcgaaccaaacaaacatcgccgcgtacagcaaacaccactctttggacagaggagggatttttgtatgaagaatttgagaagagaaagcatcggttagaatttacaaagcttggacgggaaacaagatcaaaaggaaccaatttttttcttgttttaattatctgtgttttacttttgaaaacctccttatcctatttatgtcgaggttggtattgttctggtggaatggtggagtgagatgaaggttgcccctccttatggggcaacatatttaagaaacttccttgaacaggctcatcttcatccatgctctttgttttaaggataaaagcaagttaaacatatcatgaaaaacggtacatggtgtataaggaaccaataggtagggtaccgagtttgtctatcatcacgc

SEQ ID NO: 21596 - DNA, 4216 bp, Oryza sativa
  unsure (1)..(4216): unsure at all n locations
cgcgtgttgatgacaacttcatannnnnnnnnnnnnnnnnnnnnnnnnnnnnnnnnnnttgatcatggacttttgtgtcctttcacggcataactttccatagctcaccaaattttcactgtgaggcttcatgtcaaatttatgctccacttttccttcacatgaaaatttccctacaacacacaaaggtcatttttgggtgataatcaaaacttagatgctattgaaacttgcaagatcccccaaaatgtaagttgttataaaaaatccataagaatcactggtgaccagtaagggtaactttctgactgggaacgcagtaaactgccagtgatagctcacctccagtcaagattcttgaaagcttactacttactaattaaatcaatccggacaccattgactttggcaaacaacatgatagtatttttcctatatattggagcaacttggacaaaagatgcacacacacgaaggattatgtgaaggccccttagcacaagtgctaaatagatggctactaaacccaaaacaagtttaggaaatactgatcttacaataaccacctagtcacccatgcttcatagtacaaagcatgcactcaaacttgtaggaagccccagacataggatcaataaatgtccaacaataagcacctagtcacctactcattccagtctgattcatgctttatagtacaaaagcatgcacttaaacttgggggaagccccaaacgtagtatgtctaaactcatacaggtaaaatcaagtatgattgtatgaacacagacttctgacatacaggaacgagtaaaaactatgtctatcaggatagtaatatgtacagagaaaaagaacgcaagcagtataagttaacaagctgggaattggactcctaccttggttagactcagagaaaacacacattggtacaaaatccttggacatattcaaggagtaactctttggtgtattgccagtgttagtttgagccatctccatcttgaactgccatgccaatagcaccatgttataatgaatgatgtaactataggcaccacaagcaaaaagaaatgagtgatgaaactaacatagaacggggaacaattatcaaacagagcagagcagtatgacgtatcccgctctaattaaacctctgcactcttcaatgcatctgattctgtctagcaattcgcaaatgggaaatcaactgaaatgttacccatccaatcaatcgtattatcacattcggcagtcaaaccctccaccactacatctatgttacggtcggtgcagaattttgtcccatttttcccaagcataatgcatgaaatctacatttgaggttcatacattaccaacccccacggccatagggtcatatcattttgctcgaagagaatgtactaccattcgaatccgcaagggaaagggagtgggcgggggaggcttgcctggaaggaagggctcctcggagcggaggaggtcaagggagaggacgaccttggcgacgacggggttagggttggagccggcggcgtcggagaaggacacggcgccctgccaggcgtgcgagacgaccggggggcacttcatcagccacacggagcgctcggcccgcgccgtctcgaggtacttggcctcctcgcccatcccgccgccccacgctggtggctccgcgctcgcagtctgcccggcgattccggtgtcggcggcggcggcggcggcgctagggcacggagcggcgggcgatctggcttaacgacggagcgagcgggcgaaggggaggcacacgcggagggcgtgacgtgcagttagatgaacgaacgataatccggccggatcggatcaaacgctgtttgcagatgcaccgggctttcaggaatgaatcggttaccgacgaaagttgatagaattcgaataaattttactacaaattgactcagatgttgttgtgaatatatttaatttggttttttaatcctatcgatagatgatacttgttctgttccaaaatatacatatttctagtgttcaaaatttataccacaatataaatattttttagcgtacttcctcatctcaatggatcacaagttcacaaccatcactccagtcattttctataccatctctagtttaatttctatgcctatttccttctaccgatcatgataattttatatctaatcttaatcggcttaaatttatagaatttgattgtttttttatgaagccgtgctaggagctagtgcttgctatctcataatagctccatggatttcatcggaactgttttatgtttcttgggctttttcgttgcggaattagacctcctattaatgttggctaattggcttattcataagttacatcggcctgccgcttagtcgaaagctatgcaacaagtctgcgatagtttaaaactggaattggcacaatactgcgaagtggtcgtcttcgcttaatttaggtcagaccttgatgctgcgactcaggcattactcaatagatatgcaaggcttacaaaagtgcccaaacaaccacaatacgaaccgtttccaattgaaaaacaaattgttaaattgttatgatttatgctactgtaaacagcttatgtgatcagattttatattttagaacataacttataatttactaccccttcgtcataaaataagatcacttttggatcctcctatttataaaagaaaattttataaagcaaccattgtatcagagtttgtaaaagtaaatgataaatgtattaggagtagataaagagagaaataattacattatattttaatgaaagtaacgtattctagtttttttactggtacgtgctagattggtgaaaaataaacgtttgttggtatagatggagcatttaaatgcggaagcgaggctgctatgtaggccacgtctcacgtctgtcaggttcgaaagcaaatgcatatctgtcacaaaacaaatcgtaataggcgcgcgtatatatatgccttcggttaacggccgcgacggccgtcggcccgcctcctccacgggcaccggctagcctgtgagcttctaccgcccgcgtccgcatgagaacgacaggtgctcgacacttggccagcagccagctcgcgttaacacatggccgggccggccccgccgccggacacgggcaccgattcgattcgaagaaggtacgacgtactgcgacccaagctagatcgatctcctctcgttttcttcaatctccttcattttatactactgcttcgccgatcaaatctgttgttgttttttaatcaaatctgaccatagttgattactccgtactgattagttgtcttgtcctgctgttttacttagtgtacatggtgacagcggaggtaggttaaccggaaagcattttttgatgctgcggcctgcaatcagtactactccctatttctgtattcactcgttcattgtacttaattttttttataattaatattcatattattattagataataaaacataaatactttatgtttagctcaaataaaacaaacgatcaaatattatagacgaaaacgactcttaaaatcggacggagactactcatctcacagttgcggggaccaaaacttgtttagaaaaagaggtgaaccatgacgctcaggctgtcacgctgagcgccctgtgccccgaaggtgggacagaggcggtgccgaaatctagaactccggagcccagcacgaggggaagctcgtggcagtgtccgcgccacgtggcaggcggccgctcatccgtcgtgctcaattgtgcaaaccgttctcaattttcacctgcaattgtttttttttaaaaaaaaatcacctgcaattccacatcatgctgtcatttggcatgttccattccatcaagtgtgattagactaagttaattttgttccgtatgattacagtgacggaatagaatgattctacgagagaacccgtactagtttagttacgagtttatccaacaagtgtattgcatcgaccgttgtttaggttatcttcacaaccgtcggcatccaatctttattccttacttacttggatgatttcgatctttacactagttaataatcgaattaacaagtctctaacttggccactgaccgcgggcggacggcgagccctagctaccactagctggtggccccacaccaccggcaccaccaccacgcgacgaaga

SEQ ID NO: 21597 - DNA, 4636 bp, Oryza sativa
  unsure (1)..(4636): unsure at all n locations
tggggccagaagccgtttttctcggccggccgttgtccaatcttgggngtgggttcaggcgcngcngcngtcttngtagacttcctcgcccccggcgccgccggcgagttccgcgtcgacgggtccttcccgcgccgctgctgccgcgtggtggccgtcaaggccgctgcccccnccgncgncggcggggaggagaagaagaagaaggtggtggtgncggaggtccgaagnaaggtgnacgagnacgcgcacgtggtgatggggcgcgacgtgttcgtgctgtggttgcgcgccgggttcaacgccgcgttcgccatggggatcgtgctcgttctcgaccggatcaccggcgacgagctcaacggcgacctgagcgaggacctcgccgtcgccagttcgccggtgtaaaagctttcggtgatcggatcaatgggttcatgcttagagatgtgtaaaatatgtatcatcttgcaaattcttttttgtatgttttcttgtcgaagtttgaatattttgccttgtgaattgagcttgtagctttgagcgaaatgcaagttactcctaattacgttagcctttgacagtagtaataactatagttaattattttgcttgttctttcatgccttttggattatttttgtctctgaatagtactagcagtttatagtttggtgatctaacttaactacgtttagaaaaaaggtttattttggagtcaacaaggtggaaaccaagtggtatccatgtgtggcagcgaagtgaagctgtcgttttcataccaagaaaatggggaggtctttttttttttcgtgggtagtaatgtataactactaattcacataatcgatttaatatccctttcactttcggtgtgaattttcaaaacaatgacactttcagagctggatttgcacaatggaaacatcaacataccccaacaaatgggcaagcgaaacttctgacgttgggctgcatgaaagaggagagtcacatcactactagaagagtcttagatatgcataattgcactccagattgattcctatacagatatatactggcactgccagatgttatcacaactctaacccatataggattattattaccttattaaaatcccagcacatttggataagaaaaacattatcttcccagttgccatgctctttaggccactatggcccaggacccatgtacggatgcataacaccaagttagtgaagacacttgtcaggatgaaaaagacatacctttctccacttaactgtaatacgacacattgacagaccatcatgaatgatgtatttttctcatttctatataaaagaataagatcatgagaagcgtcaaattttccacatctcacagggtttgctgttcgtgcatgtctatcttatggcccatctgttcaatctccaaacaggagaaaatacaaaaggcacacatctcaactgtacagcttccgaatgctggcacaaacatgcaaatgatttcggtggcatgtttggaacacccactgggtctactgatctaggggtctgccagaagtcacaagttagaaccaccggcttatgtcagcactagttgaaatggaaaaaagaagggtttgtgtccatcttatggcaaagaatcaatttgagtgccaaactgccaattctatgctatgtgaatcctctgtattcataatctatgaaccgccaccactgttgataccgaagtagatcgtcttgcgactgaaggcattcatagcatagtcgactcggatttgaccaaggtctgtgttaaagtggattccatatccaaatccaacaccaaatcccggttttccttgtcgaagagctggattacctgccaattttacgatgaatgatcacttgctgacagtagtgtacaacagaaaagggaagatcctcacattatcacagaagtaaacatatgtggggtgagaacaaagttaaacgcaacttgacattaggatatcaagcattcaagaccccacgttttcatgaatagggatgagtgtactcattcgtaaggttgtttaactaatctactatgattctgattctatatctgtgctgtatagtacagtaacatcgggagcaatcaaatcatttttctgtcgatggtctaatgtgttaaccttattagtttactctcgtcaagtttcattaagatggattggtcacagttacatcctaacatctcggctaagaaatatttccataaattccactggggacatacatcataatacagtagtaggctagtagctggctggtggctgtaagcgaaatccctcatttactttatggattatacagttcatttattggacaaggctgttttaagcactaatttagtatatcaacctcattttctacttaagtaaaacagaaattagtgcataggaaaacagagggagtgaagcacttaccagggacatgacaagcagatcctaagtcactgccgcagtccatgaaaatagaaccctccagatgctttgccttcacagaaacagatagttcaaatttttatgtttaatctgaatgtataatattacaacgcaaatagctagagtactatgaatactggacacttcgcactaatcatcacaaaaatataggcacaatatgaagctgaatgatttttcagttgtgtaagctccaaagcaccttcagggaaaattttaagcaacagcgctagcttacactgaatcgccagcaatgatctccatatctactagaaccctcagatgaccattatttccctctagtaacagcactagtttcttttggttcgtggctcagcttgaatttcatctctaaccaaccctacccaaaattgcttcagagtaaaggttgttggtgtcatcgtcgttgttgtgttgctgtagtgtttggttgctatcttaaatattttctaaatgatcaatgttacaccactttaaacattaagtaaaacctcaggcatctattcaataaattgccttcaattataaattccatgtctgggctcaatttctctatggcattccaagttttagttacgagctgaaatagtgtttcatacataccaaaggaaccgtatattcacagttagcaattaggcacagtcttcctgcaccaactgcacccttaccataaccccgtacgctaccaagtccgcctattgcaaatgcttgatatggcgccatgtcccccacaatggaaccacctgtcaagctgtgagataggaaaagattaattacttctgctgaggagtttggcactttgctggagaacagtaggtgcatgcattacctagtaaccaaaaatgttggccccaatttcatgcctttcgaaactgcacattttactctgttgaaggtcagagattttggtacaagtggcaatccttgttccatttggaggttaacctgtcaataagatctatatgataaagtagatcttacagtaaatatgttaaaatatagtaaacacaaacatacttttaagaagctattatcattaacatctgcataaccagactcttgcttcaagataatcatgttatcatggaggttaccactgcatgataaagaaaacaacagacaattataagcaccttttgagtatattaaagttcttgaattgtaaaatactttagcacctgcatgttagaggaaagccatcatggtccctggctatggagcgtccctcgttattaacaggccggatatgctggacaaaaagggcaacagatatgatcaaatgaacttggagaaaagataaaaaaaatataaaaataactaaaggcaagccaacaactggatttgggtagatgtccacctcgaatttaacactggttccggatgtccagtttgatgttgatggttcattaagctcaacaccaagcgacaatcgactaagatttatccctctgctccctgatcgtgtgaagttgtcagccggaaagccatgcaccgctatttccggtgtcattgtgtgctgattgctcaaaccagagcaagtaagaacaagtgtgaacagaagaatcaactaatacaaccaaacaatattttatatgcaaaacataagtaactcttgtatgcaaaacataagtatctcagaagtgcatcaacaatacatacttacataggtttcctagaaaaaaaataaaatagactactagagtatgaaacagcaactagcattctctatggagatagaattaggtgtgacttgtccctaaggttcttctcaatatcctatcagtgcccaagacccactcaactttcatgaaagctaaacatccgcaacaaaagttatgtcacaaattcaagcttcagtccatagtatgagcacatataaagatattatgtttactgattgctctgatattatagcagatactgaccatgtgatgcaacagatcagtatgaagaattataacgcacttgtgctatgtcacttgagcatttctgttcaattccagaccagaaatttacacagatacattgaacagaaagccaacctgaatgacaaatgactgttgtgataaccattcaggccttggccgtctaaaggcaatgacagcattggattcattgatacccttatccaatatgacatctaacttctcgcgtctt

SEQ ID NO: 21598 - DNA, 3050 bp, Oryza sativa
  unsure (1)..(3050): unsure at all n locations
cagtgcttgatattgccgatcctatttgcctgcacgtcgactctagatgatcccccgcctcgcagagcatgtgggtgaggtcgacgtgcacatccaccttggctgcggcattttcacaaacacgttagccacacacacgcacgagagacagnaagcagaacatcccaaaccaaggaaaaaacaaggaaagtacacggacctttccccgcattgacgctctgctgagcttccatggctgctgcggacggcgcggggaggaggtgcacctcatgcgagctcggcgccacggcgggggcaggactgattgcgaagaggagggggtggcgtggcccgcgggggttggggattttgagcgggagggaagtcagggtggggggactcgggtgctttgcgttgaacggaaggaggtggggatatccctgatggccgttgattgcttctgtcgggttactaccatagagttcagagcggcgccgacttggatggagtggacaatggacttcggccttcttcttgggctggtttcattaaaagcgaaaaatgcttatgctttggattttggatttttcttttcgagcaagagaattctcctacgaaactgattttagggtaaaatctgtttgagtttatggtttcggtgataccaacattgtgacgtcattactgcgttgctgttgcatactccctccgtctaaaaaaatctaatcatggggtttgaaccgggacaccatccaaaaaaaaatccaatcctagatttgaacctgaacatgtgtgtgtctaagttcaaactcaggattggttttgtttttttgggacggagcgagtatgatcataagtttaaattttgtttccatatttactagtaccgctttagacgtaatcttacctaccaataggttattaattactctctccgtcccatattgattttttatagaatggaggatatatgtgtctatttttctattatatctatgttaaataaattgatgtgttacattgacatagtactatattccgttggcttggagtgttgcttttggaccggaagacttaagtttaattcctattatcatttgtgggtggtcaatttttatattgcacggtgtctataaagacaatctcaccttagtccacaaataataagaagttggaggaagtactaaccttatttagccatatagagtattgtgaagcaaacatctaataatgaatagttatacgtattacacatgatcttgcttcgaacatgatgatatacccgcaagtatcatatctaacaccacacagatattagaaaagcttgcctctaaccctgttgtcgtcaagcccctccaccttgccttgtgtctcgtgcttgccggcgagaactcaaagatgatactatccttcctactatggtcgctagattaggaggtggggtgtgcttttctcatttatttaggacgtgtctgctccatggacaactaactagttcacgcttctcgcgtgggaaagtggtcttccgcagatgagcatagacgacgccaccaagcgaggcggctttgtcattggctagattcatgacaagcgatccgaaacccttcttcatgttcctgttctaaatccccgcctttcctcacccccctcgatgctgggggacggtgttgtggagcaggtgcatccgatcgctgccatcattgatcgtattagcggatacgctgatgaaaacgtcaacgttagctggtgcaacctgatggaaggctgccttgagaacattgtcgctctcgccgaggacacaaccaaacacaaacatgcggaagctatgcagacccacattgtcgacggagggagtaccatgcagggacgagggacatgtcgcgtagcattcccgctaataatatatcatatttattacacttttttacgtatcttgcttgtttgctagaagaaaactttcacacttaacaaaacacaaaactgtttagcattaaatggaaaaaacaagtaagcttaaaaaaaactttcatttcgataacttcaattggaaacttgtattttttattaagtacgcgcttgattgaactacaaatgatgcaatagtagtagccaatcggagtctagatcctactagccgtagcaactctgtcccatatatacaaccgtgacgataataacttatttaaattttatatataggattgaaacacaaatgtaacttatttaatcctctcggccaactaaactttatctgtaaaatctatactacttatctaaatctgatgatggatttgacactgttcttttcagtttattcaccaaattattgaaacgattagttgcttcacactttgaaaaatatgtttttcagataatttttttcacgacattgtttagatcacttttttttaagctacttgtaaaatttataccttagaatgtttggtttatttatataattaagtagataatcgtaacaacattccgattccgtttgataatatataaaccaaacaggtaaaacaggagatgtcataacgcttgagtcgcagataggtaacgcttgtgttcggtatcttgtccaaataggatccgaccgattacactctctttgggaaaacacttgaccaaatcttacccactaccgaacacaaccctagtgcactagctatccgcctggttttcgagtttccaacgagccagaaggaagcccaatttttcccaaaagaaatccacccccgatatcaaaatcccttctccctcccctctcgccgccctcctcctcctcctcgtcgccgtcctcctcctcctcctcgattcgaggggtgccgccgccgccgcagctccagcatccgcgagaggctcgcgttggggatcgccaatttccacgccacggtggccaatcccccgcggcgcgcgctggtgggcgatgcgatcggatgaggtgttggcgacggcggcggcgctgcgtggtggtggagaggaggaggaggaggagggcgtcgagcttccccgcggcggggtttcggcctccgcggggttccgagctagagtngccattccagcacgtg

SEQ ID NO: 21599 - DNA, 2663 bp, Oryza sativa
  unsure (1)..(2663): unsure at all n locations
ttgcttcggacngaagcaggggcgctagactcgccagcgaagatcatacgctgcctgccgctctttgccgagcatttccggtggggccgccaagagaatgcgcacgagttcctgcgctatattatagacgcttgtcacaccgctggtctgcgcatacgcaagcggctacctgcgtcaaacgccaatggggacgctggcgaggaggaggtccgggtgcaagggccatatatggtgatgaaggagacatttggcggtgcgctgctcagccaagtgaagtgcctcacctgcaagggagagtcaaacaagaccgacgagataatggatatcagcctcgacctgcctggaagcaattctgttgctgatgcgcttgcccgtttttttcagcctgagatattggagggttcaaacaagtacagctgcgaaaggtacattttatccgctagttagttgctgataaattgtcaagtggttctaagtcgcctaggcagtacggacgtgggcatggcagcatggtgtctagctccttgtcacactacgcagcatgctggaggcaggatggcacctagctcctaatcggactatgcaaccgctttcttgttattaccacgttagactggatagtgacacgtagcgtgagggcaaactaactacttttttaactgtattttggtatagcttaattagggcttgtttttgatgagggatctagatggaaatataattattctaagtccaatagtaatttttttatttagtttcttgaaaaaaaaacacactaatgttttgttaaaaaatctcaaggtattttgttaagaaaaacaagtgtattctggatattttgtaaaaaaagttgtagtgttgaatgcctaggttttcgaatgaaatgtccaagtttcaaaatctgctaggaatgtttttgctttccgcttgattggactgcttaacccctgtggaaaaggtaagccagttacgttttccttatatttcactggaatcaagttttctgttcaaatttcctggaagatttcttatcagggaatgattgatctagtggtcgtgtgcttgcttaatcttgctgacaacggctttaacatttggtacatttacaaaaaagaacctgtgttccaaaggaaattggaaaaccttgcccaatttggaggtccaattgcctttcctatattggcagtggtccatccaataatttataagaaaaatcaatatattatataaaaagcaatcattatacattttacaaagtgcgcactcacttttcacaaagggaaaagtaggtaatagatagctagcctctttaaccttgctcgttgaggtatttcccggacggggcagtttatgcttataaaggaatgcaaccctgccaaccacacctttagggtcttaggggattaaagtgagctcaatacgagaacctgttaatattaactgtgctatcagtttccatttatattcttttcatgaagccactataatgcttgcccattcatagttttgaacttgggtttccgaaattcttcttatgtgttccggacatgccctaacttgcgaaaggcaatttttttttgtatcgcagatgcaagaagctcacctcagcacggaagcaattgtttgtccttagggcacctaaggtgctcgtcatacaactcaaggttatcaatcttcattcctgatatttttattctatagaacttgttattgattaagatatgttgctgatgacctctgtttacttccattctggtttgttgccactagagatttgagggaataaatggtgggaagatcaacaggaacatagaattcaaagagactctctttctttctgacttcatgtataataaaaaccaggttcagaatatcctcttgattgttacattagtatttgttgcttgttctacatgtagttaataatgtcaaactagtcgtggaaacaagttatgtcaatcgtagcaatccatcaagcagtgaccacatgctggctgtttatgtaattttattgtgctacttttttgcatttatgctacagcatgaagtcataaatctttaaggatcattttttttctgcaattattgttaggtgaactctccaagaatgttgtttaggatcaagaaattctggattatatatgtcttatagatatattttggggcgtttatgtggtatgaccctacaagagcttcataaagttgcaaagaaaagttccatagggtcaaactacatctggactatgacacagcattttaggattattcttcacttgaaatcactttcatccgcatttttcattgtttgtttttaacatttctgctaatatttcataccaagaatcagatcagtttgttttaattatattgctttgcatggatctgcaggattcactgccagtatataatctttttggcagtattgttcactcagggttctctccagattctggtcactactatgcgtatgttaaggtaataataggcttttccccagtacttaaagtcttcaattattttgccctgacatctaactaaatgattgttgactatgctcaggatgctattggtcgctggtattgttgtaatgattcccatatctccccctcaagctctcaggatgttctatctgagaaggtctacatcctattctatattctgag

SEQ ID NO: 21600 - DNA, 7837 bp, Oryza sativa
  unsure (1)..(7837): unsure at all n locations
cggtcagcacagattatagtttagttctgcaaaataccatgtttgttatggttaaagaaataaaattatgtcaaagacatgtttgcttatttgaatacatgatattcatttgattcaaataaacattagactattgtataatatcagaaaatataagggactaatttgaaaaaagtacaaaagtagtggtgcactagtgtcttttatagtactctctccgtttcggaagccccacactgccacacaagtcatacgtcaaacatgattcaatggcttccatttctcttctgtgctattgcttacatcattcaatggctctaatatttgtatatttctctctttttttggcaatgcagaaaggagctgataagcgaatctggaagaatatttaggtcaaaaattccagaatcgctgagggagcatctcattcaagccctgcggtcatattaccaggacaaattttcactgggaggataaattttgtgcggcggttcattagaaacttaagaaaatgtatctgtatttaccattttgtagaatggcaaattgatggtggatgtatgttccatgtggtatatgtttgctctggtaattacctgtttgccttctttatttatttattactatatattgctctgcattgctaacttatcttatgcttggcggttcaggttcaacggaatcctgttggtcaactaccagctccttgtgcggcttatttttgaggcatttttgttatccaaatgaggttgagacgtagagtggccaaattacatgtaaaatattgtcttctttttgctgttgctcctgattctataggcttaaacaacaccaacaacccccattccttcccttctgtctagaatgtagaaattgttttttcccttctgtacaataatagtcgcaagattagcagtgtatggggtttttgacctttactgaaggaaaagcccgtttgtggcttcagtactgggtttgttctgaattagtgtccattgcatagaattgctggtaaaatcatcagaatataaatatccaaaagcaacatgtcgtttggacaattagacttaggacttgttaggtatcgcgccaggacaagcatgaatgtttggttagctaggggaaaaaatagcttagcatagcatccaaacaggcctacatctattagttaccatgttcactgtgctgatcatccaattgccattgctttgactttgcgtacagcagcacggacatttgaacatattgctggttggtgcgtaatgggataagagagcatcgaaaatgaaaaaaaaaagaaaagaaaagggaagtagaacaataaaaaggggtggttcatgtttgcttgtcgctggcgtctgaattgttcttcgtgtctgcatcattttcgaatcggcgcgtgtaagctaagaaagcggactgaaaacctttaaaatcggatatccatccccgttaatcattgaatcctgaaaacaaatgttttgcatgcattgtacatcgaactatcaatcgacaatcgttcgccatcccacataaattgcatcttgcctgtttcaaaggtacaaaaagacaaacgatcatcttcaagtcctcgaaaacctgatgctaacatttccaagatcaaaacggtgtcacgagctcgaattatttcggcaacttgcttttgtattgttggaagttggctggccagcgtctcctaccggagcaaacgagccaaggagcgcgagcgcgacggcgagccgctcgatcccgcgcaccgacggctcggatccaccctgccgtcgncgccgccgtcggccaacccaccggggcattatccggtattccggtgcagcgcgcacgtagtacgctacgtagacgtgagctggtttgtcacctgtcaacctcgcgctgagacgagcggcagcatcgccagcgagcagcatcatatcctaccgaacgaacgcccatccccccacaccggggttttcacctttcacggcaccacccccggtaacttgtttattgggccgtactactgctggtgtgtgttgatttgatcttctcccgagctcgtggtggactggtggtggtgtttgtttacacgctcaaagattaaccaaatatttcccgatgggtttgttggtcagtagtgtgtagacaaccaacgcaattatctatttcgtccgttttaaaatatttatatctaatatacgacgggatactattttagtataataaatttgaataaagaatattctagcattactatgtggtaatattttagaacggaggttgtactcctactgcaataaaaaaataacataactcgaacacgaagtcgtcacaaaggacctgcctgcttcccgtcggcacatccctgttcctgcttccggcgtgaatctgaacttgtttttgtaagaagctgttgtgcttaaatgggggtacatagtctaagggttcctttaatctgacaggatgaacaagatcatttcaagaagagcatgcaaaagtttttattcacttaacaaaggaggatttacaaatgcgaattacagttcggttatcacgatgatcggccgtatcgattgagttggtccagatttataaaccgccaggttcaaaacaaattcaaaccaaaattttaacttttggtaaaatttatttgagttctacccaatttcgtcgataaccctagctttaactgcagtagtaaagaagtacttactgcacttaggctgagttcggcacttcatttccctaactcacttctttcgttttacttatacaaaagttgctttaaaaatcatattgatcttttttttaaaaaaatagctatacttaattaatcatgtgttaaaagaccgctctgtttttgcgtgcaggggatgggttctcatcttgcactgctgaacacagccttactttgtctactagagtattacttctatttcaaaatataaaaacttagaatcggattaaacacatattatctaaatttgttgttttagaaacactaaaatgtgtattttagagtgaagtcggtactagcctctgccttgcctagagattcctggcggtcctggagtaggtacggcgccgttaacatcccatcagccatcaccaggagtccaggaaaaggaggcaatcagccgtctcctgtctcccccgtctccgtgcgggcaccgcacggcatctgcggcatctgcaggcgctgcactgcagcagcagccacccccaccacatccaccaccatttcccaagggaatccccacccgaaaaggccgtgaaaccggtcgttttccccgcaccccccacctgcgccttcacctgcgatgccaagccggcaggcagcggcgccccctccctcctcgagatgccaaagcacgcacgcacctgcgcgcgcacacgaaagcccgcgggctcgcacggctcggctcggctcggctctcccgaaggaaaggagaaaagaaagacggggagagaaaaaaaccgtgcgctgcactgcaggcagcatcagtgcatcaccaccaactggcgttcgcgtcccctcgctttatccaatttacaaatggtctttattaaacaaaaccgatggttttcttttgaccctttttgtcttcattaacacaggaatctcgcgtgtattgtgacagatatttgtgtcattatgtgcatttcttgaaatgtttttttggggtataatttcactagtagtattttaaattggtttttaggctaaaaagtgagtagcatcttttgtccctggataatttactagaccttaataggagtattcagtacgattggcattagtgaggatttcacagtttttaaataaaaaaggagagaggactgacaatttgcagctcgcaccgacactgcatagataattggcgtcttcagaactgacaaaactgacttttgtttttaaaattctctcttcaaatttgtttgtaatttgagaaaatttgagggatcattctgcattttgccgaataaaagcgagtctgcaagagattgccaaccgtccacctctctctctctttntccacgccacgccacgccacgcttttncttctccagatccggttcgcctcgccggcgatggccgaagatccggcggggtcccgccgctggcggtgcgacgccggcgacgaagcacggctgttggctctcctcctccgccggcggcggcggcgacgaccacttcgaccgccttcccgacccgctcctgctcgtcatcttcaaccgcatcggcgacgtcaaggcgctcggccgctgctccctcgtctcccgccgcttccacgacctcgtccccctcgtcgactccgtgctcgtccgcgtcgactgcgtcatccccgacgaccccgcgtcctcgtcgtcgtcgtcgtcctcgccgtccgccgcgccatctttccctacggcgtcggcgcgcgcgcgcaccgtcttctcccagatcgcgcgcatcgtgctcggcggcatcgtcaagcccatccaggcgctcggccagatactctccccggccaactccgcctccgtcctcgcagcatccgtcacctcctccccctcctcctcctcctcctggtcctccttttcgccgccgcttcccggtgacgtgtcgcaccactcgccatcgaaggtgctccgctccttcaagaagttacgccgcctgcggatcgagctccccgccggcgagctcagcatggaagaaggcgtgctgctcaagtggaaggcggacttcgggtccacgctcggcagctgcgtcatcctcggcgcctcctccgccggcaaggacggcggcgcgggagcagctcccgctgttgactgtggcgagtccgacgagacagggagtattccggagtcgttctacacgaatggggggctgaagctgcgggtggtgtggacaatcagctcgctgattgctgcgtctgcgcggcattacttgctgcagccgatcattgccgaccacacgacgctggagagcctggacctgacagacgccgatgggcagggagtgctcaccatggacaagtggcagctgcaagaactgcgggtgaagccggtatcggcatctgggggctcacacaggacgctgatgccagcgcttagcatgcggctgtggtacgcgcctcacattgagctgcccgggggtttggtgctgaatggagcaacattggtagccattaaaccaaccgaggaggcaacaagggacacggttgggagtgggattgctgggtctgcaggtggatgctgggtttcagatgcctttgaggagccgtatcggacagccgtggggatgctcctgaagcggaggacatatagccttgagatgaactcgttctaagctgatggcaatttggaagttctatccgtgaggtaaattctgcactgcattcaatactatgtttgtctaattatcttcagcaattgctgtttgcgatgccatgctttggcttctcacattgtagcatttgcttcaacaacattgttgcttattcgtggaaaaattaacacgcgctcaccagtataaacttgcatagtagtaaacagcacgagtcttcgaatttctgaaatttggtttatgaggcttgccatgacttcagttaggttgtcataatcaaacaaaatagcacaacctttcgctaatttgaatgcgaggttgtaaggagttggaggagatctgttgttttagctgactcgttatatccttgagtcttgtggttattcctactagtatatagcaagcttcccgtatcagtttacatgatctggatatgcatttcttggctgccaaattaatggaacttgattcacatcatatcttccactaacatcatgtgctttgaaaatacatcgttttccacttgacatctaatcacgattttctgtatccagcagtaacaaatgaacaaagcatcattcatttttcttgaagaatactctgtagctgaaagtattcttttttgcggtaggcacaataaccttcactgaactgcactgaaataaataaaatcactcatcagtggtgatgtacaaaacatatatcgagttttattttattttttgtccatgttgcttatgagaattgttcctgtaaattctgagagtctggcaatccaccaagtttacatccagaaacaaaggggcgttgcatgagctactgtctttctttgcaactagtagaagcaaaacaacctagatgaccaaccctctttacttaccttaatgtattgttacagggtatgaatcacgcataccaatatgtgccacggtctgtaatcttttgttgttttttcttaccattcttgtataagaactgtagtcatcaaggaccatccattccattgctagtttgaaattatgcaattagggaatagaaaagtaccaaaaagggttaggctattaaaaggtgtgtatggtttttatggtgagaatggtgttccaacatttatgatctatgtactgatcatttgattgtacatcaccaccacggaatcgtggatcacccagtatggccccacatgatacatactttacttctaaataactaattacttaaccagttctcatggtggaatcttctgcacctccttgtattgttggagggcgtgtcacatgccacttccttaactcttgagattcgttttagccgtagatctgctgcacgagagaatagaaagaggaaggaagatcccacctggatgcaggatccacttgttttttttaaaaaaaactttatagatcattttgaaaccctctgaaatagtcccctttcatttcgcaaattgcaaaaaggaaacaaaatcagcaattttacttaagaaaatgtccaatgccttgttaactcatgcatgtgcacttggatacttgatgcaataacaaagatatttgaaaagcagagaacatatattatgtttgcattatgcttgttgtgttttgcaagatcaacagttccaccattccactgtatgtttccatggtgtagtagtaagctttaagcaaccaatggatttgtttttggcgtgttgctaacatcttatatttctctccttttcaggatgttaatttattgcaagttgcaactcaaagtactacgcggcataagaaatggagtagaagttcactggctgcctgttttactccggcacacgccctacccagacatgctgcaagttcttatttaacgcactacttgtcttgagcatctgtcagcaaggacctgaacggaggctatacaaccgatgatgacgagaagccgaacatgcatcctagtttgttggaattgctgggctactcaatgttgagcttgttgtttgcctctttgaggaagcccgtacctctcccagacgttggtagcacggataatttgtgccatgccaagctgttaagtgctaatcctaatttatcttccagtactcaggagtcctgtaccgtactttttgcagaaaaagtttgtagtagtacatgcgaggttactctgtttctgtacatcaatattcaagggcacaactagcagaatcttgtgtaattgagcactgacgtacgtagcattatcaattatgcagtgaatccaagtgcttacgcatgcatgtgtttttcgtcgctgcatcaatattgctctgcgttttcctcatgctgctcgatgtatgtcgtctcgcgatctgcgaccagtattttggattggatggtgttgtttgtcgcgcgtatcggtgagaaactgagtataatggaaagccagatcgagatcggtggcatcgccaagcgcaagcggttgcctcgcctggagccggacgnnnnnnnnnnnnnnnnnnnnnnnnnnnnnnnnnnnnnnnnnattatattattcaaagcccac

SEQ ID NO: 21601 - DNA, 1795 bp, Oryza sativa
ccagatcaagatcgtcggcatcactcagcgcaaagtgggtacctcgcttgtaaccgagcacgggtcgcctctggtgaagtcctccagtcagacgcacacggaatatcatgtaagctagcacggcacgtacaacaaatgcatatggttcgcgatcgatcatgtattagcagcaaggtaggtagccgcagccctcacccatgtggcacggacgagcctcaaatgccggaggaaggatcataaagagccctggatattcgttggtgatgcttccaatgttgaacaagctccaacctatcctcccacgaaaaatttggtaattaatcttctaacataaagctcggcaaaagtaacaaacaaaatacaacttgtgcttctcgaccttatcaaatattgagattgctccctgcaaaaaaaaaaaaaggattggtaaaatttgatatacctatttaaattatatggaaaaaacactgaaacatccactcgagagtttagaaccattttccgtttattattgtgtcctcccgatgtataggaatgacagatctatcttgtgtatctataattgtcgatatattacctctttcgggatcatgacaaatcacatatatcacataactatctcgatgtccccggtcccggatcggtatagtgactgtaagttaattaagagctactcaccgtttgatctaatttagacaggacagatcacacacaaaaccactgtttatggtcctatattgcaagagtgcgtaccaccgtttgatgtatagcaagctgtagcatgacacgaaacgttgtttacgttaccgttactgtatctaatttaaacggatcaacggttggtatggccgtttatacgtataccatgagcgatccgtcacgtttagacaatgcatgctctatcactcgcttgcgaatacataattccgtcattagcgattaatcagccattttctatttgtcggtcgtataatagacgtgtacgcttgaagctcttatatgaagagcggacgggaatcacaaacatcagatttcgattaataatcgtccatattttgataattaagttgtttgatggtacgtaccctctccgttcgtccgacatatccgtatctctttgattgttgaaaatcggaatgtacagacgaaattgctttgcatttctcgagctgcaaatcacaacagagatctgaatcgcgacgtctcttgtcccttgacccagttagggctggatatcgagccagctcggctcggctcggctcggcctggcggctcgttatcctaacgagctaaaagtctagctcggctcggctcgtttgtaatctcgagtccagctcgtttggctcgcgagcttgcagtcgaggaggcatcgaaggctcgcgagattagatgatttttgctaattgagtgctcatgggaagaaacaaatcttgggaagacccctccaaccaaaataaaaccaaaaccaaccaaaatccatctgcatttagctcgacaaattaatcgatgggaaaaagaaaaagaaacgcaaagcaagtgatccccaaatcaagcaaagcaagagatccccaaatcaaacaaactggagtagaaaattaaacatttaactcccaacttccagctgcatgcaaatcagttcactcatcaatggaacaaatggaggcactggcctctctgcacgatgatggatgcaggacgcaggggttgtttcacgtggatttggcgatggctccgcaccacgggtgtgggatcatctagagtcgacgtctggcataaaggtattcattaagacgcg

SEQ ID NO: 21602 - DNA, 4001 bp, Oryza sativa
  unsure (1)..(4001): unsure at all n locations
tgatggtancnntttggngttgcgtatcnnnnnnnnnnnnnnnnnnnnnnnnnnnnnnnnnnnatggtggctgcggccgcacccgacgggagtgggggcttcgcgcgccaatggctcggcgacggcttcgtgcttccctcgatcgatgctgtgcctaaagctcaggcagcagccgagcaggacgggctggacggccgacaatgctgccacaagacgggaggagtcaattgagtggttgctattgacctaccacggtgaaaggataaggttgacattggaaggctttatcgtgggtgctgcatcgtgggccttgacacacgcctgggctcctggccagtgatgcctggctcgttttggctcgcgagcggctcgtgagttagctcgagctagctcgttatgactaacgagccgatacatgagctcggctcgttaacaattcctaacaagccgagccgagctgagacgagctaaccacgagccaagcgagctaacgagccatgagcttttcgtccaaccctagatccagtacagtgtcctgaggcatgaggaggccccaacgaattatctgcttcgtttgtttgtaattattaggggatgttaacatgtttagttgctagtcacatattatcacgtctaaggttagacatatttgattatattgacagttgttggttatagtcatagttgtggtaagatttttttttctaataaaatgggtcccatatgtcattgatttatgaaagtgtggcaagattcccttagatttgctaaggtgtggctaataatttgatcgtattaacttaagcaagtgtggcaatatttattgataaataatggtaaagtatggctaggaagcaaatacaccggggcccctttgaattgtaggaataaaaaaacgaaggaataggaaaaacatacgattctaatagggatgtaagtgtaaaacagaggattacaaaatacaggaaaaacacaggaatgatcgtttgattggactgcaggaaaaacatagaaattggatgagagagattgtcggtgacatgaggccgggagtatcatgactagaggcttgaggcagacacaatcgcccacgtggcctggcaccctcggggggcgtcgggcccgagggtgatgtgttcgccctcctctttgtctccccgagggggtcggactgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacaaaccggtcagatcgtgggttaggtggcgacaggcgatctgacgcacgcctcgccccatcccgtcaggacgagggcttctaggcgctcgtccccagctggagctagcgtgttacctcccggagatggcacgttagtcccggtcagatatatgccaggcttcatcctaaccattacaagcaagacattgtatgaagaagggcgaacatgcagattgctaaactgacacgtggtggacaagaatgaccgatttgtgaccggtctgacactggtcatgtcgacggcagacagccatgttcccacgtcgcgcctgcttccggcggaagtggaggtaggtatgggccgtcccatcagaaggtcattcggacggcaaccatacaaatctccgtccatttatgaagagaagtcaagccaagtttgggggaagagagaataagtccccacacaaaaaagaagagatggtgcatgtggtatccccttgagatataaaaggaggaccttgcccacttagaaaggggattcggatccagaacgatcaaggctggattgagaaccagaggagagggtttctagagtaaaagctctctgaccctccagctctttgtagtttttcatacacagatccaccagaacacaggagtagggtattacgcttctcagcggcccgaacctgtatacatcgcccgtgtcttgtgtgcttcttccattttcgcgaaccttccacagaccaagagcttagaatctcacccagggtccccggccgaaccggcaaaggggggcctgcgcggtctcccggtgaggagccccacgctccgtcatctggcgcgccaggtagggggcgctgcgtgtgtttttctaagctctcgtattctttcgtgtgcgccaaccttttcctgttcagtccaatggctgaacaagcaaaggcgcacaacctctctccgagtgttagcggtgacgacggggagccgaacccacgccgtcgagctcgtacttcacccgccccttcacgccaaagtcctaggcgggagaaggcgctcgagagggccgaaggatccgcgacttcgacatccacgggagatggaaaaaggcggcgagatggggagcgtcgccttctcgtctacggcgacggcagcacgccccagggcgcgctccaagctgcgggcgcgctcctacgtcacccgcccgtcgccatgacccggagtctccagcccaacgttggctggacgacgtggccaaattggtcatgacggcacggcagcgcctagatgctggtgggcggtcctccgccgccaagacctctggtactgctaccaccggctccgcgtcgtcaagacgaagggcgcggcgagcggcggccgctgttcgccattcggccgccactccttcgtcagcgcctccgacccgggaagatctgcgtggggggtcggatgcccgcaccagtatcgagcgccggcgtaatggccgacgtgctgcccacgcaacggagggcgcctcctcgtccggggtgtcacctcaacatggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaagtctacacgaccgggatcgaggccgccgggggtgacgacagggtcatggcgaatttctttcccatggccctgaagggacaggcgcgaggttggctaatgaacttgccacccgcgtatgtccactcttgggaggatttgtgccaacagttcaccatgaactttcaaggcacatatccgcgcccaggagaggaagcggacttgcacgcagtacagcgaagggatgatgagtcacttcgctcatacattcagcggttctgtcaagtccgcaacaccataccatgcatccctgcacacgcggtgatctacgcgttcaggggggggtgcggcacaaccgcatgctcgaaaagatcgcctccaaagagccccagactaccgcggagctttttcagctcgcggaccgagtggctcgtaaggaggaggcgtggacctggaacccctccggttccggtgtggcagcttcggccgcccccggatccgctgctcagacagggcggcgtgacaggaggaggaagaagaggtcagcccattccgacgacgagggtcatgtcctcgccgtcgaaggcgcttcgcgggccacccgaaaggggaggcctgcgagcgacagaaagaaggaggccggcgctcccggcagggagcgcccaaccggcaagtggtgcatcgtccacaatacctcccttcacgacctcacggactgccgcgcagtcaaaagtttggctgagcggacgaggaagtgggaggaggagaggaggcaggagcgccgagagggtaagtccccggcggttccttccggcaatcggcgaagtgaggccaagcagaaggcccccgccgaggacatcaatgacggcgatgatgacctaggtttccaagagcctggggccaccattggcactggtgatgggggagcgtgtgctcancgttctcgccggagcctcaaggccatgaagcgagagcttcttgccgcggcccctactcatgaa

SEQ ID NO: 21603 - DNA, 2377 bp, Oryza sativa
  unsure (1)..(2377): unsure at all n locations
ggtccactatgcctacctccagatgaagatgccgggccccggtggccccatctctgtccatggcgacctcaaagtcgcgctcgcttgtatggagcagcgcgcggaccacttttccgccgcgtccaagcccgagggtggcgacgagaggcttggcacctccgtccccgccgccccgaggcagcggatgatcacatgcgacgaggtcccggtcaaggaggttgccctgggcgacggcccgtccaagaccatacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacctctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactacttgaatttctttgggtagccaaataggacgtaacgttgaggcttatgtcgatgacttggttgtaaagacgcgcaaccaagagaccttactctcggatcttgcggaaacttttgagagtctccgctccgcccgcataaaactgaaccccgataagtgcgtgttcggtgtacctgcgagcaagcttctcgggttcttggtctctgcccgaggcatcgaggccaaccccgagaagatacgagctatagagcggatgcgcccccccaacaaacttagggatgtgcaatgcgtcaccggttgcatggctgccctaagtcggttcatatcgaggctgggagagaaggcgctacccttattcaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcatccccaccctgtgctagcttggcccgggagagagcagggaggagaggccaccgagccgaacggtggcccaaggcccccgacgaccggagctggctctctgcccgcttgtcagacggtgccaggtgcccccgacccccaggatggcccggcggccactgcgggaaggccgcacctatcgccctctgaccccgagcctaaccctgtgccgactcgacccgggagagagcagggagaagaggcccccgagccgaacggtggcctaaggcccctgaggaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttggacgaagagcgccccaaggatgcggcccctagcgaagaggatcggccccaccgaaaggtgcagcggcccgtctactttgttagtgaggccctccgggacgccaagacccgataccctcagacccagaagatgctttacgctatcctgatggcttcgaggaaactgcgccattatttccaagcgcatcgggtcacggtggttacgtcttaccccctcagccaaatcttgcataatcgagagggtactggacgggtggtaaaatgggcaatcgaactttctgagtttgatttgcactttgaaccacgccacgctatcaagagccaggccctcgccgattttgtggcagagtggaccccagctcccgagcccgtctcagtccccgaggccagctccgacccctcgcaattgcctcacaccgcctattgggtgatgcagtttgacggctccctgtctcttcagggcgccggtgctggggtcacgttgacctcgccgagcggagacgtcctcagatannnnnnnnnnnnnnnnnnnnnnnnnnnnnnnnnnnnnnnnnnnnnaactaaacactct

SEQ ID NO: 21604 - DNA, 879 bp, Oryza sativa
  unsure (1)..(879): unsure at all n locations
ccttgcccaccccaagagccaacggccaaggggagcgcgccaatgcggaaatcctcagaggccttaaaaccaagacctccaacatcctcaagaagcacgccgatttgtggatcgagaagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgtggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccatatcgagtgatcggcgtcccccggccgggctccgttcggctggccacgggcgacggcacagagctgcttaacccgtggaacatcgaacaccttcgtcgcttctacccctaagggggatcgggtgtcaggtttcgggctcgggccaaccccgcacccccttcaggcgtgcagggttggccgggggctaccacatttgcatatcttttcttctatctgtatttcaataaaagcattttcgatttcctaaaggctgtatctgtactgttgtttccttttgaagaatcttaacttgaaataggtcactcgtgctcaatcctgccctcgggggctcgggtcggctaaaatnnnnnnnnnnnnnnnnnnnnnnnnnnnnnnnnnnnnnnnnnnnnagtataataaaacctct

SEQ ID NO: 21605 - DNA, 730 bp, Oryza sativa
ggccgtcattgaatgagactccgatcgtacccccgatgggccgtaagcttatgaaactcatgccgtcgaatttatccaccggtctaatatgaaaaaacagagtgggattcagatattagctcgggcatgctcaatttatgtcgtcggctcctgcgccgaccccgtgaggagccttctaagggtggacaaaaagctcgaaattcgtggctcggatcggctcgtagcaagctcggctcggatcgactcgaactcgtagtcttaatgagtcgagtatagctagccttttagctcgtgagcttaacgagctagctcgcgagctgctcgtttagctcgttagtataaaatatcactaaattttcatgaacttagtatttattgactagtgcttagtcttttagttacatcaaaactattcatattcagtaagtattatattagttagtgtttattattatgttaatatataataaaatgttaaaattgaaattattaatacgatattaataagatatagctcgttaacgagcctaacgagcttaacgagccagctcgcgagccgagccgagctagccttatagcttattaacattaacgagccgagccgagctggctcgttaagataacgagcttaaacgagccgagccttaacgagacgagcttgctcgttatccagccctagagccggcgcgtagacaaaggccggcgcccgtttcaacgccgtaaccggccg

SEQ ID NO: 21606 - DNA, 1676 bp, Oryza sativa
  unsure (1)..(1676): unsure at all n locations
nccgttnccaggngtgcangnacnaggcnngngangnnntggannnggattgatgcttgaatgatgtttatatccagtttcaatagttgctaggcccctaacgagctttaatcccggttgatgataccaaccggggaataaatatctctattcccgtgtcatctccatctctcgcgcgctctctctttccttatctcctcgtatcgcgcgcgctcagcctcctctcttatcttctttctattccacccctcccctccacactctccttcgtcgatccctatatcatttggaattccacctgttaactggttgagtgacaaggcaacgataaccatataagaaatttcagctgcaccatactttagttcttgatgcttcattacttgagaaaaaatttccatgggtacatattttcctatgacatcttggtaccaactaacctccgttaatatcatgtgacgttttggtgtcattgatgttaattttatcaaatgttgaggatgaccctgatatgttgttgcctgctaaattcaagaatcgaatgctgtcaagatttgtaatactgtttggaatatccccatagaacatgttataacttaactgcagatattgcaagttcaccaagtctccaatccatactggtaatgctccatagaacttgttccttgaaagatctaggaaagttagtaatgatatactttggaggcataacgggaattctcctgaaattctgttgttacttaagagtaggagaaataagtttggcattctaaaacagagggggaagttctccgtcaattaaattatttgactagtccaatatatacaagttttacaacttgcaaacagtaatatgattgcaggacagtattagatctttaatacatggagaaccaaatttttatggcaaattccctgacaagaagttcatggagacatccaatttccggagtcttctcggcagctctggtatctgcccagttagtttgtttgaattgagaaataatgaatccaaccaagtcagattctgtatacctactgctataggtccactaatgctgttgtttttaagattgagaaagcttatgctctttaagtgagatatctcatttggcaacattccagtcatgttgttgccttgcaaactcaagtatttcaatgggcttaaataacatcgtggcaacttctcaacaagctccgttatgttcccagatgatagccccccatcaagtaacagtgttgtcaattcacaaagattttgcaagtctactgtcattgtggctctgttaccgttatcgaaaaaatatagctcttggagggacctcattcctcctagtgcctcaggaaagggaccatcaagataggtttgagagaggtcaaggatcttaaggcttgttactttctgttggcggatggcatgaggcccttcgactaaatctgccgaaacccgtggcgaaggctatggagcaagaacggcgtgaggcgaagagtcgtacgagtgccttgccaggccagaggcgtctcaagcgaagggtgcaaggcgaagactatctgccgaaggaagacgacttcgccatagcaagttcgcccccacgagggccgaggaagcctttccggcccatcaagcctaaggcctacagggccggcgatcaccagatggcccatcaggggcccat

SEQ ID NO: 21607 - DNA, 851 bp, Oryza sativa
  unsure (1)..(851): unsure at all n locations
tgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgacgaaaatccggtaaccgcaactatacgcaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaaggaattattaattcccttgaaaaagataatggaggagggaccggaatcagacttttaggccaagcgtgaggcgcagcccaaggaattgcgtgcgcngtcnaggcgagtgggtcngcgcgcggna

SEQ ID NO: 21608 - DNA, 737 bp, Oryza sativa
  unsure (1)..(737): unsure at all n locations
gctgtgcattganagtcgagctcggcacccatataagattactttatttgtaattagacttagtatgtaattattgactacggaattggtgcgacaagtagcaattgactattgtagtcttaattagacttagcatatacgcacgaaacacttagcatatacatgactattttagtcttagcatgcatgtaatattatttgagttttaatataagattattttatttgtaattagacttagtatataattatttactagctagggttgtataatatacgtcacctagacttagcttatatcatgatttgtaattagacttagcacgtaaggttgtgtagggttctaatgtacgacatttacacttagcatacatgacttagattgttaaaacataaatgtctcgtaacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaacagggcacgcgggcaacgaggtgcagcgaagaagcttgagggtcagcacatcataacggaagtggaagaagatggacct

SEQ ID NO: 21609 - DNA, 735 bp, Oryza sativa
cgggccgttattgattgcgatcggctcgtacccgttatgaattatttccatggaaccctgtatcaccatcttcatggtgagggtccaaggtcgctatcatggagcaataggttgaggatcgcagccgaaattgcaaaggctctttcctatcttcactcatcagttacaatcccaataatccatagagatataaagtccagtaacatacttcttgatgataatctgacatcaaaggtatcggactttggagcttcaaggtatatcccaatcgagaaaacagcactaacaacagcagttcaaggtactgtaggatatttggatcctatgtacttttacacgggtcgtctcaatgataaaagtgatgtctatagctttggtgttatgctagtggaattgctcacctagagaaaactatttccatatttgtcctctgaaggtgatggccttgttgcagattttgtcaacttacacagtgtaggtaatttggtccaaatgctagattctcaagttatagaagaagggggcactgaaatccaagaggtttcccaactagccatatcatgtatagaattaagaggtgaggatcgacctaccatgagacaagtgaactgttcactcgaaggcatcctctcacaaatcaaccaaaaatgaattatgtcatctgagaaggatgcggaggatagttcactggttggtggagaaatttgatcttcgagaaataaggttgatggttat

SEQ ID NO: 21610 - DNA, 1786 bp, Oryza sativa
  unsure (1)..(1786): unsure at all n locations
atcgaaccttgggtctatatgattaagtgttttactttatgtcgtccttctaacatttcctgngggtcttaattgtgnnctaannnnnnnncnnnnggcgganatgattgtgatcgactcgtaccccctctttttcctctctctcactcttcctctctctttctcgccagacgacggcaggcggtggacgcgaagctgcggtggggttgggggacgaggaggcagcggcagccgggggcactatgagcagccaccccttggcgcatggatggatggaggtgggtgcgggcggcggcgcggcatgcggagacggagaagcgcaccggcggcgtgctccgcctccccgtcattgacggggttctagcgcctgcgccagcccttctacgccggcgaccttctttccgtgccgccgccgatcagaccattttctgcaacaccgttgccgccctgctcaccatgcaagaggtccgcagcggcagctccacttttccctcccgccgatgaccccgctgccggacttcgactagctcattccagtccgtccagccgcggccaccggcgtcgacgttaatccccacgtagtcatcttactgtgtcacggcaaatgccaatattgcgacgagctgcaaccgttgtcaaaaaatttattggcaaacgcaaggtggagctatgcctctgctcgccattgatgctgtcgacgcggtcgtgcgcaaccgatggcgccgacaggcagcaaagtgcgcccaagatgctgtgcggtccacctgcagcaaaatcaattcattcactagtggcaagaaaactttctgttctgcaactcatgctctctgtgaatgtgcgaattaagtagtagagttgctagtgtcttacgcttgaacccgtcgttgctggcctcgaggtggttcgacacagcgtcgccggtgacgctggccttgaggaagtactcctccaaccaagccgtgacctccgcaaggctacggcgcctcaccaccatcctcagctcctcaccaccgctgccgccgccttcttctcacgtgactgacggcacctagggatgcaagcggggtaggctagcgggctttttttttcccgcttatcccacttctacttcattttttcttctaaattttatactatcatacgagaaataaactagcaagcaggtttttatacgggtagcgggacaacccacttgcatccctaacgacacccccgccccgccaccaacaagatgatgatcatcaacagtagcgccatcctcctcctcctgcgtgcgccgacgccgctgatgctcgatggagagcaggtcggtggcgtagaagggctggcgcaggacaccggcgatgatggggaggcggagcatgccgccggtgtgcttgtccgtcttcgcgttccgcaccaccggccgcacccggcttcatccatccccgcgccgagggacggctacttgtcgtggtcgcggccgccagcgccttctcgtcccccgccgacgcagctccgtgtcccccgcctgccgctgaccggcaagaaagagagaggaagagtgagagagagataggagagaggaaaagagagagagaaagagtgagagaggagtatgacaggtgggtcccacatttctttataaataaaatgcttactgaaccgctgcccatacgccatgtangacaaaaccgctctggattgggtcgatggggataattcgtccggtattgatgtaaacgatgtctgggtttcgaagttaagggggtaattcggccgacacaatagttcggggcggtattcg

SEQ ID NO: 21611 - DNA, 3098 bp, Oryza sativa
  unsure (1)..(3098): unsure at all n locations
atggnnnnttggaaaattgatattcgagctcggtaccctgctcgtccagatgcccatgtgcaacgagagagaggtaagcccaaagcaaagctccaatcatttgctccattgccctcttaagttggaatttcagattggctgttcattctcttgctatatgtacatttgtatcttcctggatcaaaatattcgaattattttagctgcaattgggattcgatcccttagttctagttctcctctgcgcgaattcagcaggaggattctgctgattttgtgtagactctgcattagattggtttggatctttgacctgtgttcctctttgacccggagatgttctgcattaacaacaacttgggtggtttctgaagttttaagttgctgtgatcttgcttgctcaatacactataacaagagcaaaaatttggtgtttttaaggttgaattttgccgttgggtgtcgtacctttcaagcatacttattgccctgattctctgtctggatgttgtcgtcaaccagaagacatgctaattgaacatcaaactgggcagcatagcgtactccttttaagactagagcgtgctacgcacaatttggaaatctgaggctcaattatctgagaggctaggccaattcaattgattccatttcatctggatgtttgcaggtgtaccagcaatccattggggcagtttgcaacctggactggccaaagtcaaacttcttggtgcaggtgttggacgattctgatgatgctaccacttctgcgctgatcaaggaggaggtggagaaatggcaacgggagggcgtgcgcattatataccggcaccgggtgatccgggatggctacaaagctggaaaccttaaatcaaccatgaattgcagttatgtgaaggattatgagtttgttgtcatatttgatgccgatttccaaccacaagccgatttcctgaagcgaaccgtgccacatttcaagggtggactcaactgaacaatgctggcagttgtaaacacggtggtgctttgcttctatgactatgaaccggattagttatattttctgacatcttgaatgttgaattccaggggaaggatgacgttgggttggttcaggcaagatggtctttcgtaaacaaggatgagaacctgctgactagactacagaacgtaaatttgtgcttccactttgaggtggagcagcaggtgaatggtgcattcctcaacttctttggattcaatggaacttgccgagtttggagaattaaggcgctgaggattcggggggctggatggagagaacaacagtggaggacatggatattgctgtccgagcacatcttaagggatggaagtttgtcttcttgaatgatgttgaggtacaatcaataatttcttcgtggcttaagcagaatctgcattgtataaatgtcaaagactaataatttgattcatgtgatttcccttgcagtgtcaatgtgagttgccagaatcatatgaagcgtacagaaagcagcaacacaggtggcactcaggtcccatgcaattgttcagactctgctttgtggacattataaaatctaaggtacgatacttttcttctgtagcactgtgaaagctaaaatttccagcaatgcatgtactagcatagcctgtaactgtagtttctttgctagagtcactttcccaatatgttatgggtttaatgagaatttacaagatggagtagttgttgagaagcatcaaccatggtacctttttacatgtttgggcaaactttatgcatattatcttatattgaggcacaatataagaaaattgaacaagatgatgagttgctaaccactcaagcaagttaccaatgtccataagaattctctgtcggttcacttgattgaaatcatcaaagaacttatcacaatctcgtaccaggacatatactaattaagttttttttatcccttcttcatatttgatttctacctattagtccacagtttttatactgtttcattggataattaacctaatatcgctgcctaatttcttgtgcagattgggttctggaagaagttcaacctcatattccttttcttcctcctccgcaagctcatcctacccttctattcattcacacttttctgtgtcatccttcccatgacaatgtttgttcctgaagctgagctccctgcctgggttgtatgctacattccagctacaatgtccatcctgaacatcttcccagccccaaaatctttcccattcattgtcccataccttcttttcgagaacactatgtccgtacccaagttcaatgccatgatttctggattgttccagctcgggagtgcctatgagtgggttgtcaccaagaaatcaggtcgttcttcggagggcgatcttgttgggctagttgagaaacactccaagcagcaaagagtaggatctgctcccaatcttgacgcgctaacaaaggaggagtcgaatcctaaaaaggactccaagaagaagaagcacaataggatctacaggaaggaactggcactttccttcctcttgttaacggcagcagctcgcagtttgctatctgctcagggaatccatttctactttcttctgttccaaggggtctcattcttggttgttggtctcgacctaattggtgagcaagtggagtgatagaagatgaagagtttaatggggttcttttttgtttgaaagaaaacactttgcaagcatcaaagggctctttgtaaagggaagagtgatgcaaatgttcgatgcttacacatggaagctttgatccctattctaggggtcaagattcatcacatatactgaactgtggagatgtagatagatatagtttggattaagcctgtgggatgcttttattccttcaggcaattcttttgtaagaatcttttgtgcctagatgggttttttttctctcttaacaaactttaccttcaaatgaagataatacatgtttctaccatgtactttgatcgattaccttgggtatccatatacatgtcagattgtccttttttttcatccagtatatagngtggggtacaaagtgactntaatctctn

SEQ ID NO: 21612 - DNA, 4085 bp, Oryza sativa
  unsure (1)..(4085): unsure at all n locations
ataatgttttaaaagacttttaccttacttccaaaatgaagcccttattaaggggccttttgctccatgctgtcttgggctttgtcatgtgcattggctaggccaggttgttttgatttctgttactatcattgaaaaagacaagtacgcccaagtgtgctccttgaattgcaacagtccatgtggaggcaaataggaaatactacaagtgacctgtaaaccttgtttggcctgttgcctgatggtgcatgttctcctaaccttccaattgttattttcatatcagaagctacctactcaatatttcctctccactgaaaagtacatctgtttgatggcacggctcttgtattatttaccttcaacctctagcaattgttttcttgcccaatggaacgcacatctgcttgagaagcttctcacagaactcagttttgaggcagtgattcttctcctccatcttctcctggtccaaagtataaaaaaaccagacagctttcactgcatatcaggccagaaattctgaagatgtgatagggaaaatggatatgaaaatgctcgccggtggcgcgtgcagacaaggcacatggcgccgattctcgcgaggaaagagaccctgtgtccatcgctctccgagatccaggacataatcagacacccttactaggctgctgctgctcctccgttcgccgagttctcgtcgtcgtcgtcgcatgtcgccgtgacaccgacgtgccatcagcctccctcccccctcgttacgcttgtttttcatgcgctatcaccgcgatctcgtacgtattggcatccgggagaagagaagaagagagagctgaatttgaaagcaacgggtgcctgcctgcaacatgcatgggatggtgtgttgccctttgccatttgcccctcccccatgtgatcgcctcgtccagttccttaatctgctttggccgcgtttgactgcccccgcgcgccggcccgcgcgacgcacgcaggcacccggcgtcaggtgcggattttggtgcgtgcgcgactctctcgcgaggtacggcgcccatgcgtgtccccagatgcggctcacatgggctccatctcacgctgcccccgccgcgccaagctaggcagatgctgagatgctcccctccctcgcgctgtgcgtgcgtgagaggcgccgcagacgcgcggatttccccggtgatccggttggttttgtgctgctccactgggttggctgctgtgtgcgaccgtgactacgttgctctacggggccgtgccgtctgccaatctgttggcgcggtcggctggctccgcgatagattatactacccggcaacagcaaggcagctacagcgtctacagcctcacgcggcagcagcgatcacctgacctgaccgtccttcctcgccgttgaacatctcttgccagttttactgcatactaatagtgctctactctagtggttgggccaaatgaatcgccattggttgttcaacaatcaacactcagcggtcacgtgtggatgattagcattattgaagcggatatttgggatctcaagcatgatgataatccaaagtacggtgagcaaacagtagactcttgtcgtacgaaaagagcggcgacaaggaaacttcagatcaaacacagtggttgtagtacgtaccttgggttataacagcacgcccagagggctctatgtacaggcagagaggtcaataatacagatgtagtcgccatcagcattaacacgagctgaggcattgccctatcattacggctctaagcagggtatcccagactgagcaagtttgggggttcatcacttcatgggcctaataataacaaagtaatgatcccttaatgcgtatctgccgctactgaaatgaagccagcatgtgcttatgggactgtcggaaagtgatgattgcactgggagtctgggaccataccttgagcccgcctagctacttcgctatccctttattgccatcgtcatcgtcatcctccagatcactgaacgatacatcttcctcctgtccccgtgaagttctgttaccttctgtgccaaccacctcttctgcatcgtcgtcatcatcaggccattcatcaacttcatcttcatcagtctcggaatgaattttgggctcgatggctaaactcttggtttcatttttcactgacaactcttcttcaattaccgacttgtctactatttccatctctgtaattgcaatggggaacttttcagcctcgacatctggcgagatatcagaactgggttcttcgaacgatgaaacctctggttttccagctttgttttcaatgcttgaaggttgtatcactttctcttcagcaggggcagaggacataatcacagtttttgatgattcctcttcctccggaacctcagatcctcgcttattcttagtctgtaaactttgcagcaattcctcccttgcttgtaggatctgaatggaagagaatgtttgaagtggaatcagactaaaaccttggcatcagaaaatgtaaaccgaggaaagaagttgactgtgttacaacacaagaactgacaatgcgcccagctagtcaaaataaagctgcatctagattagagatactgggtatactaccctggtacacccttcaatttatttgtgtgtaaacataaggggtggagtagtggaactagatatggtacaagtccaggccagccaactattttgggctgcctttgcctatccatggtgataatgagcacaaattaatgggccagttccaggccttggaccatggcataggtggcccaaggtctcagtccaccgacaccgccactgcacataacagtacttgagggtagcccattctaggcacaacctgtatgcgctaaccaagtcatcaaataaggtatttcacatgtgaaggggtagggtggttatcaagaatttcgtggtaactaagatagtggtgctaaactactatataagctggaatggctcaatttcctccccttcttattttggtttaagaagctcatcatgcatttcaaggaatacaacagattccatgataaattacttgttaaaaaaatattaattgcacgataatggaattacctgtggtgttgaaagaagttcagcgtcttgcttgttgagtttcgagtgcagaagcacaaaatatatcttccagaaacatgcttcactcatatcagtagagcaaatggcagcttttatatctgacaggcttggcacaaggtgctccatggataatgcatgcacatactgagcatccgaaagttcaaagtctattaaaataacacatttgttagggagtagatcataacgttagcatacagtatgacatagtattatactgcaagatgtaaaatagtagtgttgattattatcttttgcagctttgattctcaaagaaagctggattttcgaaaaggacacgaagcattcaagaagtttgctgtttaaagctattaaacacggtactaccttctgatgaataaatgatattcttgagacattatatagatttgaacaatgaattcattgacagaactttaataagtatataaaaaatatgcagtccaccagacggccattatccaaaagaaagatgagatttgaagccagtgtacatacaggctatacttgcaaaatatatgcttgcactaatacaccataataaacttggtagcattcaacagaaacataatgaaatttcaaaatccagtatgatcttaatctgtttcatttcctgtgtggaactaagccatcttgtcattgtaattagtattacttctgaatttccataattaattcatatcttcctagtactattgagtcagtctcgaagaccagtgcacgaaataacggaacataaaatcaactaagaatgttaactttggaatggaaacatgagtcataaacaaaactctgggccctgataattgtctcctcaagtcaagcaataatgcacaaatccaacataagtactagcacaattcagtataacctgnnnnnnnnnnnnnnnnnnnnnnnnnnnnnnnnnngagaatgacgatntgcaattcacacgcg

SEQ ID NO: 21613 - DNA, 2667 bp, Oryza sativa
  unsure (1)..(2667): unsure at all n locations
ggggatgattgcnnaatganatatcnnnnnnnnnnnnnnnnnnnnnnnnnnnnnnnnnnnnnnnnnatttgaggacacttgaccatagttttgctatgattaacaacgtaacatcctgaaaatgtgtcattttctaatcttgcaccatgctgattcttatattcttaataaccttctaaacctaggaaaatataattagcaggacctcctaaaactaacttgcataaaacctctctggtatttagtcccttttgtatttttcatttaaaaacatatttggtatttcttgttggaattctgtttcgaatattaaactttctttcgactaaagctcttttattcaaaatttagtttgaaaaccatttttactattatgaattatggaccaagaaatcctccaattttgccttgaacctaaaccgaagtaattccaatctcattggaattaattgttagcccatcctttgatcttaaactcatcctttaattcttgatccaaatatccaaattcctcattttaatctagccatcaatttaatctctgtggcttgattttctcttcggcacaagaatagtattgttgcaaatattgtgaataattgctcttgtgctaagaaaattccaacttatactcttcattcaatttccctttttagccacaaatatacattctaccaattttagaattggagccgagcagctgtgctgaaagctgattgggatttgggagccggtgttcagagtacatgaaagctgattgcagaagagactttagatagcaacctgtagcttgtactactcccgaagagttttggttttctttttgcttctgcaatataaacggatttacatgcttcaataatatggtgtttgttgtgacttatgaacatggtgttatagacagggtttaatttttcgtttggccgattctatcggacatcattgatataccgaaatttcggtccgaaatttctaaaattttgaacaaatgttgatcaaatttaaatagaatattaccaaattcacaaaagaataaaaaataaaaaaatcggacgaaataatattgtatcgagagtccgaaatgaccaaaattcattccagaatttcttacactggttgtagacatacatatgtgttttacaatctatatatccatctgttcttggttagcagcatatttaggctgtgttcgggagtgaactctctgacacgcaaaactaaacagcgtttagcctataattaattaagtattagcaaaaataaatttgataggattaatatgattttttaaagtaacttttatatagaaatttgtttgaaaaaacacatcatttagccgtctgaaaagcgtgagcgtgaaaacgagggaggtgggttaggaaagtagagataaaatcagccttatctattctgtcttctgatgaaacaacggctcaattccatgtgcagtcggtaaccgtggcttggcgtccgttccaacgagctgaggaagacatcggcttaactcaaggaaaacgcttggctgcagcaatgtgatgggacacgcgtcgcgaactagcaatttcgcaccaggggggcgctgattgtcattttttcctctcttagtctctcttctctacagcacatgtatgtatatactatatatatatatacatgtgtataaattttgtatatacatatatggtttatatgcagtatatatatacatgtgtgtatatatacatataattttttatatgtacacacttttaatataaaaaaatatacacatgtatataaagtttatgtgtgtacgtataaaaaacctaaaatatatatatatataaactttatatatgtgtatacaaactttgtatacgtgtataaaatattgatatatgtacatataaaaacccacaaaatgcacgtatatacaaacttatatgtgtatataaactttgtatacgtgtataaaaaatttgtaatatatatgtataaaacacaaaaaatacacgtagcatacgagtatacaaactttgtatacatgtatataaagtttgtatttgtacatatacaaagttagcatacgtacgtattaaaaccgaaaaaataaaaaaacaaaaaaacgaaaacagaaggtacggaataaacacagaaaaaaagagagggaaaaaacgggagccaacgcgcagtccgccgcctcctctcatgtcgcgcggagggacgcgcgcggtgcggcactgccgcagaccattttttgccagccggaaaatctatctgtgcttataaatagccattatccaaagaacacaatccactaattagtcgaatccagagctattaactcctctccggtcgattgggtcctgcgtctggcatccatgggcatcttgaatcactccgacgccgcctttcctgtagctggtactacgccactacttgggcgccgcccgctggaagccggcgagtttcggcgccagggaccggaggtcgtcgacttcattggggactactacgccggcattaacgactaccccgtgcgccccgccgtcgctccaggcttnctcgccgggaagctctccgcgacggcgccgtcgacgccggaagccgacgcgctcaccgncgggctgcgcgacgttcgcgagctcattgctccggggctcactcactggcagagcccacgtcact

SEQ ID NO: 21614 - DNA, 1658 bp, Oryza sativa
gggggtttttaccgcgttgggcccaaagacaacttgtcctaaagacccggcccgcggccaagcccccaagggggaccccccccccacccgcggtggactacaggacggccagtcgcgttaacccgcggttcgcgcgctaaactgtggttgtcctcccttccccgaagtcacggccttgcgcgccgtcgtgcgctcccacgtccgcatgccgcccgcgctcgagcgcatggtgcgcgccgacgcgcggttcgaggtgcccgtcccaagccagttcgcgctggtctgcttccggctgcgcgcggccggcgccgccgcacagctcgtcggcggcgacgagctcacggccagcaacgagctcaacaggaggctcctcgaggcggtgaacgcgacggggcgcgcgtacatgagctccgccgtggtggccggcatgtacgtgctgcgctgcgccgtcggcaactcgctcaccgaggagcaccacgtccgggaggcgtggagcgtcgtgcaggggcaggccgccgccgtcttggccaccgccggcgccgccgctgacactgctcgtaccaaggaccacgccgccggcgacgaccatggcgcagatcagccgcacgcgatgacgacgacgacgacgatgggatgtcgctccggtccatgggagctgtgaactgtgtatcgaacactccgttcttacgctgtgtatttcctcttgggcaagtaaattggattacctttggttagagaggacagctggacatgccagttgttttttcaaaaaaaaaaatcgtatttgttaggcgagtttgaccggacaattaattataaattagtttttgatgatatgatatgccggatatatatatatgctgtcggtaccttttccattgttttggaggccgtacgtctctaaaatatttgatgatcagcgtaaacgttttgcacgagcttataaacaatgggcggaaacaaaaataaggcaattgggtgattgttgggcatgctcttagtagtaatggccactttgaatcaaaggaattataaaggaatttcataggattgaaatcctataggaaattttcctatgtagccatttgattcaaaggattgaagttttctaaatcctacaaaatttttatggaatggcttattgcatataggttttgaaggaaacttagcaagaggtccaacctcttggtaaaaatcctttgagtccatctctgacggagcgtggggctcctcaccgggagaccgcgcaggcccccctttgccggttcggccggggactcagggtgagattctaagctctctgtatgtggaaggttcgcgagaccggaaacacacaagacacgggcgatgtatacaggttcgggccgctgagaagcgtaataccctactcctgtgttttgggagatctgtgtctgaaggagctacaaagtatgagccaacctctcccttgttctgggttcccaatctggaaaagtccagtccccgatcgttctcggatcgttccccttttctaagtgggcaaggtccttcttttatatcttaaggggataccacatgcaccatctttcttttttgtgtggggacttatcctatcttttcataaatggaccgagatttgtattggttgccgtctgaatgaccttttgatgggacggcct

SEQ ID NO: 21615 - DNA, 739 bp, Oryza sativa
  unsure (1)..(739): unsure at all n locations
gccccgtgatganttcanatctnatacgccangcctgcagtctactttatagatccccctttatcaatacatactacgctctgcatccagatagtgcgcacatattactatttgttctccaaagaccacagatgaaattaaggggatgttggatgttacaaaatcaaggagcgactgcaggcatgtaaacatgagtatttagatgactccttgggctctaatcaaacatttaatttatctctttatttaagtcttagatgcataaagactacaaataggaacaacttatttggaaaaagttaaatgtgaaatatatctaacttttgtggatggaaggaggagtaaactacatcaaccacgaaacacaaaggctcaggtaaccacactaatcccctccttcctcctcctatctgggagctagggttaggaggcagcagagcaccttcgacaccgtcttcgaccgaccgatcgaccgaatccacgaacggaacaccgaaatcgggagggatccggatgctgcgaagcggctcgcccgtggagctaggacggcgagcactaacctgctgcgaggagtcgtctgcggtgcgggggcggacgtgtactacgaggtggggagggaagcctctcaccacgcggcaatcgtttgcgttcaccgacgccaccggcttcacctcttgacgaatctccttctcagtcttccgcgccgcgtcattgcctttcgtgaagatttttcttttta

SEQ ID NO: 21616 - DNA, 1124 bp, Oryza sativa
cctgtcccttgttgatacaacctcatgcttgcccgcccgcaggtcgactctagaggatcccccctagaagatatacccatactaatcacaagccagcgtgtggtccaggctgagtttagagtataactcgaactagtcaacatatcatggcaagggtagaggcgatggtgcaggacagacttggatttttggtctctgctgcttccgaatttacctaggcacgagaggggactgcccgctgcctgtataggagagggggtgaaacctaaggtgggtgtattcattagggagagttatatgatgggttctgtcacgacctctattcgggtacttcggtatcgcgactcatggtagacacgatgttgaggctgtgtcttgtgagtaaaattgtacacctctgatcaaagtaaaattattcgaccagctcgtcttgattagtctcactttattaataatttgacttaatgaacgggtatagttcaggtgatttggttgtgcctgtttcaacgtggatttagcgttgtacagtgatgtttaatattgctcaattaaatatataatgttttactgctttcatcttatgatttataaatgctgcttttactacaaatatcctatgagccactcctttgaatatctctgcctcagtatgacttgttgagtacggtggttggtactcagtcttgctttatttctcacccctcctcccaagaggcagagaatgttttgaatggtgagttctatgaagattaggcttgtgccggacatcgaggttttgcctgtggatttggaggaagctacgctttgctaaaaagattaagtttagatggtctttagtttttccgctgattttctgagtttattttatatttttgtaagttgtggaactatatcaaattatcatctgtgtactctggctggtcctggacagagattcaatatacattctgcttggaattcgggttagcgaatttctgagcgtgacaaccaaacacctcccaaagtaaattgctattggtgagaaattgtgtgtattttggtggtatttcaaacgaataatgtgttttttcagttccatgattaaagaggtgtacaagagattatatggatcacgattcagaggt

SEQ ID NO: 21617 - DNA, 1499 bp, Oryza sativa
  unsure (1)..(1499): unsure at all n locations
aatttcgataagcattagatctgtactttgacattttccgaaaattcctcaaactcaattcagaaatttgaaagtgaattcaacttttacctttcaaattaattttttaatcagtctttcctcatttacaatttgttcagattctcatatatcaaaatccaccccaagataaaaaaaaaatccttatgatccgcaggatgatggatgataaaagaaaacacaaagatttttctatgggtagatagcgaagatattcctaaattaatttttataatttgatataactaatcattattaatattatgttttaattaaagtattagttatgagattaatcctactttgatccccttggtgatcgaatgcaaacatatatttacatatacatgtaacaaagcgcaaaatctttaatacgtattcattagcacaatactgatatctcatctatacactcaagcagcaaatccaagttcacgatgagcacaactatcgcatgtttctggttagcatcaaagcttccaacgaagcatggtcggacacgacaaacgaaacggattaagtaaagaatcaattctcacggatgtacatgctttggaaacaattgttgtgaacacacgcgtttccgtaacaataatgtagcataccgcagcggagagaaaatgcggagatcgtaggacgccacgatgacgcaagcagatgggaatcaatctcggataaaaattatgtcaaaaacatcttcaatttttataatagtagagataccagtcttcacgctaagtcacgtgttattcggctgcttatacactggcacggtatatgtttaattgataattattgaaaatataggtgcagtgaagtacctactttataatttgccttaaatatatggcataatttgaattaaagctaccattaaactgattacttttattaacacaaaattttagtcatttattaaaaaaatatttaaggatcgtagcgttagcacgggtatattactangcttcttttatctaccctataattcaccaatgtatggtacattctcatttcacattgatcgggcagggatcgcccaataaatncaacggcctaacgtacttccacctctccataactctttncctacaaaacccgtccgtacggaaggctggcaatcttcccttaagcgcaattttggtcccttttcccgagcgcagcggggcttaattgcggtgcactgagatgaaaatgccgggaacaaggacaaccgggcgttgtcttgcctaacttgccttttcaaattcttcggggggttaaactccgcggtccttaacgggttgagggcaatcgggtgccacggcgtttgaaatttccgggcaaaaacatgggaacaccaacacccggtttggcacagagaagggagagggccgccacacttgggatagtggcaaccggattataccagggcccttgtggggggagggttaaataggggagaaaaaggaccttttgtttct

SEQ ID NO: 21618 - DNA, 1802 bp, Oryza sativa
agtcatccatcccctcaggcgcattatgggctccctttttccggaggggcagccgtcgcttcaaatcggcgcttgccattgatgatcgatcatcgccggtgcccaacggtacaccggggtcgttgtcctagcctcacctcgcctcctccgatttcctccgcgtcgctataactcggtcgtctccctcaccggtctgtagtggccattcggcatgccatgaacgtatgtcaacttccccggcaagatgacattggtgaaccgcacacgccggctttgcgcacatggcgaggggcagcggtccggccaagctcttggtgaatgctggcaacaccggcatactacgcagggacccgtttggggagggagaggagataagaagtaggggaggagaaagaaaggagacgagataaggtaagaactactgacatatggaacctatatgttttgttttcatttctttcttcttttgtttaatttagttttcagtggcacgtcaatgttacgtgggacaagaagcaagacaaatcattcacgtaagtcggttctatgagttaagagacgttatatcttagtattgcgggtttaaggacatgattcaaactacaatagccacgtcatgctgaaaacataggccgtccaatttttcctccaagcattgtgagcggttggatcctacaattggtgaaagctcttttcggtccttccagaaacttgttttgcaaacatgtcctcccacatcccaagtcccagtagaccacccccatccaccgccgcctcctccccattccccacggcaaccgcttcctaaaccctccccaccgccatcgcttcgtcctcaccggcgtgatggatggtgttgggggagtcgccaaatgtgtcagctgtctcatcgagcacaccgactctgccttgttgaggaaaggagacacggatgatgaggagaagacgtctccttcctctcactatacacacgggcagcataacctgcgccatgtggtgccgcctcctcttcgtaccaacaagcccacgcccctttcgccaccaatgtcatcttccctgattcactgccggggcgattggagtggagaatcccatcttcgtcctcctccatccaggtatgaaagcccaaatcgacgagcactgacttagggccctgtttctttcagcttaggattattataacctagattattgagtcagattactataagctagattgttataatcagtagtagaataagcggttagttgtttcttttctagattattagagcttagattattgggtttgcaagtctaaagagggagtggggtagcatggtgggtaatttttcacccaataatctagaaaaagctcacctaaatgagcttatcagattataataagctgggctccagattataataagctacttcaataagttgtctgtttctttcagcttactcttaataatctggattataataattccaagctaaaagaaagaaacagggccttaaaaggcttaaaaggcttaaagctgacgcgatcacctcttcctacctctcatcggcatcacgcactcctctctcccccatcccgactgccctcgtgaccatcagatgctcgataaattgcttgcatggacattaggcaaggtaccccttcttattgtactaatggaagtgtgctctacgtgtacaacttttgtagctaataaatcaagcaccaaaatatgcacacattttaacatctcactgctgattaagcttgattacggatgaaaagaaaatccagcgatcagctcacagtattctagttt

SEQ ID NO: 21619 - DNA, 855 bp, Oryza sativa
  unsure (1)..(855): unsure at all n locations
aaatgtggcctggaattcttccattaagctgattccatgataaattcaaatttttaatgccatcgagaagagttagctcctccggaatttcaccagttaagtagttcaaagacaaatcaatggtcacgatatctaatactatgggtagtttgtagtaaagtttttggcccttggtgtccacagacatatttgcaatgccaacattgcgaccataacgaccagaaattgagtaacgatcgaagaccattacgatatcacaatgaccacttttcttcatacatattaaattggacaaatgcaaaggtaaaacacccgaaatagaattatttgatagatctagttgaacaagccttgtaaggttggtaatgcttgttggaatatttccagagaaattgttattgcttagtcgtactattgctagattcgacagctctccaatccagatgggcaatcctccatagaagtcatttgatgccaaatccagcatctctagattatgtctactacgcaaaaatggcgggaactttccggacaaaatattgttgctgacaaatagcttactcaaaaacactggctggaaacatcgaggaaattccccctccaaaagattgtccgctaaatctaagtaaacaaggtgatgcaaatcacacatagagtttggaatatggccagtgatacgattggagaagagatgcagataagataagacaaggtcatttccaaagttcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagacatccct

SEQ ID NO: 21620 - DNA, 744 bp, Oryza sativa
  unsure (1)..(744): unsure at all n locations
gccatgggttgaattgctttgtacaacnnnnnnnnnnnnnnnnnnnnnnnnnnnnnnnnnnnnnnnnnatattttgtacaacgtattttgaatttaaatttttcatgaccaactgttcatatcattacagtacacgtctgaaaatggcatgttttgtcgacatttttacttgtttcgaggcaataagaacagatcaaccataatgagtgactaatgaacatgaggtatgtttacgtttttatttttcctgcaggtcaggtccttccgttttaaaatataaaatatattagcttattcaccgtcttcaacattgtacatttaccactatattcttttgtaatacttgaggcatttctttttttttgggtgatttttgacatctgtgacgggtgagaactaaaaccagtcacagctgtttcgtcacctttgacgggttgcaaagagtcacccgtcacaagtgtgagtcacctgtgacgggtatattttttagcccgtcaaaggttttaattaccagtgacgggctttcacccgtcaaaagtgaggtgttggtattagtgaccactagtctctaaccagaccaaaatncgtaaaagtgaggggtaagggcccgtcacaaatggacgggatccggctagtggttattggtctttttgcaaggacaantnttgttcttccattccaattcgggtgaaatttttaaaaaaacccgcgggggggggggagaaacacccccccccccctttt

SEQ ID NO: 21621 - DNA, 1003 bp, Oryza sativa
  unsure (1)..(1003): unsure at all n locations
gcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttaatattttaggacgtcaggagaaaatattgctgaatatttcaatatatatgctattgctctaacatgttaacaaataacaacattcatttcataattaccttctgctcgtctgcaggtcacgtatcagaaaacactcgattgttaattttgttattgacatcaattctttatggggaatcttccaagccgcatcttagaggagttgacatagttaagcaacatgagttggtatggtgtttgaattgtgtttgtgtaatttttatcgcgtggcactaagttattaacttataaatcctgatctgattattgcagtattgcatttaacagcccaaatgaatcggcattgagatataccatgctgctcggcctgctcccgttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21622 - DNA, 1377 bp, Oryza sativa
  unsure (1)..(1377): unsure at all n locations
nctgaataagctccctttagtagatcaatttccttacccaaatatagcaagaatccgaacactgatgacttgacaactctcatcgactaatctcaagacttcgaagttgatactgactctaagccgatgactactctgtgcttaacaaatttcactattaacacatgccccccagatttggagtattaaaattcatgcttcaaaatttcttgtccagataactacaaaaccgatctttctttgcttactgcagtcggctttcatgatccatgacagagcgtggggctcctcaccgggagaccgcgcacacccccctttgccggttccgccggggacgctaagtgaagttataagctctcaatctgtgaaatgttcgcgaaagtggaaacgcgcaagacacgggcgatgtatacaggttcgggccgcttagaagcataataccctactcctgtgttctgatggatctgtgtatgaaggagctacaaagagctggagagcaagagagttcaaactctagagaccctcttcctccttctctcctctaccagctccggttatccccccccacccttaagtgggcaaggtcctccttttatatctcaaggggatcccacatgcaccacttctaccttcttttctatagggtggggacccatcctatctttactaaaacttggctcgccttctcttggaagctaaaacactgcttgtttttgagtgcggccacgcgtcctcattcgtctgacctcggggatcaccctgtcatctctttttaattgggcggagacttgcaatggctgctgtccgagtgatccttctgatgggacggcccatacctacctccactccgccggaagcaggtgcaacgtggggacacggtcgtctgccgacgacataaccagtgtcagaccggtcgcaaaccagtcattcttgtccaccacgcgtcagattagcaatctgcatgttcgcccttcttcatacaatgtcttgcttgtaatggttgcgatgaagcctggcatgtatctagccgggactgacgtgccaacttcgggagttagcacgccggctccggctagtgacgagcgcctggaggctctcatcattccgacgggacggggcaaggcgtgtgacaggccgcctgttaccacctaaccagcaatctgaccgatcggtgaccggtcacacactgctaccggttacggaccggataagcgagcgtgctgcgctgcattaaatgcggcgtggcgcgctcgtccacccggcataaatgcggttaggtgagcgccgctgtgcttaccntacccatatactgggggccaaaaaaccaaggggtgtcgggcccccanccttngnaccaaaaaaggggcgtgccttcct

SEQ ID NO: 21623 - DNA, 1377 bp, Oryza sativa
  unsure (1)..(1377): unsure at all n locations
naaaaaggttttcgctagatcatccgggattagggcttgaatctctgccaatcntgtccggaatgaaccgcagtcaacccaccnagttgtctaatgatgtctctagccgatgaaaaatgtctccaagagttcttttcacatcatcggtcagaggggctaaagcttatggggtgtttcttcctctgcttcttcgtcaaagtatcccttatatcgaaagagacaagatcggctaagacttgcaagagagaaaattgaagacagttaaatatcgaaccaaattatatagccaatctaagatttatgccaatgaaatgcttactggaatgacaggagctgctggttgttcttcttcttcgatgttatggctgcctgcggccgatggagtacaatcacttggtgttggttgcacaggaggtgaaagatgaggaggaggctaaaaaagataagtgttaattaacaccggttacgatcagatttaaaggattttgcagagggaactttaccggtggagctggcttagatggtgtcggtgccgatttcttcttcacgatagttttctttttctgcaaatacaaggctaataagtaatcggctatgcaagttgtttcgagaaatgatcaagatgagttgtttacccttgaaaaatgagctggggcagcaggagttggaggagtctgtttgggcgaagccgatggtgttttttctcctaagtcactaagttcggctgccgcttggtcgtcatcttcctcaatttcctcttcatcgaaggcttgttcgatggatggatctaaggcaggcaagtcgtcggttggcttggatttcttcttttcggccttcttcttcagagccagaaccgatggatcaacagccgatgccttagtcttcctcttcctgccagcatcggctagttctcctatttgcccttggagcagacttgaggtcctgggggcatgatagccgatgactgggggagctagaccacctccgtttggtaaaaggcctggagcatattttatgtctttgcgaggaggagaggattctgttgtctgcaaaatagaagaagagattagtcaagatacaagtcagctaacagttgttttagcagaattgacaaagtaaaatttacctgagggatgacatccaggaatagatctgtcatatacatggaagccgatcgatggaacaagtgtagcttccattcaccccaccacctatcaaaggccctgctcctgaaccttgccagctctatgttctcaatactgcccaagggaggtcttgggatgttgagcagccgatccatcatcaaggtnnnnnnnnnnnnnnnnnnnnnnnnnnnnnnnnnnnnnnnnnngttatntcaatnntcaaaagcacgcg

SEQ ID NO: 21624 - DNA, 791 bp, Oryza sativa
  unsure (1)..(791): unsure at all n locations
cgtggcatganatgcaatgagaatcagcatggnacccancaggccttgtctttataatgtattaatacaaaggcagatcgatgaaagaaatatatgctcaagcacaaataaccacgggcgatcgagttgcataggcagatagcttggatcactgctcgttacccatatcgccactatgcaatacccctcatcagctaccaagtcttcatggctgcttctcgtcgtcataacagcctgcaccggcagcttattcctcgtcgccgatgcactacatgagcatcatcatgggcggccaaatattgccggcgcgacctgcgtgccgcacgagagggacgcgctgctggccttcaaggaaagtgtcgtcggcgaccccgtgggccgcctcgcttcgtggcgtaccggagaagactgcttccgccattggagaggtgtcaggtgcagcaacctcaccggccatgtccttaagctccacctccgcaacacggatggtggagaggcagctatgtccggcaaggttagtagctccttgctctccttgcagcatctgaggcaccatgatcttagcatgaacaacctccaagctctcccgagatttctcaggatagccggagagggtcctatcccagagttcctattagaataattgggctaggcccgatttattctattaaaatctcaaaggcccataataagtgttaaggataataataccaccttaggatttaagcgannnnnnnnnnnnnnnnnnnnnnnnnnnnnnnnnnnnnnnnnatatatcgatntctacgcgt

SEQ ID NO: 21625 - DNA, 1091 bp, Oryza sativa
  unsure (1)..(1091): unsure at all n locations
accacttttaagaagaaaggcaagggaaaggcaaagggcgactgctttgtgtgtggcaagtctgggcattgggccaaggactgtcctgagcgcaaagacaggaagtgtgccaacatggtcattagcgagggcggaggaacatcggggtacggtaaaatattacctatagttctctttgtttttcactcacctgattggtgggtggatactggtgctaatattcatgtgtgtgctgacatttctctgttttcttcttatcaggtcaggagaggttcctccttgttgatgggaaacgggtcgcttacggctgtttatggtgttggtacggtcgatctgaagtttacttcgggaaagaccgtgcagctgaagaacgtgcaacatgtcccttcaataaagaagaatcttgttagcggctctctattgtgtagagaaggttttagacttgtgtttgaatccaataaatgtgtcgtatctaaatatggaacttttgttggaaaaggttatgacagcggatgcttgttccgcttttctttgaatgacatgtgtaataattataatgttgtgaaccatattagcgagaatgatgagtctaatgtatggcattcgcgattgtcatgtgaatttcggttgtatgacgcgcttagctaacatgagtttaattccaaaattcactttggtcaaaggttctaagtgccatacttgtgtttaatcgaaacaacctcgcaagcctcacaaggcatctgaggcgaggaatttggcacctctagaacttgttcattccgatttgtgcgaaataaacggcgtgttgactaaagggggaaagaaatatttcatgacactaatagatgattgcactatattttgttatgtgtatctattgaaaacaaaggacgaagcattgcatttctttaagacctataaagctgaggtagaaaaccaacttgaaaggaaaatcaaacggttgacgtctgatagaggtggggagtatttttctaatgagtttgcatccttttgcgaagagtttggaattggggatcttctagagtcgtcagacgggcacctcgggcagctgtacagatntacatnaacgc

SEQ ID NO: 21626 - DNA, 761 bp, Oryza sativa
  unsure (1)..(761): unsure at all n locations
tgtgcccttgatannnnnnnnnnnnnnnnnnnnnnnnnnnnnnnnnnnnnnnnnnnnnnnnaaactgggagatttttgttatcaagcttctagctagttactctatccagtttcataattccttacgttttagacaatggcatggtctccaaaatatatctttgaccttggtttttttattgtaacatatacaataaataaatgcatgtttacttttattatagtacttcgaaacataaatttatatatgttgntctagttcctttaaacaaaataattttaaagttactgatagtcaaagttacaaaagtttaacctcaacattgtctaaaatgtcaagaattatgaaaccgaagggagtaaacccttatggatttttttgaggtaaacatcaagaagaaggataaggtttctaattattaagaagaaaaaagagttggccttgtttgaggaaaaccaggcctgaaaacaacataatcgcattgtaaattaaaggaaagagtaaagggcacgaacagttcctaaacttgtacggccatgtcatctagatccccaaactatcaaaatatatatttagataccagaactcgacaaaatgtgtcattccgatcccaaactgtcacagcccttccaagatcctatatggcactgatgtgtcatgccacataagcgccaacgtggtatcatcaataactctacatgacaaacgagctttcgcgtctaaaagagaggaacannaaagcaatgaaaaggaaagagag

SEQ ID NO: 21627 - DNA, 840 bp, Oryza sativa
  unsure (1)..(840): unsure at all n locations
naacctttctccatggacctgacttagatgaactttgaatttgtgctccggtctgcaaaatagtaagaaaggtaagtacaggtgtcataacttcagctttctatacagtttaccaaaatagcatactcgtagttttaggtttcactctcaaaagaccagaaataaacatgttaccatggagacgatgtaaaacgtggctaagttgtcatgcatattagaaaatcataatgctaaatgcagcaaggtttaagatcacaacctaataaaacaaggtgaaacgaaatccctcctcaaattatcacatgaatcagaccaatgggaaaacgactgaaatttacctcctcaaatttctcaaaattctgagtatccaactcgctgttaacttctggtatgaaagcagctttcatctgatacaatctttcccatgggagacctctaaaccatggatgtgcctaaagtagagcatatgacgataataattaagcacacagttgagagcaataaagatattgtacatatagaagagagcgcacttttatctcatgggctccttttgttccaagtctctgctcaacattacatagaagtttgctgatgagatccttagcttcaggagaaagctttgcctcttcagggaatttcaagtgacttctccagtttacaatctgcaaatgaagaatagaaaataaaattggatgaaacacatgctcatgaagctacatgagtatttactgtactggagtaaacaagcttagctgaaagcatcggcatatcagncttcactaaattatccactatacggcactttataatgcaaaaccaagtcatgcgtgattttgg

SEQ ID NO: 21628 - DNA, 726 bp, Oryza sativa
gtgtgatttgataactagctcggtaccctacaaactgccagaaacattgaagcagttaaatagctccattttaattagtatcacaatatgagtacattagcttatgcacctcccatagtcccttccccttttatttggcaccttcaccatgataataatatttcattatctgcaccattaagtgccttccatcagatagcatatagctcaagcaagtttccaactaagaatgcctttaaatttattttcttgagtacagctttctaaagcttatataagtagtcctaattctcctcttcctgatctatcacacacaatatgcattctttcattcacttgtccattcttctttgcctcctatccacaaccctcatttcctatgcaaaagatagcaaagcccatagcagtgtggtccttggccttagccatgttaggtctctatctgctccatccatggtgataataaactccacaagatttgacttcttggacatcatagaaccagtaacaacatatacagatggctaccttctttccctaaacctgggcatgcccccacaggtttttcaggtgtacttggacacagggagtgacctcacttgggttccttgtggcaccaactccagctaccagtgtttggagtgtggcaatgagcatagcacctccaagccaattccatccttctccccatctcagtcctcttcaaacatgaaggaactatgcggg

SEQ ID NO: 21629 - DNA, 986 bp, Oryza sativa
aagtacctcattgtgtcactatcttgaggcgtgcctgtattttgtagacggcgtctctctatagcgtgcatgaaatgacagacatcatccacccaaccagacaagtgaagctcagaagatgccgattcagcaagcctgtttttaattaaataataaaacgcacagtaagttcaacaaaaagatgttccaaattcaaaaacaaaaaaaaaggcaaccattacatattcctccaatgaacaatatgtgtgaagattctacaacatacactacaaactgcagtaaacattttttaaatatgtgtgaataattgtagttgtagcatgaaaattgttagtataacttcataaaatttcagacatacaatcagcaagttgtataacatctgaaactgctagagaaaagataaagcagaatggacaatcagtgcttcatggaaatagctacaaataacaaaagcaaaatagttcctgcccattagagacttacatttccttaaacttcccttcttcaagatggtgcttcaaggaagaactgtccttacccgaagataccacatcctttactatgactgcagacatttcatggcatgaaacaggatttttagaatcctccaaactggcaatagatgacttttcagaatattgctcagcacatgtagccttagcatcaatggtctcttgaagatcagaaaagtgaattggatttccatttccattcgtattgggcaacactctctgtgaattaacatccgtcttattgcaagaaacactaccattagcattcattttaccgggttctgcatattttccagagtcacggccattcactgctggcagtgttaaaccctcactaacttctagcttattgcccggaatgatgcttgccttgccatttgaagaaactttccccgttccattattcttcaagtggattggcttgaggtgcatacctggtgcaatcttgccatttttcaggggtgggggtgg

SEQ ID NO: 21630 - DNA, 742 bp, Oryza sativa
  unsure (1)..(742): unsure at all n locations
gacggttgatttgatctatcnnnnnnnnnnnnnnnnnnnnnnnnnnnnnnnnnnnnnnnnncgcctgatggtattggtcctgtcagattattgtaggacaaatctaaaatgcttaaatatgttaaatttgataagctgggaggaatctctcctgaaagattgttgtttgagaggtctattgattccaaagcatgcatactcccaatcttgtgagggatattcccattcaattgattccaagataagttcagatttaccagcccttcaagacttgaaatgtccattgggatctcaccagataaattgttaggtgagaagtcaatggtcgttatatccaaaacactaaaaccttagtatttaagctgtagtctcttggttattacagacagttcaccaagcctaagtcgataaaaacgaattgaggcaggaggatatggatttgctgcactatattcatataccatagcacttagattcgataggcatggaggtatcataccagataaccgatttttcgcaagattcaaatggcgaagatctcttagtccagtgatagagcctggaatatgcccatggaacatgttgttgttcagtcgtagaaaccgcagcgatgtgcaattccctatccacattggcaacgttccagagaattcattccatgctagatccaaaaaggacagaaaaaagcatctttgcaaaaatgatgggaacttgccagagaagctgttgttacttaacataa

SEQ ID NO: 21631 - DNA, 1428 bp, Oryza sativa
  unsure (1)..(1428): unsure at all n locations
tttgccaaaccgcgcacagcggcaaacttttcaataagctaaattaggtaaccgtataaatatacttttctgagtgtaggaccctcaaagttgcacagggtggtcagatttgttgttttcatggtcatttcatttgatgataatactagaacctggagtgaaaccatgtctccgagcacatttggaaataggccatgcaagccaatagcatcaaggttgagtttcttgaggctcgttaggttccaaaatcaacaagactcgattgagtccaagtagttgtaggagaggtcaagctcctcaagattcgtaaggttaaggtgtgggagggattggttggcactagtgagtgagcaaccacctagaccaaggaccctcaaaatggaatcatgttcaccacttgaggccaattgaccactgtactgagatcgatttcccccaggttaaggtgctctagcaaaggtagacgtgtcaaccaagagagatccgtggaatacggtttgattgcatctaagcttaatgaagattcactgaaatgtgacatgccagagatgtcgagataccgtagtttcgaaagattaccaaactgaggaggcaccttgtccgaaaacggtattccagagaggttaaggtatcttaggctcctcacagagcctaggaactattggaaatatggtcatatatcggcatattttaatccaattatttaagacaataatcataatcatggcatgaacaatgtggggtgatctaatgacaacatgtagcataaccagtaacatgcttaaggtatcatgagcatcatgcacatacccataccaaggacgcaattgacttgcgactagcatgactaacagcggtatgaacaaatgaattaacaacaggagaaggacataccccgagaatggccctccgctgaattgtgaggcagaattgcctctgttggtgttgacgttcgcaacggctccggctcctggcgcgccatctccagaggcagcagcggcgccggcggcagctccggctccaggcgcagacatggtggatgaactgagcagtcgtgcgggaagcactccccaaaaacctgatcacccgcctacccggtgcatatctcaggcgaaggtgtggttctagaggcctgctccttccgatctctcgtgcgcgcaagtgatcagaagcgaggaagcgagacagcacaggcgcgcgcggaggaggaagaacaccagggagaaaagcaagcgaatcgttctgatcggactagcggcctccttagatagcaggagagattccgctagttgcaacacacgcgtcgtgggatcgtgggccgttacggaggcagtcgtgggaatgtggttgcaaaagaatnnnnnnnnnnnnnnnnnnnnnnnnnnnnnnnnnnnnnnnnngttntatcaatnngccaatcaatcccat

SEQ ID NO: 21632 - DNA, 2025 bp, Oryza sativa
  unsure (1)..(2025): unsure at all n locations
catggttgattgacgatcnnnnnnnnnnnnnnnnnnnnnnnnnnnnnnnnnnnnnnnnnncactcacccctatgaacacacgcacgcaaaccctacccctataaacatcttcgaagactgagccagcaaatcctggagagattgacgaagtcaccataggcgcctcgctgtcgacggatacgtcgcctaccactgaaagcacaacgccgaaaaatcctggaaaattcgctcccatggggagtcgaacctaggacctcaggtgctactgaggctcttgtatgactgatattttttttctcgtgatataaattgtttcaatttgcaaagtttggaggattataaaaaaatagtaataaactttaaatctactttaacaatatgatatatgcaaaactggttggaaggctaaaacaatctgttatgagtataaacatgatgggactactaacagacaatcttctcttgtttgtaacaatttctcaattgacaatgcctgtagctagctcaaggatcctgtcagggttatggataccacatacctaatagtagttgattaaatctcggcaggacccaccacataccatgtcctatacggaaacaacctacggatataggagaagttccgcataaggaaggataaccagagttctacatggaaacgacaaggactactcggattgtatccatattggtttccctagttctacttggacaaggggacacctatgggtataaatacaaggccccctaggaggagaggggatacggacaatcgacacccaccacaatcaacatagacgccacaaagccaatacaagccaacatacgccaagacaagacgccggatatcgacttcagggataagcacggctagtcccctacggtgtctccggatactgtcaggagagacgaaagcgttatctctgatctcgccgggcatggattcaaggaggaagactaccctgtcgtcgactacgagtcagaccttcagaccgccatgacgacaacagttagataggctaccccaagtattatactggtgtgattatggtgaataagagcaataccggcttcggccaataggatgtagggttattatctgacaattcaggggccctaacctgtataaaaaaccctgtctctgtctcttttaccgcagtctcgcgtataccctagtaccaacgatccccataccatgcaaataccggaatcgcgacatcaaacgtcgatagatccatttgataagctcttggcctgaaggaacataaaatttaatagctcgtcggacaacaaactaagattgaaacctacaaaaattaagaacacattggagcttctcatttcatatgttttttttctactgcacctccagtttactatattgacaacatactccttctgtctctcttgtgtagcaatgtgtctactgggctagactgtaccgagtcaaactggattgctcattccctgccaatggcaatataataaagtttcggttgtcaagaaaaagatgctaaactggaatatgaaaaaaataactactgtatatatatacaacgttacttctttgctggcattatggaacagacagatggattttggctgcagcaacggcattagttggtttgcagaaccaaatggaagttacccattagctaacctgccctaggtatgaacaataaacactacaaaaactctttaggattcttttaatttaacggcagagtgcaggaccccactcagaggccaaccacaaactcttacaaaagtccgaagtaaaggataattaagtctatgaatagtttccaattctctgttcactgtatgctcaatattgtttttattgcctgatcaattcttctgaagcggagttccacaaacattgatatttccgtcaaacatcgatgttttgtgtgcgtttcagttatgctagccttcaatcagtaaaccaaaaaaaaaaaagnnnnnnnnnnnnnnnnnnnnnnnnnnnnnnnnnnnnnnnnngatntatcaatcaaatacccg

SEQ ID NO: 21633 - DNA, 735 bp, Oryza sativa
  unsure (1)..(735): unsure at all n locations
agactggttatataaccttatnnnnnnnnnnnnnnnnnnnnnnnnnnnnnnnnnnnntttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcacgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacttacctaatttgttgcatttgatccttcctttgttaattgttatatcatgtccccttgtaaccatctagttgcgtctcggtattcgtgcaccctgtgcgagtatcgacggacgccttcaaacttaaaatctgaataacaacttaggtaaaacttaggttttacaaaagacttggaaaacccgacacctgggtcggggcttgcgaactaaatgaatttccaaaaccgcggaccggggaacgtacccggtgtacggtttcccgctctcgcacttaaggaccgattccttggaattcatccaacataagtcaan

SEQ ID NO: 21634 - DNA, 1039 bp, Oryza sativa
  unsure (1)..(1039): unsure at all n locations
ccatcagggacacacttttgtagcctctatgaccaanccatcatctgtatgacggcaatgatggtctttgtgggccacctctccaaaaaagttgttataagtatatgcctcaaagcaaggttccagatcagaagcaaacaaggttttcacatagggtcattttccattggagttacagtgggatttatggcaggcctatgggtggttttctatattcttttgttcaagaaatcctggaggattgcttacttttgcttcttggacaatatgtatgatgaggtttatgtgaaggtgattgttgtctgggcaaagttgacaggaagaacagatgaaagattgcgaatgtcgcaggtcgcatggtcatccatcgactctgacgaatactatgaatagacgaagacaaagaagctggagcaggtctacaacactcttagttgggttgtatattttgtcatagatggaacttattagaacaagtatcctaaatgcatatgatgcattgatccacattgatgtatatattattgtatctgtttgtactagaagagttgtgtagtgtctcagaaatgacccttcatactgaactcagtttagctctgttctgaattttgtcaaacagctacagtaacctgacgagggatgaaaacaaaataggtatattcatcagcttttctgcgctaaagctacaggttttgcggtgcaaacttcatcagcttttttgggcttatattctcccttaattaatgtgcaaaataagcaaactaagtacatgcaagaagtaactagtatgttggtttatcgcaacttcgtcaggcctatgagttttagcaactaagtacatgcgaacatgctactaaatcggagcgaaataaatttagtacatacaagatcaccaccccagttgtcatagtgcagccgttcactttccccagtagtactgacaaactttgacctcaataagaacaatagaatacctacattnnnnnnnnnnnnnnnnnnnnnnnnnnnnnnnnnnnaatgaagttgatcacaacacggc

SEQ ID NO: 21635 - DNA, 953 bp, Oryza sativa
  unsure (1)..(953): unsure at all n locations
cgtggtgannatcttatgccgtgatacaacnnnnnnnnnnnnnnnnnnnnnnnnnnnnnnnnnnnnnnnnnatcggctgcttctcgttttagggattctgccagtatcggctaaatcgcgttgctagattagatttgcttagacatctaccaccctaaaaactcagtcaacggcttgattgtctagatattatatttcttttcatacttagtgctgcatccattgagtttgatctactaagtcgtgcttagaaccataatctctagcctgcttcttgattgccaataagggtttcatcggggtttcaaccggtgagttatctggacgttgcatcggctcataaggattgcatatacatataagttggatttagccgatggcaacaaaggtttcactatttaatttaatcttgtggatttcatgatatcggacctccagccaatgtgtgctttaaccttcggattaatgcttgtttatcatatcattatttgctgattggtttatactggattatattgttatgtcgttacatcatcttcagccgattgcctttatatcattatttacattggacatatagccgatagctctaaaccctatcgctatcggctggcatcggctattggctggtatcagcatcggctggaatctctacattggattatgagccgatcggctattttatctcctatttacataacttgtcagttgcaggatcaaacttactggcacgcctgcatctcatcaagatttggacctgcacaggagctaagcagatctcccacgccggtgtgttcgattttttcgtcaacacaaattggcacgcccggtgggaccatgaattttatatccacatgtctgaagaagaagccaatgccaagatcatggtnnnnnnnnnnnnnnnnnnnnnnnnnnnnnnnnngagaatgaggatntgcaattcaacacagtct

SEQ ID NO: 21636 - DNA, 747 bp, Oryza sativa
  unsure (1)..(747): unsure at all n locations
cgtggcttgtagtagcncatccttgatanaacnnnnnnnnnnnnnnnnnnnnnnnnnnnnnnnnnnnnnnnnnaacgaagcacaaacaatcacaaagcaaccattgagagtaatgaataaaatatttgttgttcataggaacaccacaaataaagtatcttaaccaatgtttttttcacttaaaaatagagacgccaaataaatcaagaatatacctctggctggtcagtttcttgcaccagcgcctttagtgcccaattgggctgtctttcaaaaagcttgaatataatattttccagttccctgcgatccctacgtattctttttgcatcagatggtttggttggtgtttgcttcttcttctcctgaagagcacaaaattaaatgtgttatgagaaactttaactgatgatgagtagttcaagatgaagaggccgaccacatgattggcatttggcaacatggtaaagataaaaaaaaaagtagaggaaatcaagtactgaactcattttataagccataatcagagagaaatcagaaaacatgtatgcagatccttactacctagatagcactctattaacttgaaataacatcctccacagaaattaaacacctagagttattaagaatgtgtgatctatatcattaatgataccagaagaccaaaagggaatctcaatcttcatttccggaaatgaaagcaccttagacccaaaaggtatgagnaccaccatgccaagcaac

SEQ ID NO: 21637 - DNA, 789 bp, Oryza sativa
  unsure (1)..(789): unsure at all n locations
tcaaccctttccctatctttgaaaactttagcaagagctcgcaatcttgattgaacaaaatcttccttttcgtcggccatgagattataatattcatcggctgtcaattcattatgtaaatttgtcctcctggagccgattctaacttcccatggtaaaactacttcctgcccataaacaagcttataaggaggaacttgaatcgatccatgacaagccatccgataagaccacaatgcttcggctaacctagtatgccattgccgaggataatcagaaatctttctcttaaccaacttgatcaaattcttgttagatgcctcggcttatccgttggcttgtacatagtatggggaagaatttaataacttgatgcccatgctatcggcaaactgaacaaactcatcggacacaaagatcgagccttgatcggttgtaatggtctggagaataccaaagcggtagataatatgctcctgaacaaattgtatagcatctcctgaatcaaccttcttcaaaggaatagcttctacccacttggtgaaataatcagtcgcaaccaatatgaatttatgcctcttgctggaagatggattaatttggccgatcatatccatgccccatcctctaaatggccatggcttgataataggattcatagccgatgctggtgctctctgaattgctccgaacttctgacaatcttgacatcccttgtagtatctggggtaccgagctcgaattcgccctatagtaatcggaaacagcacntcaaannnngatccatca

SEQ ID NO: 21638 - DNA, 831 bp, Oryza sativa
  unsure (1)..(831): unsure at all n locations
cagtgattgaattgatcnaaccttatnnnnnnnnnnnnnnnnnnnnnnnnnnnnnnnnnnnncatcaccacccactcaaaccccatcgccatcgccagccgccaaccccgctagatccagccaaagcggcagcccgatctgggtgtgtgctccgccgccaccaacgggcgccgtcgccaccgcaaccgaccgccagttgccacctccatcactcagccccgccgccagccgccaccccgtcagatccggccggaacgacgcagatctagatggttgccaccgccgctgcccaggcagctcccccggccgtccgggtgcatgctgggcaaagccccgccaccgccgtccttgcggccgcgcggctttgccggcgcctgctcaggcggcggcgagccagggaaaggagggggaggagggagtcggcagcggtgttgcctctcgtgttcgtgttgtgaatccagaatattgaatgcttctccaaacatgcatgtttgcgcttgaaatataatgtaaagtgacatagtataagatatgaacaggaccaatccatgacagtttgaatcgaagaaacgtgcagacttttaattttgtccaataacagggcaggctctcgaaaagcttgtaaattctgatattgttgatcaagataattttgttttcgaagaaccttcgcaaaggacatggagttcatgccaatttataagataaacaataataagatgtagtgttaaagtcatattttacaagttactagaaaaaatgnnnnnnnnnnnnnnnnnnnnnnnnnnnnnnnnnnnnnnnnnnnngtatatcaatngatcacaacacatg

SEQ ID NO: 21639 - DNA, 4684 bp, Oryza sativa
  unsure (1)..(4684): unsure at all n locations
ngaatgattgatagttaatgatacatcgttcatcgttataggttgatagaggattggtgattgatcgtatatatagatactcattagattgagtatggttctcttcgtcatactctctctaacattatgaatcgatgttggtcaatgacgaatagtatgattgatatacgtcattatctaggcggtatttgtataatgacatgtgcgtcgatcgtcatcatcgtcgatgtgatgttgtaatagtagttatgatatcgagctcgtagtatgtattcgtgagcgtgttttatgataatgtattatttatatgtggtagtattatattattttgacacgtgttttctcgttttttattttcaagcattccaatacgacgtaagtgatgttgcccggttccaactgccaggtcagcgaaacccgctcgcaaanctgccatgggagtcgggttgcccaggatttcaaagtttaggggtcaagatatctggttttgcggtttagggtcatgaattagattccgatcacttttgagggtcatgaagtgaacttattcaaactggtcatcccccgcccaggcaggccgcgtccgtgacgtaccactcttggcgcctgcgctcacgcaggccgacgcggcagtcgttctccatgtatggagtacgggaccctcatcccgctaggccggcggatgcggccgcctcctcgtcacccgcgcggccgtgctcggcgcaacgtacgcgcacacgcagtggccactgctcggccaatgcccaggcccaagtgctcaactcctgccgcttcacacgccgacgatggcgacgagccgacgacgaggatgatcgaagagcaagggcgccaccgcgccagcgacagtggtagtatcaacatgtgctatgacggtgagtgaagccagatccattgccattccagatgacaaacaagttagaagtcggccctcgaaatcccgacgcgtactgtgcatatgatctagccgcgctggacggcaggggtggctccagcagaattttggcccaggagcgccccccccccccccgacggcccacacaaaaaaaagagcccaccaaatgtgttagggttagctcagctggcagaggagaggcgcacgtaggcggcagacgctcggctctccaatcctccccaaatcgtgccgcctctcggtctcccgtcgccgtctcccgctcctctcgctctcccgtcagtcggccagcgctgctgcgccggaggccatcgcctggccacctgctgcccctcccaccctcgcctgacgcctgcagccgccgcccgtcgaccgccacagcccgggcctggcgcagcactcggcagcactccggccggcggcggccagctgatgaccccgccacaccgcacggcggcggcgggtttgcggcgcgacggctgatccctcctgctggccgagactgacgagccggcgagccgccctgcccccggccggccggcccctgcctgccgactgcctactgcctgtctgcctagtgcattggcaatttggcatatgtgagtcactcatttagtcattcgtagtcttttgtatttcttttgaatagaccggtcattgtgatggtgaatgaaaaatatgaatgaaaaaatgtgaataaaaactgaactttagattttttttaagcaacaacttagttagtagtcaatacgacttagtttctcattaatttgtggtgtaaattgcagtggcacgtgaaaaggaatagagacattgtaagatatttgaattatttatgttgtaataacttccgtaacttcgaacttaaatgttggttttaattaatttgtaatgttctgagctatattgcaatatttgaattatattaccactgtatttgataattttgacttgattttataacattatgacaatttggcacgccaagtaggaccacccaacgaattgatcctggagccgccgctgctgacgcggtaccgtacgccgccggccgcgtacgttgcacccgtaacacgtcaagacaagcagacagcggcggcgtccgaccgacggcatattaccgggccccccttgcagacgacggatggagagatcgttcacgtggcgcacgcgagcagtgcctcctcccacgggcggctgtgctgtcgatcgagcgggctgggcaggggcaaccctgtggtgtccgactgtccgagccacgtgcaacggcgccctccgcccccgtcgtccccgtgaccctccggccgggcacccagcgcgccacgcatggacatgccgatgcgtccatggccgcctcctctcctcgccacgcgtggccagagcggcacggcggcgggtgggcgggcgggggaagttcgctgtctcaggtgccgaggagacaacgaggcgacaacgtgcatgacgtacgcgttcctctctctgcacagaaggcactactgttccaccctacggccggaggacaataatgttgagagtggattttaaactataggtcattccttcgttatttgtatatttgagttatgagaaaatttaaaatatgtattaatatatgatatatcactccacaaatatgaaagttaaaattcaatttccacaattcacaacgaaaaaaacaaattagactacaactatttaatgtgtattcaaaaataaatttcttttttcgttgcaatacttaaaagttaagtttaattttgcatgcttgcggagtgatttattacatgttaatatattttttagaattttttacataacaatttaagtaacacgtaaacaacgagtgacacgttcactcgagagttaatagtttcccaataatgtccttccgcgctagcatcatatggaaacaagcgcagagctgtttgtccgtctacgctgctgatctactccaaagatcatcttttctaccggtgttcttgcacctattgaatgcagtttcagacgctgggaagaaatgatatgtttcaccagcaattctgcagaattcctgtagcttccatgttctcaacagagcctagctaagcacctaatcattttttttaagatcaacggatctgaaagacttattataacacgtggaggattcactctgacaactcgacagaaaaagacgctgcatttgcgagttgcgacacgagcagttaggctgagcgcatctaccccgtgtaccaaaacaacgagaattcatcgttacatcgtcgtgttgtcgtgacaagacgtatagccaccaaagcaatacgttcccaacacatacacaccatgacactactgtaaatttgactgctaagatgttaatcaagagtacattaaaggatgttgataatgaaaatacgactggaagggcggccaggacaaggttcacatgcctgctacaacaaatttcgcttcggtgaagcagcatcgtcgtttttcttttctttgagaggccagcatcatcgttgagcctgcacgtatccactttatcttttgaacctaataatgcacagataaacaggttacgacctgcccagaaaagtatatacgtacaaacgaaggcgatgcgactaatattaggagtgcgacatttcagtaatcaacctaaacaaggttgttgcgttagaaaccaggtgtctgacatttctagtatatatcacacatattaggcatgtaccaacctttaaagacatcatcatgtaaagacttatataaaacaaaatcattgaaatttatactgtcgtaaaaggataagctaatgtgatggtgatatgcccccactccttcactaaaggtagataagcttgtgttgtgttctttgtaatgtgcatatgtagatggctaattgaccgcatgtgatcaagtatacaatttttagatatgggaataacttttcttttgcattttcatttggatcttatagcatgtttatttgtcatccatcgtgcgtcttcacacaggaaaaacaaaactgtactagctaattcaggctatgggaacctgctcctgcctttaccttcaacacagttgcagtcatgtgaactacggtttcctatatttttacctaggaaactggtaggcatcaaaaaaatcatattatctttcttattctttcacgaggtagtacactgttgaagatactatgggtctgggcaaatctcaaaatttcaataacataccaagctaaacaagccaatccaaaaggaaggagaggtctacaaaaattatccacacaagcagcaacctagtcctgaactccatactgtttccttctatttgccttctcccaccttctttctccttctctactcccatgcatctactattgttcttttagtcctctttccatcaggcatcagcattgaagatggacattgaatcagtgaggtgtgcgtgctgtggcctggaagaggattgcacccaggaatacatagagaatgtcaaggcaaacttcggagggaaatggctttgtggcttatgctcagaggcggtaggggatgagctcagtaaagacagaagagaacaggatggcatcgaagatgctatcaaagctcatatggcattctgcaggatggcactatcaagccctgcagtcaaggtggcggatggcatgaaggagatgctcagaaagaggtcaaaggataaggtaaannnnnnnnnnnnnnnnnnnnnnnnnnnnnnnnnnnnnnnnnnnnnnnnnagtntatcaagccctct

SEQ ID NO: 21640 - DNA, 1865 bp, Oryza sativa
  unsure (1)..(1865): unsure at all n locations
ttttttagtctctttccatcaggcatcagcattgaaaatggacattgaatcagttaggtgtgcgtgctgtggcntgnaagaggattgcaccaaggaatacatagagaatgtcaaggcaaacttcgaagggaaatggctttgtggcttatgctcagaggcggtaggggatgagctcagtaaagacagaagagaacaggatggcatcgaagatgctatcaaagctcatatggcattctgcaggatggcactatcaagccctgcagtcaaggtggcggatggcatgaaggagatgctcagaaagaggtcaaaggataaggtaaagcctgaaataccatcaaaagcacacccattcttacttggtgacaattgacaaggttccaaagcgaagaacatcagaattatgcttttagataagggtgtgactgatgtaagatttctctcaacctactcaacagttaatttactagtattaccttttatattccctggcaacatgtcaagtgtaaatacaatttggtcatatgaataagtttcaagatcacaacatttcagcatgaagatctacaaacttcgttgacaagagatactatgcttttgtgtgaacatgcaggttatcctgtgttcttcttcgccactcgagaatatttactcagaggtttgtttctcacctaattgattttgatgatctatgatgaaaattaataatgacaagtgatcacttttattccaccaactagagactagttatggttcagtgtcttacattcttaaaatcattgaacaaattggcctaagattgtcactgtgcaactattcatgtacaaataccccagggagaatctatcagcaacatgtacaaatagagtgaagaaatataaatagaattaggtactctaccattccaggtttgtaatatttgattcgcaagatccgtgaatctatgacatttcttataatttgtaatcacccttatgtaacaagctgaagttgtaacaacatatttcattaagatgaagacgcgatacaagtaaaataccacgctatgagaaacttatgaagaaatgagcctggtaaaggcatcaaaatatcactttctactgaaagatagcacgaggcaccaatcaatgacagataagtattggcagggaaatgcttgattgaaagctgaaggtgttctacagataattcacaatatgcacatttcaagttcaaattaataaaaaacacatgacccacagctaacagggtgcatggacacttcttagaagtcaaaatcctaatactgttaaaacaatcaacaaaagagttgaaacatgcctgtactcctggcctgcttgtgctgagatctttcaaactagaacaatccttctcctgcatacaaaggttgtcatgattaaatggtaaatactaaaatctaaaacactggacatctgcatgcagataattgtggagaccaatcatagttgcataatcacaacaaatacaagtaatgcaagattctcataaatcagaatattaaggttttcagtgaacttacttagctcatctaatgaaatgctagcagcactctcgccagatttaatcagccgaatcttacctgtacatataaatatttttccaaggataagcttttacaacaacaaagacaatcaaaataaataagtacaaaagaatagctatcaacattactcaaatgcagtataattaaacaaagcagcaggcttctgtgtccagtttggtaacagagttatggagttaccccgagaaaattgntcacacttcacacgttatttattcttgctataaaatattactaccacacagtttctagtggaatggcagatcaacataccattngcgtcgaa

SEQ ID NO: 21641 - DNA, 2088 bp, Oryza sativa
  unsure (1)..(2088): unsure at all n locations
ggaatctacacagacaaatatttaatcaaaacttactcagtaaaaactgagtagaaatcttgaaacaaccatgaaaaacaacccaccaattggttttctctgctgttctaagaccctcctcaagcccttcagtaatccattgctgagagaattcatggtaaatctacgcacattgaggaaaaacgttaaataataaaatcataaaaataatcatcagaacatatatttttttcctattcctttaatggatttcaaaacaacataaacatcacagtcgtcaacttcattcaacattttcctggtagcagttctattctcaaaagcatttgttcagtgtgaccttctacaaggaaaaaactacatgaggaaataaggtgcatcagaatggcctatcacgtgggagacacttattctttatgatgaggcatcccaggtttgtctcaacagtgcagaggagttccatgacagttctgcttattctttcctgcacaaaaacaacttatggtcttattcagctacagcagctccattccgttggaacctcagggacgacatccggccaagacaaggaacctgctctacctgcctaagcggctgatccgcctagctaagctgcagcggcattctaggatcgtagtatccaataaccaccctcttcaggaggctgaattaacaccacctaaaatctaaataggcaatcacagaaaaattaacagcctactggactaaactttgcatggataaaatatgcaaacggtccaagatattctaccgagacattttaacaaacaccttgcaagcatcgcacactggtcattcaggggcttcacgcgacgtcgacaacagttgcataccccatagaacagtggcagacccagcccaaaatggaaaactgcagccatggcagagttggaacagtagaacgagctcgggaaaaggacgtaccttcagccccgcgccggaggccttcgcgcgtcgccgagtcgcgggagggataagacggcgggacgacgacgacgggcgcagaccgagcgagcggggaggctatccgtacggatcgagggaanatgggaggaggcggctggcggcgttgggtggtgtccggtggagtcggccgcggcggcgctcgtgcctgggtggagcggaggagcttcgtagcgagatcaaaaggttgagttattgtgaaaactttgggccgggcctggatatttctgcttctcctggcgtaacgggccgaacctgcaccaaagttagtgggttgctgctatccttgagagtcgagacttctgcttctcatcatggttctgggttgaaacttcaaacttgagaaccccctcctcttgtcttgaaataggaaaaaaaatgataaatgcaaaaggtgaattaggtggtgtttgaatcttctgaagatgaagataaagatcgagtgttttacgtaaaacgatgtgataataacgtgtgattaattgaatcttaattattacaaacttgaaaaaatggattaatcttgttgaaagttttcatacaaaatacacagtttaacagttttaaaagattgccacaagtatccaaaatttgatccaactcttgttgagtaacgaaagtaacaaatctgacactgagttagagatggaaaacgttagggtgccaatccaaagagtggtgcattgatcaattcactctagtaaatcaatcttttacggttggtgttaagccaaagcaccatttcattaccaccgggaattagtagtctcatgctcgcgttggcaactcagtaacgaaagcgcatatagcctagtggttacagtgacctaagtagtacccaaaggtcctaagttcaaatctcctatggagcgaattttagattgggttgtttgcggggctaaattccctatctcaatggccgtatatatccggttggatatggaaaccgggtagaaaatacccttctctaaaaaaaaattattcttccctgataagagaggctaacaccttgtcacgcgttggtaacattgcttaattaataaaactnnnnnnnnnnnnnnnnnnnnnnnnnnnnnnnnnnnnnnnnnnttcatcaataaacac

SEQ ID NO: 21642 - DNA, 911 bp, Oryza sativa
  unsure (1)..(911): unsure at all n locations
tggccgacggaaggacgatagatgagaggaacggtcggataactaacgatccgccatgatccgttcatgacctggcaccgatgacgacgacgtacgatcntcaaacnnnnnncnaaggggttgattgatgactancacctcnnaaccnccnnnnnnnnnnanaacccgacgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgactttggattgtgtaaacctttggatagcagtaattttccaaatttgaatgagccagattatacatctacaaagggcaccaagagctgtaccaggtagtaacaaacgacgaaacgtccccacgacagctgtgacgacgaacgacaatatcacactacgacgagaccagacgacgacacgacgacgacgagataccgccgcgatgccacatcatgtcacgctgtcgacgagacgacacgcgaaccagacgagacgctacgacgatgacatcgccgcggcggaggaggcatgacgtcgagacgaagacaagcaagaacgacaacggagatcacaacacccacgccgacgaagacgagaagatgacgaccacgacgacgaggacatcgaggacgacgatgacggcgagcgacgtacgatgctggaacg

SEQ ID NO: 21643 - DNA, 774 bp, Oryza sativa
  unsure (1)..(774): unsure at all n locations
cgcagagttgaattgcagtatcctcatcctcnnnnnnnnnnnnnnnnnnnnnnnnnnnnnnnnntagaacttacagcactagatactgcgacagttgaggccgagtggcttcttgaactcctgatggatttgccggtggttggaaaaccagtgccagctatcctaatgaactgtgacaatcaaacaatgattattaaagtgaacagttcaaaggacaacatgaagtcatctaggcatatcaagagaagactgaaatctgtcagaaagcagaaaaactccggagtgatagcattggactatgtccaaacggctagaaatctggcagatcagtttaccaaggggctaccacgtaatgtgatagacagtgcatcgatggaaatgggcttgatacccacctaaggttgcacaatagtggaaacctgtccattgtgatcggagatcccgtgaatttggatggcgaaacaaactattgtgtgactgagagaagagacccttgaaaaaggctcattttcatgatgtacttctcttcttttctgcatggtaggatggctcaaaccttaatgtgatccgagtggcttttccaagcagagatgttgacctgcagaacatctcagaaggaacacacctatatgagttcgactgctagtcacaatctatgaggtttgggcgatctctagatacttatgaaaggcctggagtttgacttatatgctccaaacagaggggatgcgaacggcagcccaataccagttaagggtttgagtgaaacctgat

SEQ ID NO: 21644 - DNA, 995 bp, Oryza sativa
  unsure (1)..(995): unsure at all n locations
agcgcgttagacacnctgctcncnaccccaaaaggccatgaaagtggtatgatctgcagggcctgggccggctgatggatttgctttgcgtggaattgacacgctctgcatcgccggaccaggtcgaccgcatcattgggagccgtcggccaatagaaaccctggcgaaaggccttgccaaccaaggtgcgcgaggcggagtgggctccgcattcgccttcatggatatcggcgagaagttcgacgccttgttcccgaggaatgcacttcaggaggactccattagccgtgcgccgatagagggtcccttctatcagcacgtagcgtttggagatgcgctagacgcgttcactcccttcgcggtcctcgggtagagtcttatctgtgaggtatgcttggatctcagcgatccaagcaatcaatctaagggagctgggagcgctcccctcgggtcccgaggcctggactccgatgggcctcgggggccggtcaggcgcgtccgtcttccctaaagggtcgggtcgcgccgacggctgggtaagcctttcttcaaaggcgcccggtggggtctgggctcgcgaagaagcgagccgtgagagttcgtcggcaatcgtgttatcccgtctgggcacgtgccgaagctctatcccgtcaaaatggcgcttcatacgccgtaccttgcgcacgtaagtgtccatctgggggtcagagcaccggtactccttacagacctggttaacgaccagctgtgagtcgcctaataccaggaggcggcggatccccaatccagctgccaccctgagtcccgccaggagtccctcgtactctgccatattattggtcgcccgaaagtcaaggcgaaccaggtatctgaggacgtctccgcttcgcgaggtcaacgtgaccccagcaccggcgccctgaagaacagggagccgtcaaactgcatcacccantangcggtgtgaagcattttcgaggggtcgagcttcccc

SEQ ID NO: 21645 - DNA, 914 bp, Oryza sativa
  unsure (1)..(914): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctctttcgggatcatgacaaatcacatatatcacataactatctcgatgtccccggtcccggatcggtatagtgactgtaagttaattaagagctactcaccgtttgatctaatttagacaggacagatcacacacaaaaccactgtttatggtcctatattgcaagagtgcgtaccaccgtttgatgtatagcaagctgtagcatgacacgaaacgttgtttacgttaccgttactgtatctaatttaaacggatcaacggttggtatggccgtttatacgtataccatgagcgatccgtcacgtttagacaatgcatgctctatcactcgcttgcgaatacataattccgtcattagcgattaatcagccattttctatttgtcggtcgtataatagacgtgtacgcttgaagctcttatatgaagagcggacgggaatcacaaacatcagatttcgattaataatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21646 - DNA, 2810 bp, Oryza sativa
  unsure (1)..(2810): unsure at all n locations
cggtgatgataaactgatacatcnnnnnnnnnnnnnnnnnnnnnnnnnnnnnnnnnnnnnnnnnttttctgataacggctaaccttgacctttttcttcaggcgtgttaccttttgtagttttatatggggaacttctcttttcccattcctccttatgctaactggtgtacttgacaggcatttcgcaggctgtagaaggtgacttagtttatagcaaagagccccctcctggagaagcaacttcagttgatacttcagaaccttgcgatgaccaaataaattcatctgatattgatctatgttctgagacacttccagaagaaacaatccagtctgtgaaggtctgtaatttgcagcaaacaatgcggtgtacatgctcatgcacaaaaagttcctaatcatgcactgtcatttctcgtgtagatagttgattctgaagatttattgaagggtgtctacacatttgaagatgttgtccttcctttgcctgggtatttaccattccacatccataacttcaattttcatattgaatcacattgagaaatatatatggtgtgcttatttctgtaaacatgcagttcgcaagcattatttcctggaaacggaattgctgacatttatcatgaattggctaaaaaggtgctactatcctacaaaatttattttatagtttattcagaagtacttcctttgctttgccaggaacttgtgcattcttgaatttcctctataacccttctgttgctaaacgcaaaaaagaaaaacacatattgtaggttattggttgctagatatgtttactgtgaaatgtgtttagtttcccttttctttttgtggataaacgatacttctgtaatgtcacaggtttaattggctaatatattatgaatgaattacacaatattttttaaagtgaaagattaaatccaagaaataggaatcatattgttgatttgctttcatgtctcaggatggcattagcttgacagagaatgcacatggtgtcaagtaagtttctttattttactgtaaagatcaaaggcacctctaaaagtcaatacttagtatatgtgctatgacaagctttatatctttttgttctgatatcctactatattctcattctgttgtatatattaccttggcttgcatatttcaatttgctactttataccctaacttctatgctatatgatacaaactccatttttaagggagttttcaattacaagcatgaaaggaggttatcggcgggtgttccagcggcctattgattttgagtggtatgccttatcccattgacttttcacttcattagatgaccaaaatcatccccttttctttcgtataaattctagccctgttccactaaaaaatgctttggtgtgcctgtagggaactcatgacttacacagatgacacagcatctttagcagaaactgatttgattggctggaggtccgatatcatgaaatccacaagattaaattaaatagtgaaacctttgttgccatcggctaaatccaacttatatgtatatgcaatccttatgagccgatgcaacgtccagataactcaccggttgaaaccccgatgaaacccttattggcaatcaagaagcaggctagagattatggttctaagcacgacttagtagatcaaactcaatggatgcagcactaagtatgaaaagaaatataatatctagacaatcaagccgttgactgagtttttagggtggtagatgtctaagcaaatctaatctagcaacgcgatttagccgatactggcagaatccctaaaacgagaagcagccgatagagctaaattgatatgctaagacgatattaacagagacatatgataaataggtaggcaaatatatcatccaaaccagagcaatccaagagatcgaatgtactgatgcagacttgaacgacgccgacgtaaacgatactattgcctaggccgacggaacattggacttaccccttagccggagatcaaacatagccccacgtcaggtgccaagtcccgtcggacgataaaataaagtagaaaaggtaaaaggtggcgatgcgccgaattgtattaataccctgggtgtacatatttatacccatgggttgatacaagttcttgccggacaagaaagaaacttttctaaagataaaaggaaaagataaagtccttataggacactaaacacactttcctaaacataaaaggaacctaataaactattcttaattaatagataccttgccatgcggcattctctttaaactcggtctcttctggataagcttcctttagtagatcaatttccttaaccgaatatagcaagaatccgacaactgacgacttggcaactctcatcggctaatctcaagacttcgaagccaatgctgactctaagccgatgactactctgggcttaccaaatttcactgttaacacaaccccagcatatgtcgcacatatgcaaatggattacatgagaagcaaactcactaagcacatgaaccccaagcttttctatgtacatgaattgaatagaagcaacgaactaagctatatggaagtcttacagatttgtccactaacccattattaacatcttctcttgaataagtgtgtctgagnnnttnnnnnnnnnngnnggttnncagcnggntgtncatcaaaacgcgggggggggggagganggatattgttcataatcatcatgaacangagacgncaatcaatgatcaagcgatgagtagcnnatgcatcaaaattcaatatccttcatctgttggt

SEQ ID NO: 21647 - DNA, 4222 bp, Oryza sativa
  unsure (1)..(4222): unsure at all n locations
aaggattgaataccttgactacctgcttgcacgtcgactctagaggatccccaagtgagtgtctttattttactgtgaagatcaaaggcacctctaaaagtcaatacttagtatatgtgctatgacaagctntatatggtggtgttctgatatcctactatatgctcattctgttgtatatattaccttggcttgcatatttcaatttgctactttataccctaacttctatgctatatgatacaaactccattttaagggagttttcaattacaagcatgaaaggaggttatcggcgggtgttccagcggcctattgattttgagtggtatgccttatcccattgacttttcacttcattagatgaccaaaatcatcaccttttctttcgtataaattctagccctgttccactaaaaaatgctttggtgtgactgtagggaactcatgacttatacagatgacacagcatctttagcagaaactgatttggatgttctgtccagaaacaaacctacaaaagccaaggaagtaaatgagactatatctagcgcgatttcaaatgctcaatcacatgattccaaggtggcaggaccattggatagctctatgccaggtagtgaaactggcttagtagaggaaaagtctgtcggtagctcagatatgttagcaaggaaattggccataaaattagcatttactctaccagcatcctcctatgctacaatggctattagggagttgctgaagacttcaacctcggtatgtttctcaactaatattatattactattcttttactagaatttaaatgatgttaaatggactctgtttatggtgttatgcatagttaagaatgcatgcctacttgagaattcaaatacatttaattatggcagttgcccaacagtattgttaatattttaggacgtcaggagaaaatattgctgaatatttcaatatatatgctattgctctaacatgttaacaaataacaacattcatttcataattaccttctgctcgtctgcaggtcacgtatcagaaaacactcgattgttaattttgttattgacatcaattctttatggggaatcttccaagccgcatcttagaggagttgacatagttaagcaacatgagttggtatggtgtttgaattgtgtttgtgtaatttttatcgcgtggcactaagttattaacttataaatcctgatctgattattgcagtattgcatttaacagcccaaatgaatcggcattgagatataccatgctgctcggcctgctcccgttcggtgcatactgaattgctgatgcacgtttgtgctattgtgggggttaaaaacttgttttgccactagaatatgtggcatgccataatattgtatgaacttttgtaaccaaacagggatattaaagttgagaacccttgcgaggtttccttcttgtctgggttttgaatttttatatgctgtgtttgttgatcggagctcaattatcgtaatatcgggcaacaaaatcagtttgaatttgtgtcttgcacatgcggccggctggcaactggacggcagctgggctgcacatttgacgcagcctgacggtgatgagcagctgggcggctgacttgaggctgcaacacgacacgacgcctggtccagtgtggtaccccaattccactagccctatctggaatacgaaaacggcagcacctcctcgaacataagggttggtagaataagcctacaacaactggtgctcacagtgagccccagaggggtttataccttggaagtacaagaaaataattgatgtatggcaaccaaatacaaccacaacacacagatgtacaccctgtaggtgcataactcatttattattataaccggttaccaaagttcgcatctgctgctagctctctacaaagaaaagatgacggaaatttgggatacaactcagtatacaagaagagcctaagatcctgcacattttcaaccgaccagcaggacatgcatagcctaaatggattgatgatccaatggtgtctccaatctcagcctccaaaacaacactaaggtgacaaatggcatgccctaagtcaggttctggatcttgcgtttcagccacagggcccggacgtcaccgttaagcgagatgaatatttcccggttccccgcctggaggaacacatcgggggcaaccgatttctccacctgagatagctcggccatgccgttgaggatctggacgcatctcgatatgctgtagctgtcctctggcttggccaactgccagtcgtgattcgagttcttgtactcccctgagtcgtcgatcacccggtcgttgctctgcctcttggagcaatgccatgagcggggctgccactgcgatatcgcctgcgggaacatgtgtgtatctctgttcgtggctctgatatgcgggggagtttgctggaaggaggactcttttgagattggtgactgcaggcgaggtgaacgttccacgataaagtcttgttcatcctcactgtggtccaggtctgcgccagtgtataaaaagcgcttactttcttctgccattatgccttctgcgcaagggaaggggtattaatcagtatacaggtccagacattccgatccattaagataagggatgattagaaactcaagaattgtttgcaaaaatatatatgagaaatcagaagcatatctttagtaccatttttcccgaaaggattcctgcagtcctcacatcggcaaaacaaagagcaaccagtcccatcctgtacataagaatttagttgagaatatttttcaccaaatgtttagcagagagcttgaattaagaccaaacctggtagcaatcacagtatttctttaggcaacttgatttcttgcaattgcaacctcgcctaggcggagttgaagaagaagaatgatgagcatcttcctgtaaatgagaacacattgaaattactactacaaaccaaaggaaagatcaaatactgtagcaccagctttttcagttaagaaaacaaccacagcttccgcatttgcctcagatcttcgattaattttcagtgacatccgtttctgccgtgaaagaagcaccttgcgagtggtctgaactgtttctgcatataaggccttgttgaagcatggttggcatccacacttttcagaacaataacctccaccagcaaagcatgggcaatagctgcataagcaaacgcttcaatatcagtcttagttcatgaaagcacaagcaaccaaacagacatagagatccaaatcaatttaaacttatcatatattcgtactgatggcgttttgctatccataatatttgcagtaggaagaaaaacagcttcttgataacatagaagaactatggcttccatagtagcttttgtaggctgatcgcaaagttgtaagctttccgccattagttgcacatatcaaaggagtactagaggtaacatacaatgggaaatcatactaataatcaaaaggtataaacatataatattataacagagcatgggattccaattatttattcaatttaaacacattacacaccacatggagcactcaaattacacatactaagagaatagaaccgcaatccattcaaatagctgtactatagaacccaacaacaaaggggtttttgaactacgagcaatatatctagtcagaggggatcatacccgtaaaacgtcgcgcaaatccctatctctattatccactaaccaaaatggatgcacatagctgcgaaaatcgcatggtaccaaacatttccatttcctctcccctttttttcactaaaatgtctaaaccttcccagaatcgtatgaaacagagaactacaaaaatcaaaaaggatcagaggtttcttacagcttcaagcatctcgacttcttgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21648 - DNA, 4102 bp, Oryza sativa
  unsure (1)..(4102): unsure at all n locations
cgggcattgattgaanatcctcatnnnnnnnnnnnnnnnnnnnnnnnnnnnnnnnnnnnnnctgtccttgtggggtttgtttcttggtttttggtgttttcttggaaaaagctccttggtttcagtttgcttttttaaaaaaaataagctttggatttcagtgtgcctctttttttttaatctttggatgtgccatgtgtcatggtaggggtttgatttgggaggttttgaaatttttgtggatttgtgatgttttggtgggggtacgttttgatatttttgaaggggttttaaggatgtgttttgttgtgagaataagtaggatatacgattttagggtgataaacaatagagcgggtgcgaagaatagaaaatagaatttttccttgttttgagaattgtctttagaataaaatattttaattatattgctaaaaaggggaggctattcccctttccaggttagttgagatatattttaaggttttttgcatttttaggtggtgttttttttatatatatatatatatatatatatatatatatatatatatatatatatatatatatatatatatatatatatatatatatatataatttgtttctaaagagaggctattcaactattgctaggatatgtatagtctccctttataatattgttccatttgactaaagacgttcttatcccatatctcacccttttggcttgaggacatttcatatactactaattagcgtgttgaactttgtaccgtcaatttgcctttaatacatggcaggactaccaattcaaattggcacaatttgctacatcggtagtacttactgtgcgagatattttttgatgtatgacttgtcttcctttaccgtttataacatacaactttcctcaagttttatagtattttaaaattataaaacaagtctcacaactaaaaagaagaaactagctgaaaagtgcttgctcatcggacaagtgtttcttgtactgcagtaagaagaaagtagcgtgtgtgtcatcacgttacttcgtttttttagaagaaaaagggtatcataaagtatggcgcgttactccttttctttaaaagctttttaaccgagcatgaaacgtagcttataatgcacggcaatctcaaattcgccacctcataaaactctttgttttgatatctaaacgaagaaaaccgcactagttgaaagcttttttgcacttaacgcatagcccatcagagaagcgtttcaaaagaaaaaagatacggcaacaactcaactaaacagtggtgaacaccaccactaacgtctctacctacaattgagctataaaaaattacagtttgaactaaggatcccttaatttgtatggaaaacacagaaaatttagaagattacaaccttacaaagaaagatttctagaagggcctttttttagaattgaatcatttcctttcctataaaaatcttattaaaaatacatggtggtgtttgaatctcctaaagatgaagatgaagatgaagataaagattaagtatttcacacaaaacgaggtgataataacgtgtggctaatttggttttaattattacaaacttgaaaaatagattaatatgatattttagaccaacttttatatataaagttttcgcacgagacacaccgtttagcagtttgaaaagcgtgccacgagtatccaaaaattccattgcagtctatcactctcattttactcttagtcctactaagattttaggagaaacgtccaagggtcttccggctagcttcacaaagtagtgggctagacgacctgggttcaaatactcaccccttctaactatttgatattatgtcattccctaatatttgtgtttttttactgagattttagaggaaagttaacaaaagcttcaacctcttgaaaaattccattgcagtctatcactctcattttactcttagatgattgttctactaagattttagataaaagttaacaaaagcttcaacctcttgaaagttacattgcagtctatcactctcattttactcttaaatgattgttctcattttactcttagatgattgttcgtgtatttttcctgtattttacaattctttgttttgaatttgcattctttcctgtattttgcaatatttttgggcttgcattcatgttaaaatcctatatttttttggtatttctttgatttattttaatcattcctgtgaaattgaactctttgacttcagcctcaaatagtctatttcaatacaaatggaggaatccgcatcaatacttatttcgcgaacgcaaatgcgcatcaataccaatcgatgacctttgtcagtttaagagaaacattgtgcccaatacttcctccattcagcatgaaggaaaaaaaatactttaaatgccccttacgagggtacgctaactattgattgactgaattgacataaatttcagcaaaattaatattactacttcctccattcagcatgaagaaaaaaaatactttaaatgccgatatcccactgaaaaccaggccctcaatgttagccgagtgtttgcatcaagcccatcatatatatttgcaaatatcaattaacatcagcacatgctcccaaaacatttcgttcatgtctttaagcccatttgcttcatgacgctctgcaacggattaacaccaccgatctgattcaacaattgcttagggatgagattgttaatggtgttcagcgtgtccttgttgttcataacattcctgtccatattcttgggcaacttcttcttcaacttgctacacaccttggcgattctcttgtactcttccagcatgtcggtcacatctttcatggtcctgccagatcctcgagcgacccgtttaattcgtgattcactcatcagctttgggtttgtgctatcaagctctgaaaattaaggagctaaataagtttcaagaaagcaatctccattcaaagaagaacaaaaatgcctataatagctcacctgcatttgtcatagaatccataatagtcatgtaccgcttaatctttgcttggctttccttgtcatgtccttttggcatcagttcagacctaaatccaggtatcatagataaaacctgcaagaaagaattacacaatgcatgattaaattcgtaaaaaaagatttccttatgttgcattggctttcagtgttgatatctcgatgaaatactccaataaaaacaagattaaatactgaaaataaatctaacctgtccaataggacccatgttaagaagattctggaacagctcgtagaatactctgagagtaaaggttccttctatcagtctctgcataagctcaggttgttgatcagcaggcatagcatctttgatcttgttcactaagccagacaagtctcccattcctgacagttagagaagttatgtaagctcgatagaatagcaaaaggttacagattatacccaatatgtttttactaacctaacagacgactaacaaatggtttcacatcgaaaacctcaaaatcctgcatgtgttctccagttccaataaatacaacagggctctttgtagctgcaaccctggaaaagaaaaaaaaatgtcaaaacaggctccttataaaattttcactgatttactcaaggatatccgcctttttgctataattaagaaatcctaagagtaataatttaataattaataaacataaaatagcaggaggtggtttatgtaggaaatactaacgcgctaagtgcaccgcctcctttggcatgaccatccaatttcgtaacaatcacagcaccaacagaagcactctgtttaaatgcttgcgcctgatcaaacgctgcctgaccaatgctaccatccatcacgaatatcacaaggtcaggtttctgcacacagaaacacaagttaaattctcagtaacaacagtggaatgtgccttgatcaaaagatctttgccaatggttgtgccaatgtaaataccgttgcttctgcaacttgacgcatttcttcgaagagnnnnnnnnnnnnnnnnnnnnnnnnnnnnnnnnnnnnaggacgaaataaaataaaacagcg

SEQ ID NO: 21649 - DNA, 6275 bp, Oryza sativa
  unsure (1)..(6275): unsure at all n locations
cgccattgaatatcctatnnnnnnnnnnnnnnnnnnnnnnnnnnnnnnnnnnnntgacaaacagttttctttaatgtcaattttagcaaagtacttttttatactaatatgtaaaggtgtggatgtagagaaccaaccttccatagtaaggaatcttggcctttgtagcattctgttttaactgatcaaaggcaccagctctgaatgtatcagcacaaaccaatgaaggtttaaagcccttcagctgatgatagtgagcatatttggtacaggtagtggttttcccagaacctacagcaacataacattatgaagtgagcagcgaacattaaatttatattgcaacccaagaaagaggcagacaatagattattctaaggagcaggtgcaatagaaggcaaaacaaaactagcaggaacttaaaggaggaaatggcactaatccttaagacaatgggtctagcatctacaaccagcagggtaccacaaatttccctgagatgtgacctctatctgacaatgtaatactagaatctgaagtttgttgacttcaagaattaattaattcacaagaaggggaaaaaagattgagaatcgtccgttgtcgtctggctatggatacttttccaacatggagaaaagtaatcatcatcagaaagaaaaaataactttacatagttttactcaccaaaggcctaataaattcagcagaattcaattagaggagttacaaacaaacctatcagcagatagctactagtttataacactaaaacctagcaggtgctaggtaaaattaaaacgggaggccctgttctaatcttcaactccaaacaacaaacaactttctcgttttccgttagcatatttcctaaactgctaaatggtgttttttgaaaaaaaaaatatacgtagaagtttctttaaaaataaatcatttttccaagtttagctaatacttaatcaatcatatggtaatgagttttattatttcacgtgcgccgaaaatcccaacagacgaacgggcctaccttgcaagccgacgaacatgaccacactgggcttccccttggtgggggtgaaggacggcttccccggatcaagcatgttgcagagctccgcgaagacggcctacatacaagacgatatatatcagcaaaattcgttcaattgccagctgattttgacgagggagcctagcttatagctagctcatcgatggatcgatggatggatctctgcatatctgactgacctgctgtatgatgcggcgcttgttggtgccggcggggagggcgtcaaggttgacggccctccggatgttggcgcgcatgtcggagaccatcctgatctgcacgtcggactgcaggagcgcgcgcgcgatctcgtggaggcagtcggcgaacgccttgtcgtcgatcaccgtcgcgttgctcatctgcgccagcgcgcgggagatgctcccgcccagctgcgcgagcaccatctccaccgatcgatcggcgctccggcgtgcggcgatcttcggcggcgggatggataacgtgtcgtgtcgtgctcgtgctcgtggcgcggcggctgcccagatttgtggagtgtttatctccgtgatcgttattagtatagcttatatatatatggacagggtttggtgtaaatcggaatccggatatgaatcgaagaggtgttacaaaaactgggctgaaaattgaaacttaggcggaatccatctatcgatctatccgtctgtctctttctgggggcgatttttcgtcttcgtccgacttccgcgctcgcgtagatcgctcacgtttccaagtttccgtcgtggcgtttgtcccgtccggttcgatcctttgccacacgcccacgcacacccacacgtgccaaggcttgacaggtaaggggcccgtgttgatgtcttctgtacacttgtgtgcgtccctcggaccttttggtcctgtttggggagcttgtcccagctgcagctttttctaaaagctgtttctgctagaagctgccccaaacagtccacagcttctgagaatctgtagttacagattctaaaaaaatgaactaagaagccagaagctggagaagctgggtttcagagcttttccagattctcagaagctggttaccaaacagttacttctcagaatctaaagctcccccaactaggccctttgtttggtccttgtccatcctactaaatgggccttcatcgtatatatatggtccaggctagggaaataagtttagtttagttccctcatcttgacaccaagtttaaaattcgtcaccgcatcgcaatatcaggtatagcccgtcttcaaactcataaaaccgtgtcaactttcgtccaactcctaaagcagtatgtctctcggtttcatctaacatagagctttgactcccgtcagctgtgttgagtcggtgtgggacccatgcggaccccacatgttagcaacaactctttcttcatccactctcccctatctcccctctcttctcatcatcagcaggtcaggaggtaggccgcaaacagtgtggatagaggtagcgatcgagaaggtgaagggtggcccgacacgacgagagagctctgtgtgggtctcacctagtcagtgttagccatgagatccaccaacttcgtgtggccaatggggagaggggcaggcgtcggcgagtagaacggcggcctgacacgacaagagagctttgtgtcggcctcgcccaattgacgtcagtcgcaagctcctccaactctgtgcaattaatggggagaagggcagccgctggtgggcctcctcgcctcccaacggcgatagccggccaaccaccaaatctaagcgttaggcggcaacgccaatgtgaagaagtcgaccaaaggtgacccgactgctcgcgaggctatgatggcacgtcgtgaccttcggcggtgacagcctcggcgggatccccatcccccctcctcctcctcctccactgatgctggcgccctccatccgcgcctgcacgatcatcccgttcaactacacctcccacccactctgtctcatccctagccactgagacaaggggcaaagaaagggtaaagagaaagagagagagagagagagagagagaatgagaggatgtgtcactaatatgtgggatccaccaatttttattttatattttgtactgaattgttctgacatatggattctatgcagattaagctgccacgtcagccgaaactgggcactataatgtcctatgatcttaggtacatcgagtttacaagtccggaacatgctatactatgtttttttacgctgatacggagtactttgtaagtttgtattgttgtttagggatgaatttcaatctccgagtcaagatgagagacctaaagcggacttattgcccagcgttgggtgctcatcgagacgcctgtgcaaactggtcaggaataagttcacttcatgaccctcaaaagtgatcggattctaattcatgaccccaaaccgcaaaaccagatatcttgacccctaaactttgaaatcccgggcaacccgactcccatggcagttttgcgagcggttttcactgacgtggcagttggaccctgtcaacatcgctgacgtgtcgtttgaagatgggtcaacaaagtcgagtcaccgtatgcgttacacttccatgtgggcccggttttcgctgagttggatctggtaggtatatccccgcccagtgtaaatcccgggtgtattgacgagcgaaaccctagagcgcgctgtgagtcgtgaggagaaggcgaagaagggcgacgcggggggtggcgcaacggtggagggcgacgcagcgggcagagcggcggtggtggccagctcggtcgtcgtttctggcgggcaaagctggatctgtgctcgagctgaggttagttaatcctcattgaaccgtcgtcttcccgggtggattagggttagttgtgtcgatttgggtgctgatttgaaaatgcggtgcatgtatactattgttgttggatttggaggaggcttagcatattttaataagggaatcagtagatcaggtggatttgggcatactatattgggtggttgctttagatcaggtggatttgggcatattatattgggtggttgctttggatctgcggaatggtgatttgaatagcatggttgacactatttttatgttgcaaattgcatgtagggtttgtgaggagtatttggcatcatggacccattagacactcttccagtgagatttcattacaatggggagtttgttttgcataggagggataagtcctattgcggtggtagtgaagcaatgtcctacttagagagagacaaggtgtcacttccagaaattattgggcatttgcgggatcataccaaggttatggaaaggacaatgctgcattggttgttcccaggcaaagatctcaattctggcttgagagttcttgtggatgacagagtgtgcagctatatgtcagattgcatagttgaaggtggggtggctgaagtgtatgtggtggaaccaattgtagttgatttgtcagaagatgaagaggatagtgactatgaggttgagatggatgagggtgctgaaacagattctgaaggagaggatgatagtggggatgatgttgaagttttcaaggataaatatgtgcaggagcaagctgggaagggcaaaataaaggaagggggtgatgcatcttgttaggacagtgctgggaggtgctgatgcagctgagagggcagtggtggaaggtggtgatgcagctgaaagggtagtggttgaaggtggtgaacaagctgataagagaatggtgttgtacaccagagacacttagccaatttgttatatgcaggaggaggaataccacactgaaactgatagtgactacatgccaggagatgaatcaccatcagatgatgaggaagaggctgcaaacatacataaggagtacaagaaggtgaagaagaagatcaagactggtttcattttagggattgatggtgctggtttagaggggtcacagagcaacccaaatgtacatgctgatcaaggaaaaagtggcaatgaaacaccatatgaagagagtgactcaaaaaggtcaatagatgagcttgaaagtgatggggaggtgactactagaagtagcaagtttccaaggtacaagaagaagcaaggtgtgcctgtgtttgaacttggaatgaaatttagctctaagaagttgttcaggaaggcagtgactgcttatgccctaagtgagaggaaggtaatcaacttcatcaagagtgatcctagaagggttagggctaaatgtgactggccaagctgcccatgggtgtgtcttttgtccaagaccacaaggtctgatagctggtagattgctaccttagacaatttgcatgcatgtccccctagaagagataataagctggtgacctcaagaagaatagctgagaagtatgagaagttcatactgtccaacccttcctggaacttggcccatatgaaagcaacagttcaggaggaaatgtttgctgatgcttcattttccaagttgaagagagccaagaaacttgtgatgctgaaggctatggatgccagaaaagggcaatatcaaaaattgtacaactatcagcaagagttgcttagaagcaatcctgggagtactgttgtgataacaacttggtcctttcaaacactccacagagttttgtgcagagcaaaaaaaaggaagaggttagctggtgctaccactagtgctgtcagcctaacaaacaccacaagtgctactaagcagaaggttagctcattttcattacaacttaatttcatttgcatatccatttcctaacttaagcatttccactttattttgctgtgttgtttcaggggcaacaatccaatattgtcagcatgaatgctaaggcaaagttggcaacacaggcaggtggttcggccacagtcaacctccaagcaattgtgccatactccaagggttctgcatcagcttcaattcaggttacatctgggaaggcttgtgtgtcagtctcagctcaagaaccagcaaagaagacaaaaattggtggtcctcctccacccaagaaggccaagacacctggatctattctcattcaaccaccatgggaatctgacaagctttgaagcaagctttgtgtactgctatgcactgccatgccttggctaattattcagatgtaatgccagactcataggcttactatt

SEQ ID NO: 21650 - DNA, 5139 bp, Oryza sativa
  unsure (1)..(5139): unsure at all n locations
ggggtgttgtagaattcgagctcggtacccttaacccgtccaacaccgtggtgtttgcgacggccaaggcctgcagaaggggctctgcgctcagtggggcaacggaaggcgtggggaagagccgcctcggtgaaaatgccgggcggctcggcccgccgatggacgtgccggactcggggatgtcccccggacctggttggtcctgagcgtcgcctgagggagtgggcccaagcgatgcgcccgcggcctcgtcgcgagctgcctcggaagtcgtcgccgcctcggcctggcggagtctggcctcctcctaagcggcttcttcagcttggtgagctcggacggccgcctgggcagcttcctcggcttcccgaaggcgatccgcggcctcttgccggtcagtttcacgggtcgcctcggaggatgtcgtcgcctcggcctggcggagtccggcctcctcccgagcggcttcctcggcctagcgagcccgggcggcctcccgagcggcctcctcggcttcccgtaggcgatccgcggcttctcgccggtcagaatcccgcctccgagcctctgcggccgccggatcctcggcctcagactggccggacttggaatggcgggagggacgcgacgggatctcgctgaaacagaagaaagaccagaagacgaacaagatgggtgagtgaaaactcgcgttgagagaaggaatacagccacgatgggcgtgggacgaacctgcgagggggtcggttaaacgaccaccttggaggggaaataaggtttccccgggatggttctgtcccccccatcttgcggagccgcttcttctttcgctccccctcgggctgcgacgtcggcgtggccccctccgggcgcctgctgctggcacgcgccgccccgccccctcggggaggagatgggggaggggttcctccctgcttcctcttcccccgggcgtcggcagggcggctgctccccgggcccccgtcgcggggcccaaaagcacgaccccctcccggggtagattgttcccccctgcggctcctgcccgcgccatcgtggcctcgaggagcccgctcctccgacgccccgaccgcctgcatgatggtcaggatggaagcgcggtctggatcgctgcagagggggaggactccttggggaatgagggatgcctccacggagctgagattcagcacccgttggaccactatcttgaagtcctcaggagcccagtcccatctgactccctggtgggtcctcatgtagtcttcggacccggtgtactcccaggcgccccgggcgcgccgctggagcggcgcaatacggcgacgaaggtagtcgccgtacaccatggcccctgtgagcccctgggatcgcaggcccgccaggcggtcaagaacggcatcatagccatctcccagatctaccggcgaccggccagatgaaggcttgcgccgggggatggctaggaagtcgtaggcgcgctttgtcggcgagggaagtgtagaaccagtggcttttccagtcatcccacttcttcgggaggacgcaggggatgtagcggttcagcaccggcccccgcggctggaagtagcagccaccaaccaccgacggcggttacaccgactgtacggtgaagaaccaccggaacagcagaagggatgggcgcactccgatgaacatctcgcacaggtgcgcgaagatggccaatgtcattaccgcgttgggggtgagatgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcaggttccggcatgaagcggcgcggcagcccggcctgcctctcgctcacgatgcgggaaggcggcagcacgctaccatcgagcagagcggagccccgtgccatgacgccggaagaagaaatgtttgagagcgagcgcgtgtggcgaaggtagggcacaggaaagaaggagttagggcgcaagcggcgaagacaaggggaataatggcgaaaggaaggaagcaaatctcttcctcggtatctttatacccttgccaacgctgtgcccggctcctcgcttctcgcgcccactatttcgctccctcgtttctcgcgcccacgcttccactaatcccatacgcccgcttgcggcgcatgaggtggatatgcggctgaggcagtcgagatggaacatatcgtgcgtgcgttaattacgctcgccgaccgaagcgccatcaccatatctccaggcaaaacgaaccggctcatcccgattcatgtgctactcgagtaatgtggcagccttgaagaggccgctcattattgacagtcgagttaccgttgccggagtgcgtgatttgcgaccgttgggtttctgcccaactgtggagaccggtcccacctgtcaccaggctttgggaagtggcgtcacgcccgaccgcttctctcgaggagggcgatcgccctggcataacgccgggggctactgtcggtgacatgggaccgggagtatcatgactaggggcttgggcaggagcaatcacccacgaggcctgaccccctcgggggagtcgggcccgagggtgacgtggccgccccccctcttcgtctccccgaggggtcggaccactcccgcttcggccccgagggctgaggcgccccgaccccttgtgggtttggcgccgcgtgtatgggttgggtgagcacaacggggctcacctaaccgcatttattgcggtttagacgagcgcgtcacgccgcatgtaacgcagtgcagcgcgctcgtttatccggtctgtgaccagtcacagaccgatcggatcgtgggttaggtggcgacaggcggtctaacacacgcctcgccccatcccgtcaggatgagagcctccaagcactcgtccctagccggagccggcgtgttacctcctggagatggcacgttggtcccggtcagatatatgccaggcttcatcctaaccattacaagcaagacattgtatgaagaagggcgaatatgcagattgctaaactgacacgtggtggacaagaatgaccgatttgtgaccggtctgacactggtcatgtcgacggcagacagccatgttcccacgtcgcgcctgcttccggcggaagtggaggtaggtatgggccgtcccatcagaaggtcattcggacggcagccatacaaatctccgtccatttatgaagagaagtcaagccaagtttgggggaagagagaataagtccccacacaaaaaagaagagatggtgcatgtggtatccccttgagatataaaaggaggaccttgcccacttagaaaggggattcggatccagaacgatcaaggctggattgagaaccagaggagagggtttctagagtaaaagctctctgaccctccagctctttgtagtttttcatacacagatccaccagaacacaggagtagggtattacgcttctcagcggcccgaacctgtatacatcgcccgtgtcttgtgtgcttcttccattttcgcgaaccttccacagaccaagagcttagaatctcacccagggtccccggccgaaccggcaaaggggggcctgcgcggtctcccggtgaggagccccacgctccgtcagtaccctattgcataactcatttcctgctaaactgagagtataatgtacactaaaatgccacattttcattgaacccagtacatccatccattcactgcaacttgcccattccaattgaacagaacctactcacttcaactgcaaataaccatccaatattccaaacaaatttccattccagattcgacaacaacaagatgacagcaccacaaatgacaaatgacagcatcaccaatttcaattccaacccgatacagatgacagcatgacaacaacaagataagataacattcatttcctacccatcaacatggtaaaaacaacaacaacaagacctagaactaccaacaacatcacaaatatctctaactccaacctattattcctatccttcatcatccctacaatagcttccttctcaccaacagcattccttgatgtggccaattcctttctagctaaatccagctctgattccacagatcttccttcttgaacagcagccaatagctatgccttctccctcctgagcttccacacttcgtcccacaaatcgtttagcacttctctcaagaagctgctagtcggaccatcaacccaagcaaaaaaatcgcaacctccactctgcaacagtaaataaatgaaaccctagaactcagccaaaaaaattgaaaaccatatcaaaactcacccttgcgtctgcacatttgaagtagcggcggccgggattgtccgggctccacaaaatccacctcgccgccttgctaccgcacctgcatgccaccgccggctgatactccagaggcccaacccgatacgggatgggggatggagatgtgcgcctagaggacgccgacgagccctcactcctcgagcttgccattcgtcgacactcgtcgctgtcgccgcttcgccgccgtaaccctcaccgtcgtatccctctccgccgccgcttgtagtagggatggggaacgagcgagagagtagataggcgagagagcacgcgctatttattcccaactaccaccgacacgtcagcgatgttgaccgggtccaactgccacgtcagcgaaaaccgctcgcaaaactgccatgggagtcgggttgcccaggatttcaaagtttaggggtcaagatatctggttttgcggtttagggtcatgaattagattccgatcacttttgagggtcatgaagtgaacttattcaaactggtcatcccccgcccaggcaggccgcgtccgtgacgtaccactcttggcgcctgcgctcacgcaggccgacgcggcagtcgttctccatgtatggagtacgggaccctcatcccgctaggccggcggatgcggccgcctcctcgtcnnnnnnnnnnnnnnnnnnnnnnnnnnnnnnnnnnnnnnnnaagaggttcttcaacacaaacccac

SEQ ID NO: 21651 - DNA, 10978 bp, Oryza sativa
  unsure (1)..(10978): unsure at all n locations
atttctcaatgtgattcaatatgaaaattgaagtatgnnatgtganatggtaaatacccaggcaaaggaaggacnacatcttcaaatgtgtagacacccttcaataaatcttcagaatcaactatctacacgagaaatgacagtgcatgattaggaactttttgtgcatgagcatgtacaccgcattgtttgctgcaaattacagaccttcacagactggattgtttcttctggaagtgtctcagaacatagatcaatatcagatgaatttatttggtcatcgcaaggttctgaagtatcaactgaagttgcttctccaggagggggctctttgctataaactaagtcaccttctacagcctgcgaaatgcctgtcaagtacaccagttagcataaggaggaatgggaaaagagaagttcaccatataaaactacaaaaggtaacacgcctgaagaaaaaggtcaaggttagccgttatcagaaaattatcaaactgcatcatgattcaactaaaactgagtagctgtagaaggatgaagtgcactgaccatatttttcaactctggcactggcagcatggttccagaggtaactttggtaactatgaacgtaccttcataaaagaggcaacagcaaataagaaagacgcataagcaaaatatgagaattaataaattggtcaacaaaacagaacagagaaaaagggtaacagaaaagcttgaatatatcaaacggtatgtatattgagcagcagagaacaattttaaaaacaggtacatataacagatctactactgttcatgactaatgtctataataattccaatacaattttgtatattataaaatctacttagcttttgaggtaacagaaattgactaacccatcaatgtaaagaaacatgaaaagacgaagaaagttaaacaacatacatcattcgtaatgttcttggtatactctttaatgcttgcagatagttaccagggcatttcttcaaacattgaagctggaaacaatgcatgaaagaatatcagtttaacttccccaaataatgtgatctacattacataacttgaataaaaactaaaaagccaatgttttaaataattccaggttaagtaatgaaggaaaagaactacacttacaatagccttctcggctacaagatgtcgagggaagttccttagtgccatatcaatatcaccatgctccttgtaatgttcacgcatctcccttatgtcatctctctgttcggagtattaagttatgttgaacaaaagttggcacagctatatatccaagtatgcaactgctgattggataaaataaatcaaggatatctcctttcccttggatcaagaatcaaatttacagaacttctccactctcctctaagcaaagcagctccaccaaggtgagtaggtactgaaccacttccaaaacgctaaccaacaaaaaagatgaacttgatgagcttcaaaagtaaacacgtaccagttaggttttgaagcataacgaaaaggttctggcttcatacctgcaacccatagtagttgataaatccattctttcctaagccctccacagaagcctttattatgtcttctgattctgcaacaacacccctgaagaaatgcaggaaaatatcagctctccatttgtttggttttcttgaaccaagaaaagaagaggtttggtgcatgtgaaatatagtactgtttgtagtgaagtaatatgtagctgcaaatcaggccctccatgagctctaagattagtgcaaatcattttttagagcactagagaacatttttagttttttacattaaactaaaaggagaaataaaaaacaagtacctcagagtaattgtaaatcgatttcccattagttgaccaagaacaagtccctccttcacataactagaaaggaatgcaaaaataattagtatttagaataattacattgcaatgatatcaacaaagaggataatgcattttatcacctacctaaagtttccaactttaattccaaatagtcgattattaagtgcagccaatctgttggctgatatcttgaaaacagtcacctaaccaggggaaaacaatcagaaaagtaaccattgcaagaaaacgtaattacatgcagaggatcacaaccatgaaaaaggagtgagataacataaacaaatctgtcaaatagactaaaaatcactatgcaaaatacagcaacaacaccagcctttaatctcaaccaagctgggtaggctagagatgagaacaaagccaagcaatacaaactaaaggtgaaaagactaaaaactatgaacggtactagttaaagaaaaatgatcttgtagtttcatttcacaaaactcctttgccaagacaatactacatgtagtattccaaaccagagcagcttcacttatctcatctggttgtaacatcataataccataaattatgccttaattaaaattataccagtatttcttgcatacttgtatgcgaacttttaaacaaattgtacaaaaacccgatttatgtaaagaaaattgagtgagatggtatgcacatgaggaataagtacctgttgtgttgtaacagcacgtttatcttttgtccctgcaaacccgaatgaacgtgactgcaaattgcaaaaggtatagaaatcaactaggaatgcgaaggaaggtaaaaaagaagaatcaaagcattcagtagaaacaagaacacaatgttatgagttagcaaccgaggtatacctgaagtcctaacattttcccaattactcctaacgcttcttgtgtgtccttgttctctttgcaaaggtgaaacctggtcagcacaccagaatgacaactccggttataacgctaattaacagcaaaattagacgaagcaaaaacataatatttcttatacaaatttatacacatagattagatgttttttattaagtttagccaagtaaaatacacagcaagtcagatgaacacattcgagtacaaaggccagctaaagataccaggccaatagaaactatcaattcaagctgaattccaccaccttaggaacttcccaacatgatttggccagctagttgatcctctgctatcaaatggcctgtcatctctccaatcagaaccacccatgttcttcctcttccttcccctcccaccaccacttctcccaccggcaccccgccctcccctagctcctgatcccagccgcaccctaatgcatctctgaactccatcattgtgttcgaccgtgtcggtgaccaaaaacttgaagctcctcttgaagaaattatgcacctcctacagccaaaaacacgcccaaatcacaccatttccaccaatctcaaccacataaacaaccagaaactggaactgggggatcaaaccaaccgatcgatgagccttatcggcgtccggcgagagaataaccggcgatacatcagcctcagcccccgcggacgccttctcgaggagccccttcaacgcgtcgcaatccgcatcgccacagagcgcacggaacgactcgagggcctgcgagtggtccgcgtcggcggacggcgcccgcttgtccttctcactcacatccacgcactgcgatacacggcggagctgagctagcgcgatgaaaaaaaatcggggatcccgggagggagccgcggaatcggggtcgagagggctaagcttacctcgtcggggagatcaaaggaggtgaggcgggcgacggacccgtcgcgggcgacctcgtggacgatgaagtcggagtagcggtgcttgaggacgccgcggaagcccgggagggaggaggcgaagcaggtgatccccgcctccgcctcggtgagggaggtcgagcgcgccatgggaggtggccgcgcgtgggattagggtttgcgagaagagcagagtgtggaggagacgagggttttgcgagggaatggggagaggtttaggaggggaaagctgatggcggaaagacaaggagatatttgcaggtaggtccaaataataacgcgtaatattcaaaatggtccctgagagaaagcaccgaaattagtttagccgtttagggggtggttttgatacagggtcgtaaattttggcgtgttatatcgggtagtacatagagtgtcgcatggggtgttcgggtattaataaaaaaactaattacagaatctatcaggaaaccgcgagacgaatttattaagcctaattaatccgtcattagcaaatgtttatcgtagcaccacattatctaatcatggagcaattagacttaaaagattcatctcacaaattagtcgcaatctgtgtaattagttattttttagcctatatttaatactttatgcaggtgttcaaacgttcaatgtgacggggtaacaaatttttgggtgggatttaaacatggccttagctgtttaggtcgtattcttttttttgtttacgagtaatggattacgaggagacgcttccaagtttttaaacgctataattttttttaaaaaaatcttcatcaacatatattagaacttcatttttaaaatacaactttcaaccctgtaatatttaattcatcggttcatgttcttgaataattgtcatacacttaatccatcatccgagcagacaaagaacaggccctaaccttttctagagtaacttagttggagaagaatgtaatgttcatgatcaaatcatgaacggctgctaaaagatcaaacagctagattagcaatgtaacacgcgatgatgtcgtgctttaatgggcactcatcactaatcagaagctgaaaaggaatgcccaaaaagagaatgtccaagagttttatctttgccgaaagacgaatacaaatctttttaccactgccgcctcatgtcagctgacaaaataacatatcgtcattatcaatgtaccatttctctgatggtgcaaaaggagagaaaaaagatgcgggcagaggtaaacaaaacaagatcaaaatacaaacaacacatcgccttgctttgttccagtttccacaccatataatcatagtgtggcccaacttatttgtgtgcctgtaattcaaagcaaacctagcaagcatctagatccctgcacggaggaggtttcggctcaccgtgcaaggtggtattccctccagcagggccacagtttttccgctctgggtgttgtgtgccgcgctgcaaaaatcatcacaatcatcaaaatcagttcgcaacctaaaccaatggtggggcttgatatctataacatcaaactgagtaaaacttgtcgctagaaatatcaaaagaattatttcgttcaagagcaaagcttacaggaggggtttctccttttttcagcatctcgacgatctcaacaactcgtttaggagtgaggtcctcctgaaaaggggaaatggaaatgctcagttacagtacacaaataagtcttttcttcctctctcagcaaaaggcaggcaggttttgttaagttttatccactcgtcttttgttactctgttggcattagtgctttcagtgccacagtactgctatagcatggaagtttagcaaaaaaatgtagctatgttagcattatttctccaaagacgcctgctaagaagtatagaaacccaggggcccagcatcctataacatgcaagtttatattcttcagttgacaatgtttcattttgtgcataaacatgaactaacacgagtgggcaccagctgctaattcttactaatgctgtgatgtttctactaaaatttccaccgcgtgtactagcataagtcatcaacaatagataatcggatgcatcaatgtgtatacttacataatagttgtatgtgtaaccctctgaacctttagaataatcggccacagcaatcatgggagcattcacacagcagccctgtgaacatataacagaaagctgaataaaaagttgccttgtacttatgttttttcattagagtactgaatcattcactgacaaaatcctacagaccattcctattggctatagttaaacacttaactcaactagaacacctatttgcaagcatccaaaatgacagaaaattatagatctcgaagttaccatgcactccatttctccaacagaaaataaaccatcactggtcacctctgcaaatgaaagaaaaatgttaatgctatcacagagatagcaagagaaacacatgctcgaagaccgtttgtggtaacaaatcaggaagtgttattcttagttgataggataagttatgtgaataatacaaaccattccgtttaactccaagatgttctaacaaggcttcttcaatttcacgtgaaccacgaatcatgcaaggtgtggttccacacaccaaaaggtgatatttacccacctacatggcaaaatagggtgaaaagatgctagtggagggattaacaagtacaaaatactaagtcatgcaaagataccttagtccggttaaacattgtgtaaaatgtagcaacttcatatactctgattggtgcaacttcaacgatcttagcaatctgaaagtccaagacatgaaaatagtattgtcagaaatgctttttgtgagcacagtggtggtggaatggtggttgggtctatgtacaaaatatctaaaatgtaacataagctataacactcccagtagcaatgttattgtaatagtcctagtcctgaggagattaactcaattgtaattataattatataaatatgtcaactgatatgctgacaagaactttttcttttgtgattgccaacccccattctccaatgcctcttactattaaggctcctaatttcctagtgtcacccatcttcagtaggacgaagaagtgaacagaaacaaggccagtgcaataaggttttgatttatgaatgtctgctaagcaagtccaatataactatagctaacgtgggttgtaacaactaacaaatgttgaggtacatcactttctgaaaattgaagtattgaaaacaggatatagcacattaaaggcggaaaacagttgatcatcgaaagctcataaaaaagggacttacagcattcattgctgcaactggcacccatccaccatgctgctgctgggcaagatcaagcattggaataataccagactgcttgtagttgcttggatagtgagacaatatctcattaacctgaattagttattgaaatagagattttaggccagataaccaaaatagctgatacaattgatataaaccgtattcacaaaacctaaatcccatgtcaaaggaatagaacactataccccacgtctctattacatttggacatttgcagatttgcacatttctaaaggttttacatgacagataacgtttccccttctcaaataaccagcaaccagttccaacgtaagattatattattatctaatagtcctgaataaaatggtaccctaacagccatttctgaacatccgaaaacaaaactgaacaaattctgccacaactactccaaaaccagccactgttccaatccaaaacataaatcacagggaaatgaatgaacgagacgaacaacagcaccttcttcatgttggcctccgtgaactcccacggcatgtcggggttgttttccggcgaatcgaggtgctgcacaacaagcaaacccacaaatccgactcattatcatcctcagacaaaacagacagatcagggaagagggtagggggtggatccgagggaagggggaggcgcctcacgtacgtagttaagcgccgtggagaacagcctggaggagcagcccgcggcggcgtaggagatctgcaacgagacgttgcccccggagggagagatcaggacggcaaagctccgccgacgaacagcgaggagatacagaggcatttggaggagggggaggggggcactgaccggagaacgggacaagcgtcgcgccgcggccgattccgaggcggaggaggtcgcgagccctaagaggcggcgggccgcgaggcgggcggccggcggcagcatggttggcccgcggtgggggaggcgactcgactcaggcgaagaggggggaggggagcgaagttgtggccgctcgcggaggtaagtagctcggcgtgacgtcagcagcaccggcccagtgggctctcatgggcttattgacccaatcggcccaatagtaataattccttcgtgtactggcaattataacgatctttttttttttggttgggcaattataacgatctactgtccggatttcgtaccaataggattctgatatatcatacttcatactggattgtttattttagtacggaggaaatataccggtagatcaccaatcttcaagcaaaatgaatcgtcctatatattataggccgagtttagttccaaactttcaacttttccatcacatcaaaactttcctacacacaaactttcaacttttccgtcacattattccaattttgtggagattatggataccccataccaacacggcatttataatccgactgggtatggggtgccatgtatagatagaatatctttaaagggacttgggttaaattccaaacttgtatgttaaggaaatacccgggatcttagtcggttaagattgaatcttatctgtaactacctattccgttagggatatggactgtattttataatacggaccccttcccctatataaggaggggtccaggtgcctcttagggcacgatctgctcccagatcatacgatcaataatacactcggcaaatcaatccccggacaggagtagggtattacttcttgttaagaaggcctgaaccagtataaaattctttgtttctcaacccatccacttttccagcttgatagccacccccttttagtattgccaaaatcttgtttcgacaattggcgcgccagataggggtagcgtcaagttcttcgccgattagtgcgatgggtttcgtctccggcatcgacgacttcgtcttccctcccgggcaggcgttccggttcggcagcctcaacttcttcaccaacgacttcggcaagatttctcttcttgactcggattcgaaccagtcgggaagagaccaggtttccgccccgttcgtaccccaaacttggccgagatctaccccaagatcatctcaaccgagttggccccaaaccactcggacgagatccaatctactccaacacgacccgatgaagacaatagagcctatccgccaatcctgatgaaactcctcaacgatttggctgtcgttttcaccacaagagcgtcatctccccgtaggtctaggcgggatccgccctggccccgatccagtctagctctagggaagtcggtgtcatactccagcctctcggcacggtttcgacgaaacagttggacggctacctcagctcccccggtgtcgactcacgaccaacggagatcgtagagtacgacgacttcggctaccgctacgactaccgcaacctcgacgacttcgacgaaggctatgaagataactacacgccccctctacttcggcattttcatggccgacaacgagacggaaaaacagcgtcaagcccgagaagaagaagaacaacgcgtgcgacaggaagccaaacgtcgccgactggaggaggagcgccaagcacaagagcgagaacggctgcagcgtgagcaacaggagcgcgagcgagctgcaaaggaggcttggaggccgggcgacgagcacgagaactcatcgggcaacaagatgtcgaggggacggcggtttttcgcaccccccaacagaacgtggttgcagcgatcaccctcctcgacaccctcctcaaggaagacgcactcaatcaggccaatcacgtcgtcaacatcttgaaccagaccaagaccatgatcgcagcttcggtcccggttaactccgcgagtgtccgcacgccaactggcagccgagttccgcctcttcaatctcaagactatcaccaaccgagcctcagcgtcgtcggcgccggaaccagtcgtaggagcagggatcacgacgagcaatccgttcactcgcctcctgaccgacacagggagcgtcgagctgaatgtccccgctccccacatcgcaggcgtcccatcgatcttcgcgaaactatcaatcagcgccgtgcggcaagaggctacatcccccaccattcaccagatcgttacgacgacgacgtggatggagttgctgccttcacaagcgacctgcgtcgagtggattggccagccggcttcaagccgactggaatcgagaagtatgacggcaccactaaccctgagacttggctcaccgtctacagtctcgcaattcgcgcagcaggaggagacatcaaagctatggcaaactatctgcccgtggccctagcggattctgcccggtcctggcttcacgggctaccccgtggcacgatcggatcttgggcggaacttcgcgaccacttcattgccaattttcaaggcacctttgaacgccctggcacccagttcgatctttacaacattgtccagaagtccggagaatcccttcgagattacatccgacgtttttccgagcaacgcaacaagatctccgatatcaccgacgacgtcatcatcgccgccttcaccaagggcattcaccatgatctcttagttggcaagtttggacgcaagcctcccaggacagtcaagcagatgttcgagaaagccaatgagtacgcaaaagccgaagatgccgtcaccgcatctaagcagtcgggcaccacttggaagccgaagaaagatacgccgaccacaggagggagtggaagtaccaatcacaaggatcgcaagcgtaagcccgaggaacttgtggcaaccactacaccatcctcccgacaatgttcgcgcgtcaacactttcgannnnnnnnnnnnnnnnnnnnnnnnnnnnnnnnnnnnnnnnnngtgcttcaccntgacagc

SEQ ID NO: 21652 - DNA, 11899 bp, Oryza sativa
  unsure (1)..(11899): unsure at all n locations
nnnnnnnnnnnnnnnnnnnnnnnnnnnnnnnnnnnnnnnnnnnnnnnnnnnnnnnnnnnnnnnnnnnnnnnnnnaaggcggtaccccctggtactagacccagtggtttgcaacatcaagctccgaagatccctgatcgatggtggcactgcactcaatatccttttcgccaagactctggacgacatgcaaatccctcgcacggaattgaagccaagtaatgcgcccttccacggagtcatccccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaatccgactggctgcgtccactgcaaccgaaggagaagtgtctgcaaccaagatgtcaaaaggcggagaaggcgacgccaagaccgagaagattcctctagatccctctgaccctactaagactgctgtaataggcgctaagttagattataaataggaaagcgtgctcatcacctttcttcaaaataataaagatatctttgcgtggaaaccatctgatatgcctggtattcctagagaggtgattgagcactctttacatgttaaggaagatgctaaacctatcgagcaacgactccgccatttcgcacaggataggaaggatgcgatcaaggaggaattgaccaagctgttagcagcaggcttcatcaaggaagtcctacatcctgactggctggccaatccagtcctggttcggaagaagacggggcaatggcgcatgtgtgttgattacaccgacctcaataaatcttgtcccaaagatccctttgggttacctcgcattgaccaggtagttgattcaacggctggctgcgagttactcagttttttggattgctactcaggatatcatcagatccgactaaaggagtccgactgcttgaagacttcgttcatcacgcccttcggggcctactgctacatcgccatgccttttggattaaagaatgcaggagcaacttatcaacgcatgatacagagatgcttttcaactcagattggtcgcaacgttgaagcttatgttgatgatgtagttgtcaagaccaagcagaaggatgatttgattacggatctagaagagacctttgcgagcatccgcgctttcaggatgaaattaaaccctgaaaagtgcatcttcggagtacagttagggaagctacttggctttatggtgtcccatagaggcatacgagccaacccggagaaaatcaacgccatcatcaacatgaaaccatcgagttcccagaaagatgttcaaacgttaactggatgtatggcggcgttcactcgatttgtctcacgactcggcgagcgggggatgccctttttcaagttgttaaagaaaaccgacaacttccagtggggacctgaagcacaaaaagcctttgaaaacttcaagaaacttctcactactccaccagtcttagcttcaccacatccgcaagagccgttgttgttatacgtgtcggcgacttccaaggttgtgagcacggtcctggttgtcgagtgtgaggaagaaggccatcttcaaaaagtccaacgaccaatctatttcgtcaacgaggttttggccgactccaagacaagatatcctcaggttcaaaagttgttatatggtgttttgattaccgttaggaaattatctcactattttcaagatcactcgttacggtggttacatcgtttccactcggggatatacttcaaaaccacgaagcatatgggcggatcacaaagtgggccttagagttgatgtctttggatctatccttcaagccgtgaacttcgatcaagtcccaagctttagcagacttcgttgccgagtggaccaagtgccaagaagacacgcctgcagagaagatcgagtattggactatgcatttttatgggtcaaagaggctttcaggcaccagagcgggggttgttctaatctccccgactggagagaggttgagctacatattgtggatacatttttctgcgtcccataacgtggcggaatatgaggcgctacttcacggattaaggattgcgatctccttgggaattcggcgtctgatagtttgtggagattctcagttggttgttaatcaagtcatgaaagagtggtcctgccttgatgataatatgaccgcctatcggcaggaggtacgcaagttagaagataaatttgatggccttgagctgacccatgttcttcgacataataatgaggcagccgacagactggctaattttggttcaaaacgagaagcagctccttccgacgtgttgttgaacatttttatgaaccaactgtaccgaggaaagaaatagtcgaggccacggacactcaagaagtaagcatgattgaagccgactggagagagcccctcattaaatttttaaccaagcaagaactccctccagataaaaacgaagccgagcgaatctccaggcgcagcaaactttatggcatacacaaggccgaattgtacaagaaaagtccatcggggattctgcaacgctatgtgtctttggaggaaggaaggcaattgctaagagatatacattcaggcatctatggcaatcacgctgccacacgaaccattgttagcaaggcctatcggcagggttttttctggcccaccgctgtatctgatgctgacataattgtgcgaacatgtgagggttatcaatttttcacccgacagactcatctaccggctcaggagttgcaaaccatcccgttatcttggtcgttcgcggtttgggggctcgacatggttggcccattcaaaaaagctatcggtggttatactcatctctttgtagctgttgataaattctccaagtggatcgaagccaaaccagtcgtcacaatcacggcagacaaggctatagatttttttcatcaacattgtgcactggtttggggtacctaatcggatcatcactaataacggcactcaattcaccggcggagtatttaaagattcctttgaagacttcggcatcaaaatttgttatgcctccgtagcgcatcccatgagcaatggacaagtcgaacgcgccaatggtatggtactttaaggaataaaagtacgagttttcgaccaatggtatggacaagtctttgcgatttcgtaacttcaaggaggagcgctacggagaagaccgagtggatgatctcaaccgactggaagaagcccgtgaagcagccttaatccagtcggctcggtatttacaagggatacgacgttatcacaatcgcaacgttctttcacgagctttcttagtcggagacctggttttgaggaaaattcaaactacacgagatcggcataagctatctcccttatgggaaggaccattcataatttctgaagttactcggccagattcttatcgactcatgtgtgaagacggtactcatgttgacaactcttggaatattgagcatcttcgtcgtttttatgcttaggcattacttttgtatcttcctctttgactactaacatcaagttgttccttgagttaccagtcgggggctactataataataatggagtgtgatttttatcaattcaatttgcttacttgatttatcattgtcttgtttgattttttagcttagccaatgaggactgaaagtttttaacaacttttgcgggttctaggctcaataaggtttgataaaaacttttaagaaatctagagctgagtttaaatcatcaagcacagcataaattcatcagtattgtacaaattgtgcctccatcatcatcatcattatcatcagaatacacaatcaatcagattcagttttttaatcattagagttatcagacccagtcggcttaagatcgttgtcctgtaacctctcaactacatcagcggctatcttgtcggcagctttttgcgcatcactgatgaggtcaagggcggcttcctcacttgtcccgtctgcgaagccgtcaacaacatcaatatcaatcttcgggtacaaggacttggtcatcgccaactctagacttgcccccatacttccagcttctttgatgttcttaaaatatgtatccggagcagttctaagcttgtcgaagatttcgacagcatcaattgaactcggaccattgttattgaaaaacatggcctggacgagtggcgtagcggcattggcgacttcatctctagctccttcaagcttcttgattttgttaaccaagatgtcgaattgagcctgggatttgattttgcgatctgtacaaataaattcacatcaatgactgggcatgaagatgagagtggtttttgaagtttcagctacaagtaccttcgacatctttcagagccgagtccctctgttttgccagttcgaccttgtctttctccagagcctggattcgcctttctagcttggatatcttggcagctttcactatattgctttccactggttaatcgcacatgaatagcagcatgaaacaaatcagataaggatgagagttaccttttgatgaaccacttagctcaaagttggagtcttggagctcggcgatccggtctctaaggtcatgctcagtcttcctagcaagctccttggcttcacgcagttgatctctggttgcttccagggttccaaggtggggaaccaatttctcgaggattgcagtttttgcctcatttctaagatggattctctgcattacaagtgcgtctttattcagtaaagtggccgacaggatgattgaagctgtatgtaaagagacttacatttacaagacgggtagcttgtccaagtgtctttttcagcagacacacttcctcgtcttccttctgtttatttatcacgattccctgtggatgcatttcatcgtctcaccacttgactaatatgggtgggcgagaatcttcagccgatcgtatccggaggacctcttctttgtcaccaatcattgggccttatatattcatgaataatggtgagacaattgaagaaagtttgttggatcaaaacggatttggaggacttgtttacctgttatgatttccggtcggggatgagcaggtccttttatcctaacaggagagttggatcccgggtcaacaccagcgtccttcctgggagggctgttagcttgagtttctacttctgggatgtccttattttgttctgtacccgactggtctctagtcgggggctcctgttcaacattggcttcagcttcggccaactggtttccagtcgggggctcgttgctggcctctacattatcggttgctggttgattatcactcgggcgaccttcggcggtcggcctggtttctgttgaaggactagtctccgcgccattcggctcagggtcttttccggaaggatctatatcagatggcttcctgcaagtttgagatatgctatcagtactacttcaatagtgagtgactggcgatacaaaggaaattgctaaacgacttgtacctagatgatttcctgatttttggtatgggacgactggatgtcttcttctttggattggcttgccttggctgtttttcggtcacccctttgttgccggcatcatcaccttcatcatcgctcaagaccaatttcctcttacgggagtctgactggttagtcgatttcgaggtgtttggttgagtatcggaccgaattttttgtactccactcgcctgactagtctgccgacggggcgagcgatgttgagcaattggaggatccgacttcatcaaggcaaattcctgggcatgatattccaagctttcaattaactttgcagaagataaaagcatgcttttgagaagggctgagatgtttgatacatacccgcggaggagggttgaaggcgttgtatggcaccactggcaacaagtgcgaataactgaccacgatagcattcgagaagattttgtacattctctccttcatgactttaaactcaagagaatctagatcttcacggttagggtcatgcttgccgtcaaactcaaaggttgtgcgggatctctctttaattggcgctagtcggcttttaataaaatgccgggtgatctgctctccttgcagaccttgctctttgagcttcagcatgcgatcgatcagggcaagtgcttgggccacctcatctcccatgggaagcgagttccaggtgtcttgatatactggaggtagacaagaatactcgggaagcgctggctcgggattttgcacatagaaccaatttgcatgccaacccttattcgaagttttgaagggcatggaaaagtatttttggctcaaggttccccttagttggaaaccggctcccccgacaacacatggtttgctcttgtttggctgaggcttgaggaagaagatgcgacggaacagggaaaaatgcggtcttatacccaggaaagcctcgcaagcatggataaaattggcaatgtggactatggaattggggtttaggtgatgcaaactaatcccataaaattccaaaatcccccggaagaatcttgaggttggaagagaaaatcttccatagaagaaatgagaaaataccacgacctcatgtgtgtcaggggttggaaatgcttcgccgcacgccggacgccacccaatgatctcctttgccggaagaacgccgtgcgccaccatctccttcaagttttcctctgtcacatcagagggcacccactgactttcaaagctttctctctcctctgccatggatgcaaattggatgatgcgatttggtttgaaatatggccgggaatggataggagatcgatgcggtggttgcgcggaagatttttgtggaactttggaggatggattggaggggatttgtgaaccctagcttcaccgaagtgatttcgcactatagcagtgagtagggaaagtggcaagagtttcggcggggaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttatactgattttgtaggcctttttaggctgcaaaaactatttgggttttgttgaggtgactggtttttgaatagtcattctctcggcatgttatatgcttattttgattatgacgtgagtcatggcctaggttatttagactcatcgatttatatcacatttgatggatctttttgagagtttttactcggattcttgtcatatgtgttggattatggaccttatagtattttttactcgggtttctttatatttccatttttggtatatcaaagctaaagcagtcggctggatattttatcaaacgtctcatatgcttagttgtatgatactttggatgattcggttgtaaaaccactcggttggatgttatttacaccttgactatatgtttagtttttttaactaatcacttagtcgggggctacacctaattaggtgcatctagtcgatgcacctgattttttctattttcagccattcacagtctttgattttgatactcgggagaccaaggcagaagaagttggagtgctcggattatcgtttgggattacgagagaaaactattttgttgactgtaaaggtctcaggggctactgtggagattatggataccccatacctacacggcatgtataatccgactaggtatggggtgccatgtatagatagaatatctttaaagggacttgggttaaattccaaacttgtatgttaaggaaatactcgggatcttagtcggttacgattgaatcttatctgtaactacctattccgttagggatatggactgtattttgtaatacggaccccttcccctatataaggaggggtccgggtgcctcttggggcacgatctgctcccagatcatacgatcaataatacactcggtggatcaatccccggacaggagtagggtattacttcttgttaagaaggcctgaacctgtataaaattctttgtttctcaaccccatccacttttccagcttgatagccacccccttttagtattgccgaaatcttgtttcgacaaatttcaatcaaattttcaattttgatgtgaactaaacacacccatagtaggatgcatgagatcgtgagatgagtaaactcaaacttgcttaaggttgggaatcgctgattggtaactacattaattggccctcataattttatccatccaaattccccattggaccattacttacacttttgtagggtgattactggagggacgacacagggcacaattctctactgcttgtacatgcttcagagctgcaaaaaaaatgacaatttgaccctttcagaaaacttatttcgcaaataaaccgcgcacaaaacttatttcaaaaataaaccagaggttcagcgccaaatgcttcggcactgagcttagccacctcagtgccaggtcaaccggcactgaatgtcgtgccaccgtggatggcacgccgactcagtgtgccgacgtgtcaaagttcagcgccacccgactcggcgctgaggtggctaagctcagcgccattgtatttggcactgaaggggggaacttagtagctgtgccgagcattatggtatggctggctgctctgctagatctcagcgccaaataggttggcactgagtatggctggttccgtgccgggtggtttggcgctgagatatatttgacaggcttaaaactatgtttacttctgacacatttggagttaagtgaacacagcaaaaaatatgcagtcattcggttgataaccagtgcgcaaccaaagcaatgttgcgaagtgaaagtcacaactaagcaaaccatttaacatatatagaagcagtacttaactagagaacaagtcttagccatacataagaaggtccatagaaccccgcaaaaaaaaaaggtccatagaagtgcctaacagccataggtgcaaaagtgatgctaattctgacagccttacatgacgaggtccatacaaaagtcatattcagcataagttgtgcacatcaacttggaggataccaggacaatacttacaataactgaaccattaccatcgcttatatacaaacctgccgagatttgcggctcctggagatttttgagctggcgtggccacctgcgcgtgccgacgcgtcagcgaggcgctggatggcgggtggttttcgtgagctctcgcacgtccgtgtcgtcgttggtgattttgcaaaaacacccttcatttacttgataatttgttatagatccctggtccttagttctaacgttgtgcactcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattcctctgcctcctctcctctcgctccgctctctctcctgcccaagcgacggccgccgccgcgtgccgtcccctcatcctcttcttcccgcagttggcgacctcccccgcgcactccctactgcgagctgttgctgtcgccgcgccgtcgtcctgccatcgccatcctctcgctcccgcgccgcatccgccaacgaggaggccgggactgtcggatccggtgactccggcctcctcgccggcagatccggccgccctgaagtgaggggaagccaggagccgccttctactcttctacctctatgcccggcactgcccctctctccctctccctctccctctccatcttgttcatttccggatcagcggatgcctgcgattaggcggccacgaacgtgcgtgtgggacgtcgaggagacggggaatcactggatccaggaggtcggtgaaccgatttggagagggagctgcatgatctgtggcattggtgtaccgtttcggacagcggcggtctccagtacggcgggtgctgctggatctgccgcatggagggctcctcgtcagctccgtcctacctcttcttctgcctttttggaaggaggtgaggagaggaaagtttcctctggaatttcatactgcatgttatatctttgccaagttggtggtcttagtgtgatactgtgattaatttggaccgatgaagatatgtgtattgaatttttctttgcaagtttaaatcagtgtaacactatgaatgtgagcgtgtgaatgcagcttgtagtgaagctttgttgagcttacgcaaagcagagaagggcatcggcgcggggctcctagaggatgctgccacctccatccccttgcgtcacggccgtgctgccctactggtcctctggcacagcatctaaggtcatctgccaccacaaccaggttgcatctccaccgaatgtgaccccactttgatggcggcgagctttgctttggtagtgttgctgtcaatttggctgtgcatttctttaaggggttcatctacgatccattgtagcatgctgatgactttaaattacaaatgagttaatgcataagattctttgtttccaagtataagaaattgatatatcttttgttgaagtatgagtatgctgatttgttccagcaaaatatagcaatgtacaatattttttgtggataataatttgataatgctccatccaaatgtagtcatgcatcttcatcaaaatagactgtggctttgcatttttagtttgttcattactaattatgccccttgaaggtagtgacttctataaaattaatttataacgagcatgtttgtaacttgacattagatgaccttttacatgcagaatctgagactaaacatatacactaatcacactaatcactactactgctgctatatattactgttgtaccaaaaatatacaagtgcatttgataaaggttatacaggtctggatcagaactgtatattactgttgcaccaaaaataaattaatgaactgtaattttctctgtattatttttggatgtgattactaaagctcgctatgtgtctgctctttttgcactatagatgttatgtggggcattcagtatcagcgccggaaccgacgccaacagccagagcaggcgccgtgatgttggatcaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccgggaaggtaaggcgtgcgtcctcgccctcccgttcgagcacagctacgcgctatgccacttagggccggcgcctaacaatagaaaatcaatttatctcaatttgttgcacaatccatctatagcttcaattctattctaagctatctaatcttcccaacgccaatcagctgctgcattacaatggaatacatttttgcttt

SEQ ID NO: 21653 - DNA, 3130 bp, Oryza sativa
  unsure (1)..(3130): unsure at all n locations
gcggtgannntctcatnccgtgatacaacnnnnnnnnnnnnnnnnnnnnnnnnnnnnnnnnnnnnnnnnnnattggtaactctataaaaaaaattaattatcatgacataatagacattaactctgaacatattaaattatcatgacatccccacgatgtgcaacagaatttaacttgatataaaaaaaagtgatgttacattgttttctaatttgcattcagtaatgcctatgatattttacaaatgtaactgacttgtccttcagatgcttctcatgttctacattggatgcatccagtttttattgcagctcactttgaatcttctacctaatgcttctaatatttatgcccttttttatttaatatgtgatgattaggtaatgcttagactagcatataaaagattggcttgattagggttctaaaattgaagttttctttgaaacgactaatgttattatttgctcttgccatagaagtggtttttcaggactcttgataatataactattggtttgggatgataaagcttcagtttaggacgatgagtgctgccctgtaggttaaaatcccattttaactaagttatgtattatttgactagcttgcactttcaccctcttcctttaaacatactgatagtatctgctcataaaattattgtgcttgctatgatttaggtattaaaatcacataccttttataatctatgtaaaagatgtacaaccagaaaccaataggttaacttgacagaattgacctttacaatcctacaataccgtccattccaactttctttgctaaataaatatgctgctgtgtgcattatttggttcacatacctgattattagaaaattactgaaaacagtttggattgtttacctgtttgtttttttagtatggataaatcattactttgcttttggttggtacctttttgtgccccccccccccctgctatttgagatgtttaattaatttcctcatattgggctaaatttgtacctgctggtggtccttcagttaattcattcacagattacttgacatcggcaattgcttctttgattcttacaatctgaatatataccaaaaaacaactatgttaacttgcttttttcacattcagaaaaagaacattactaggaaacaaggatgcttaattgttctaatattgttgagtagttcaatgccataagattattgactgccagtattgataaaaaaaattgtatttttgcatcacttctcaggcagctatgtacacgggggaagcaattcatcatagcaaaacatattgcacttccatttgcacatcaacaaaagggcccctgtgtgaattcggtgaaggcatccaaaccatattagtagaatttagccatgtgtaatatagttttatagtcctatactcctatgtgctcatctagcagaactgtttcaatgctaccactataaaactactatgtactgtctatcctgccatcaaacatgtggcacattttgctatttaggactgtccacaatctgcatatatgttgtgattagcttttagcctctataacaactttcaatataaatgctcacgtcacaaaacttcattttttgcactacactaaacctaaatctcacaccatgtcgttagcctatacttgaccttcacagaccttgcaaatagcatttgtttcagttacctaccagaaccaacagatgtaatcaatgattttcctctcctggcaccactggtgcaacgcgcgaagcgcgcgttcacctctagttgtctttatagtactaccatattggcattagcaccatatgctacacaaaagtatacttgtggctaacttgtagccggtcggattaagcgaaacgccacgcagcgatggcgatgatacaaatcaggacagcgacgaagggagtggcaaaggcttggaggatgttgaagctggagcgaagttgttgaagctgggcctccaattcctcgttgcggttagctaggttagcgaaatgcgtcacggtacctgcaacggactggacgcgggatatttaagtaatgtgcatgtatggagcaaacgccaatgaggaaatagtttagttatagattgtaatgaagtaatgccaagaaactaaaaagatcataaaacatcgtactgttcaattcctagatgcaattgaaattgaaaagtgaacagtacatgcaagaaaagaacaggataacaaacacatcaaaggtaggctatctatatatgaagaagggaaattaattcatatcttgcaacaattccaatggtatgtatcacctcaacttgaatttcatccctttccattgaaatatatgattgtaacaattgtaatttattttgatctttgcatggacagattctttctattcagaaattaacatttcaactttcagaaattgttttagcatcgtaacacatacttatataacatcgatctactcatggtaaacatgagttgttaagcccctcgacgaatcactagaacttgttaagtatacagtggcgagctgcactgtagtttaggcctaagcccatttaccttcccttcttcagcaacaagtaagaaacacacaccacttcactttacccatcagatccagagttccagacgcgtcccacccgtatcacctcatctccgccgctagcgccgttgttctgagtcgcaacgctaccgcgtcgtccccttggcttccctccacctcttggtccatctgccatggccaatttcgtcggagcgggcagcttgaaccacccaccaccccagcgcaaagggaaaggtgctctccagagcaccgaccaggtgttgccgttctccacatcacgcaacaacggcaaggagggaaaagctcgcaagagagtggaggaggtatattcagaaattagcatttaaactttcaaacatccctacacccatgcagaagcatcccaaaccagtttccaagcagaagcacatttaacaaaataggttcgtagttccacgacaactaagtgcacatagtgaaccgtgattccttcactatctcaacatatgcctcccattcggtctctccattcaactgggtaccgagctcgaattcgccctatagtaatcgtagcatcactcg

SEQ ID NO: 21654 - DNA, 2179 bp, Oryza sativa
  unsure (1)..(2179): unsure at all n locations
gtgtgttgtttgancatgatataacnnnnnnnnnnnnnnnnnnnnnnnnnnnnnnnnnnnnnnnnnccgatgtgggattcggaggggccaccgatgaccagcgacatcacctcggatgtcaccacgagcaccctggcaccggggttgctcttggcgatgtccttggccacacgcagcgccgtggtgcctccgaagcaaccagcctggtagagcatgacacgcttggtcgacagcgggaggccgaggagcttgatgagcacgacgtcggcgctgggcaagcagccggtgctggtggtggcgaagacgatgtgggtgatgctcgacgccggcttcccccagtcgtcaatggccttgcgcgccgcctccgcaccgagccgagggatgccctcctcggcgacctgctgccgtacgttgagcgaggtggacatgtacgccgtcaccgacgggttggccctcagccactcatcagagatgtacatgtgccgcttctccgtcgatgtcttctcgcctagatttgcaataatgcaataaccattgctatataattgcttgggcaccatgaaaatcgtctccatcgtttcgtttattgatggaataagcgaaacggtatatttgtaaacggaaaataatttgtaaataaaacttttatatgcatgttcttagcgatctaacggcaaaggctgaagaataaattatgatgaaaaatctcaaaattaactccaaatataagattggaaattcaaattttggcttataagaataagtataagccaaaagatgaggctgctagcttctacctatatatttatggttgttaattaagttcatcgatcgggaaaagatacaaaatggtagtaatttcgcatgcacttacagatgtttgcaaacttggcttttaggtcgaccaagtgattgctatcggtaatctcaaagtaataatcagggaatgacttctgctcataaacatgaaccggcacggccgtgccgattcccaggattgttgctctcccgccggcacaaggattgctgctcatttcatgtgtcaactctggtgcccctgacgatcccatcaggcagtacgtatttggagtatggacggcaactatactctaagaggaaatgaaatagccgctatagctttgagatctctgcagctaccaaagctcggcctgatatatataggcattgtcgatgatgacggccgggctactttttttttttgttacaactagatgttagcattaatcgagaagaggtggaagagggagtggccggcagttcaagtggaggggagaaattgaagaggaatggctggcggtggaagggaagagaatttgtcatgggaggtcttcaggagggtaatttggtcattttgacaaaattaacgacgtctaacagaataaaagtgatggcaaagacatttccaagataaaatagtttatacgattatatttcttagaagttgggtttgttgatggcctttattgaacgaaagtctatatgcttgtcaattgcatctagctaatccaatcatcggtgccatatgagaagagtgtgcactagcttgaagatcacaccaaaaaccatgagattagtagatgccatttccattttccaccattaattggcctcttgttccgctccttgcgtgtcgcatgtacactgtgatcacccttttttttgtcaattccatttgagtagtaattctgtaattgttgtctttttcatagtactttttttcaacttcatttgattgtagttcttcaaaacgtaaatgtaacaatctagcggattaaaagtagattagatgggatagttacataaacattttcttgaagttcgtgattacacatgcatgcaccctatatcaatacccgaagaaaataattatgtttcatatatacggatcatatttagatgtttagagtgagtcataatattataatgtttttatgtaaacaatacaggtggttagctacatagtgcagaggtaaaacatgaagctacatgaagtaagttcagcgtgaaatctaaaagtaattcaaataaattgtagaagtaactaaatacgataacaaaagtaactctttgttctagtattagaagaagtagctttatnnnnnnnnnnnnnnnnnnnnnnnnnnnnnnnnnnnnataaggatntgcaatccaagccgcg

SEQ ID NO: 21655 - DNA, 2136 bp, Oryza sativa
  unsure (1)..(2136): unsure at all n locations
aaaaaaattccacccagtcttatcgaatatttagcagnatatatcagtatttaaatatagaaaanaactaattacttgtaaattacgatatgaatcttttaaatctgattgctccatgatttgataatgtggtgttacagtaaacatttaccaatgacgaattaattaggcttaataaattcgtctcgcagtttccaagctgaatctgtaatttgttttattattagtctatgtttaatactcgtgtgtccgtatatctaacgtgacacgctaaaaaatttcgttttgcttatcaaaatacatatatgtgtttgagtccgtttttaagctcgttcgctctttaaaatataaaaggagtcgtataagaaattattttaaaggaactcacattctaacttggggcgcttttagaaacacaacagttatcgtataagaaatcattttaaaaaactcgcatgctaatatgagataagagtcggactcctaattacaactcatgattttctaaaaatagtatccaaacaaattctcacaatgattttcactttagctaaattgtataattaataataataataataataataataataataataataataataataataaaataatattcacccattacaacgaacgtgtatttttcatagggtagtatcaagatttcagccgatcttacctgatttagccttatattttatgtgcttaattgatatgctagatccgccttttatattgagatcttcttgctttcaggtatattaagcttctcgtttgatatatattacttgctttaatatctttacatagagtggtatcggagtattagccgatacatgctaaatctatctaatcggctatgctatgagcgcttataatttcattgttaatatatatttcgatctaagtgatttatactgtctcgacatggcgatcaatctatcccaatcacttgacttaaatatatatcgacttaaggattatgtaccgttaatatctacagccgattgaatagatttagttctttcttgttattcatgactgccaatcgatgcaaagatgacatcggctcaaggataaatgatatgtcatcggcgactggccgatcggctatcggttatgaatttaactgctattttcctgtctttggttattggtgattgcaggatcaaatcaattggcacgctcatgaacctcaaaggcaagatttttggacctgcactggagttaagcagatctcccaggcctcatgtttttcgcatcaacacgcttttggcaagcccagtgggaccaagttacgacaattttctctcatggctgaaaaaccaccacagtcaccatcatcagcaacaaagactgtggtccctcctcagaccaagattccaaagcctacgggaaccaatgaggctgaggttaatactgggaatattattccagtcactggtggcaagctatcaccagagcaaaaaaggaatttgaactaatgatgcagaacgcacaacaacaattcatgaattcattcacagagactcggcaagggagagttgttcaaaaatacaagttgaagctagttgctgatgtccctggaacaggtccttctaaagatggtgaggtgcaaaaaactcaagtcagcacagatgattcaggcagcaaaggtactacagatggattgggcgacaaaggtgatgggctccaagatggcttggttgaagatcttggtgaaaataagcacaaaagaccaattgcagttcaaccactttccaagattgaatagactacaccgtgccacatgctttgatcaaccaatcgggagtgctgtttaataccctaccaacatggtgaaagttttggtcgatggaacattaacttaccatcaagcacaggcccagttatcttcaaggaggtgtttcccaaattacagatatttgataactggtaacaaccagcctggctccaaacataaccaccagttcaaaccgaccggcaccaggttttgggttcctgaaccaagccggacccggtgtaaggcaccataggcaaacaacccaatccttgattggtggacccaaagaccaagccacaggatgtgtggacaaaaatattcattcgggttggcaccaagggagcagg

SEQ ID NO: 21656 - DNA, 739 bp, Oryza sativa
  unsure (1)..(739): unsure at all n locations
ngctccacgacacgagccccaagttcggctggtcgccacgccacccatctccatcttcgcccacgcacccgcacggtcgcacgcacgcacgcgccaatgtcgtggctcgcgcgctccatcgcggcgacgctctcctcgccgcgcggcgagccggaccccgacgccgacgagcccgaccacgccggcgacagggcgtcctccccgcagggttcctccccgcgtgaccccgactccgacgaggccgagcagcccgacaccccgagccgccgcggcgtcaaggacgacatctccgagctcaccgagaccctcacccgccggctctggggcgtggcctctttcctcgcgcccccgcccccgcgggagtcctccaccccgcacggggaggaggagtagtagggtagggatggggaagaggagtcagcgcagtcgccgcggatcgcggggatccggagcgatctgacggagattggggggagggtgaggagcggcatctcgatgctgcagagcaacaaggcggtggcggagatatccaagatcgcgtcctccctcctgccatttgggcagggggatgcggacgagggggagcccgtggctggcgtcactgaggaggttgtggtgttcgtgcggcacatctcgaccaggcccgagacttggctcgatttcccactgttcatcagtgnnnnnnnnnnnnnnnnnnnnnnnnnnnnnnnnnnnnnnnnngttgtatttaantgaacac

SEQ ID NO: 21657 - DNA, 968 bp, Oryza sativa
  unsure (1)..(968): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggaccgcgaagggagtgaacgcgtctagcgcatctccaaacgctacgtgctgatagaagggaccctctatcggcgcacggctaatggagtcctcctgaagtgcattcctcgggaacaaggcgtcgaacttctcgccgatatccatgaaggcgaatgcggagcccactccgcctcgcgcaccttggttggcaaggcctttcgccagggtttctattggccgacggctctcaatgatgcggtcgacctggtccggcgatgcagagcgtgtcaattccacgcaaagcaaatccatcagccggcccaggccctgcagatcataccactttcatggccatttgctgtttgggggctcgatatcctgggaccatttaggcaggccccgggcgggtttgagtatctgtatgtcgcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntn

SEQ ID NO: 21658 - DNA, 2293 bp, Oryza sativa
  unsure (1)..(2293): unsure at all n locations
cccctcaccgcgccatgtgctcggtggactcggtagatcgtgcaccgacccccaagtgccactgacagtgggccctacgaggaatattcttccagaatattcctttccattaaaaagaaactctttttcctttcgttctgaaattaacttgaacttcataaatagatatcttgcaaacggtaactccgtttgactccgttcaactctcaaaatctctataaaaatgagatctatctattggcaatattatcgcctactattttaggtactttagtggcttttgtgttgatttactcctttttgcgtgtagttgccaagcctgaggacgatccgtaagccattcttgatgaggaagaaccacgcaggaccaaggcaaaccacctttggccatattgcttcctatatgtacaaaattatgttgtttggaaatatgcatgcttagattacacgttaaactgtttggtctcggtttgcgaatgcaaccgacggactcacctattagtcgcacttgaatctagtaggatattgaagtaacatgtcctggacagctccacagataatgcgtcggtaacttaccatacaagtatgatcactgaggtagttttgcttagctatgctgcgattgcattgtcgtatggggaaacatgggtttccaaccaaatattcaaaacccgagattttattttggtgtgtttgataaatgaaactggattatgaacctggatgatatgtaggctgaacctgtgtgattggctatgtattgttgttaaggaccgattcatttgggaattccatccaagcatcttgtagtacttagtttgtttgtgcctaccttgtgtgtcagtggttggggacaacggggatgaggagacggagttttgtgttgtgagattttgaccattcatggcaatcgtctctattgtgctgcttacggtacaaataggtgtaggagcatccttgactccttgttgtaccccgagtagacgatggctagccagcctgatgcttgacgtgcgattcaactaactatgtggcatggggttttcatgaactagatttagaaaggccttgccacaaacttgtggtgtcgacgggtgaccggtggtagtttcgtgccatgtgggtaaagcgtacaacctatgtggagtgtaaactgttcgaacagctgtgcttacggtcaagggcgaatgtgaggtgattttcttagcgtagcactgattttgaaagctttttgaaattggtttgtgggatgggccggaatcgttccagagccggtctgtgtggcagacggagaacctgagtggtttcaaacaggtggggtgtcttgtggcaccatagtggagctggaatagttggttaagatgtgttgcgagatgagatggctccgcggttcctagctataagcagtactccctccgtcccattttaagtgcaacaatagttttccgtacctaattttgaccttccgtcttatttaaaaattttttgaaaaaagttaaaaacataagttatgagtaaagtactattcatattttattatcttataacaacaaaaatactaattataaaaattttttaaaaaagacggacgatcaaagttagacgcggaaacttatggttgcacttaaaatgggacggagagagtaagaacttggcagctgatcgagctacgcgtggtggcagagtgagccggactgacaaatccatatattaattgtttataaacacactagctagatgccagagtttgctgtggaaaaaataaactactagaaacaaaatgtatagatatctgaattgactcgcccgttcactgccagaaaattgcctaccgtgaaaggtgggcacagacacatgccctgtttaaatcccacctaaaatttttcactctgtcaaatcgaacgtttaaatagctgcatgaagtattaaatataggcttaaaaaattacacagattgtgactaattatttgcgagatgaaccttttaaaccaaaatgctccttgatttgataatgtggtgctacacaaaacatttgctaataacggattaattaggcttattttcacgtgcggtccacttaagaggcccgcacgtgaaaatcgatttttccgtacggtcctcttaaggagccgcagatgaaaatggagaatgatttccgcagaccgcaatctaaagagctccttgtacagaaaaaaatcgttttatagtagtgcaaccgcccacccaagcttcaactcaagactcacttctaanngcagcnacatagagatacaaaggagatggttgagaatt

SEQ ID NO: 21659 - DNA, 1372 bp, Oryza sativa
  unsure (1)..(1372): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcagctcaagaggccaccacaatgacatgntgcagacggcagacctggtatttgttaccacctgttactatactatatatgttaataccagtataccagtcagtgagtaaaacggcacatgaccactacatgacaacccaaaatgtacaattgcaattatttacattttagtgtcttggagatgctgtcccacctcctaaatctccacccctatattcatctttactatacattgaaacaagaaactcaatctcctactccctccgtcccaaaaaaaggcaaactctgggtttccgtgtctaacgttgactgtccgtcttatatgaaatttttttataattcgtattttcattgttgttagatgataaaacatgattaatattttatgcgtgacttgtctttttaatttttttcataattttttcaaataagatggacggtcaaacgtttggcacggaaattaggatttgtctttttttgggacggagggagtatgtacatttcagacataccatggctcattgtcagtgacccctcgattccggtgcaggtacatcagtcatcgatggacgcagcctcgtcgctcctggtgactgccctcaacgaagggagggatgtgatcatggacggcaccatgtcgtgggagccgtttgtccagcagacgatcaccatggccagggctgtgcaccggcaacggtaccgcatgggtgttggctacaaggtcacggaggacgggtcaatcacttgaggagtacctgggacccagtttganggacttccccagtttccccaccgaaatattttgtgttaaaaagggggaaaaaaaaggaggg

SEQ ID NO: 21660 - DNA, 1567 bp, Oryza sativa
  unsure (1)..(1567): unsure at all n locations
gcgtgccnttagattcatcctnctnnnnnnnnnnnnnnnnnnnnnnnnnnnnnnnnnnnnaacaaagaggtataagcacaaaatttgacacggttaatcacattgtcaggagagctgtgatcaccgggagagcagtgagggtgaagtcccagctgaagtcccacaagcggttcgccaccgcgttccacagctactgcaacctcgtcgacaatgcgaggctctactgcaccaactccacgggcgccgccaaggtgagcttaccaatgcattccgtgttcggttaccgatgttgttatcggggccggttttataacatcaggcacattgagaaatgagaattcaccatcgctcgctggctctctctacagctgataggatggaaggacggcgagagcaaccttctagtggaccctgaagaaatcggctgcttggagagggtgagccacctcaacgacgaggccgactgcgtccacgagatctatccggacggctcggcggcggcggcctgggaggccctggtcacgtcgccgtcgagggcgccggcgcagcgggagatcatggcggcggtccagaggagcgaggcgcgcttccggaccacgtccacgccctcgtagctgcagcacacgatcactcgtgtcaggttggaattttcttttcttttgacacgatttcaggtaggattgggggtatttgggtgttggttgtgtgtggtggctgccaaatggctcgtgggacacagttcgtgttatgtacgtatcatactgtacattgtatcaactgatcctgactccgttaccacccggcatattgtttcgttttgccgggcgatcgagctgcatcgaatggagctcgtcggagtcatcggtcatgtacacatgtgtcttgtacgatgtattccggatctagacaagaaacaacacatacttttcatggtcacttcagtgaaagcactgatgaaaaaaactcaatgacacttcccatcgaaacacttgtgtcaagatatatagtttgttcgttgagccaatgtccatgttggcatgtcggacgccgtgcaacctcctggcacatatatatactactacgttctgatactctgattggtacatgctcacctggttggctggttcttcaggatttggatctgtggtcctgtacctgacacccaccgttacatttctgaatctaagatagtggcaggagttgcacttcaccggtgcaaacgcccgcttacttttcaacggaaatctaccgcgtccaggtggcggacgcccattcgctcagaggtgatagaccacgacaccacgccacgcatggataaccagaccagaagaactaaacacgattcgcgagccacactcctgctgtcactcgttgcatctcacctagagaccagcagagtgtagtgtgctgtgtgcctcttgctagctaagcaaggagatagccggagccatggcgaccatcgccgctgccgccgccgcccgcaccgccgtcgttggccggccgtcaggtaagttcacaaagctatcaacagtgctatagtatacttcctgtgtccctaaatattgan

SEQ ID NO: 21661 - DNA, 2745 bp, Oryza sativa
gggaaaaaaaaaggttttttttgggaaaatttttttttttaaggccacatgtttaactatttatcttatcaaaaaacttttgtgaaatatataaacttatatgtatacataaaggtatatttaacaatgaatcggatgattagaaaagaattaataattatttaattttttttaataagacgaacggtcaaatatgttttaaagtcacggcgtcaaatgttagcgacggagcgagtaagaattttggtaaaagaatcgaagatcattcagttcactgatggaagctgccattgcccattgcgtgcaggggtggctcaactgagagcgagaaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcgacgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgatcctgcctctatctttttttttttttactgttctgcaaataggcggggcctgcctatgcttgagtgtgcatgtcgaatttggtgtaattaattggagacgtgcatggatattttgtaactaattaagttggtgtttaccttgagtagtagctggctaagtttttcatgaaagtttcaagccagttatgcgttccactatatatagaaaaggttgccacatgcatattcctcttcttttgcttggatactagatgatgaaaggaatggtacacctgcagttgcaaggatggttcccaggttaattgctttcaactctctgtaaagttaaatataaaccagcactaataatgttatgaaataaattaagcaacaacacgaaaaaaaaaagaactagcactatgttcaattgctgcagctaaattgctaatggtataaaactgtcgatgtgtttgtcatgcctagagatcactagaggtttggattggctcaacactgacaaaaaaaaattgacaatttgacccatttccgaaaacttatttcgcaaatgaaccgcgcctaaaattacttatttcaaaaatgaaccggaggttcaacgccaaatgctccggcgttgagcttagccacctcagtgccaggtcaaccagtgctaaatgtcgtgtcaccgtggatggcaggccgactcggtgtgccgacgtgtcaaagtttagcgccacctgactcggcgctgaggtgtctaagctcagcgtcattcaatctggcgctgagcttcgagacattaaggcccacctgccccggccgagagagcgagctctctcatttctctcccttccccgctccatgaaaactacgacggcgatggcggcgttcctctccgagccctaatccccctctaacccatgggaaatcaaggggatttggaggggatttcatgtggaggttgtggagtaaggtaaccttctcaaaatcctcctatattttcttcatttggtgatttgttttggagaagagcatgaaccctaggtttgtcgtttttgtgagacaaggaagatcgacttcatttatcggttaggtgagttctataggttaattttgaggggatttcattcatcggtactgaaccctagttggtaggatggatttggtaggttccaatgtagggtttgggaagaatttttattctcattggcgatgtagtatgtagtgaatcgaatgaatgtgatggtatgaagtttgtgccacattgtctagtttggtttacttgtgtaagttagtcttttagtacccttgtcgttgtttaattgaaatagatgtactaatagtattacttactttgaaaggtggtcggactttgtagatggagagagttgttcatgtgcactatggtggaagtgtcctagagtcgagtaatggtggtagtcagttcgatgggatgtcggtgaagatgattgtttttcaatctaagcctaccttcgaggagcttttgtgtcgtacgaaggatattctgggttggtcggacaaggtggtatccattcaagatagatatgatatggggggagagcctatttcacataagcaaatgctagagttgaatggagagaccgaatgggaggcatatgttgagatagtgaaggaatcacggttcactatgtgcacttagttgtcgtggaactacgaacctattttgttaaatgtgcttctgcttggaaactgggttgggatgcttctgcatgggtgtaggggatggtttaaaagttaaatgctaaattcttgatataccttcttcactctcttggcgagcttttgcctacttgccgatgatgcgtgatgtggagaacggcaacacctggtctgtgctctggagagcacctttcccttgcgctggggtggtgggggttcaagctgccccgttc

SEQ ID NO: 21662 - DNA, 852 bp, Oryza sativa
  unsure (1)..(852): unsure at all n locations
cactggtaaancgtttctggtgtagtgtttactttctttcaattcatcttcannctgctatctaaaagtctctaatatacttatactgtnaacccaccccccccnnnnnnnaagtggatgataacttcatgctcgcagcctgcaggtcgactctagaggatcccctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21663 - DNA, 739 bp, Oryza sativa
  unsure (1)..(739): unsure at all n locations
cggcgcattgaattgnnnnnnnnnnnnnnnnnnnnnnnnnnnnnnnnnnnnnnnnnnnnnnnnnatctcaaggggataccacatgcaccatctcttcttttttgtgtggggacttattctctcttcccccaaacttgacttgacttctcttcataaatggacggagatttgtatggttgccgtccgaatgaccttctgatgggacggcccatacctacctccacttccgccggaagcaggcgcgacgtgggaacatggctgtctgccgtcgacatgaccagtgtcagaccggtcacaaatcggtcattcttgtccaccacgtgtcagtttagcaatctgcatattcgcccttcttcatacaatgtcttgcttgtaatggttaggatgaagcctggcatatatctgaccgggaccaacgtgccatctccaggaggtaacacgccggctccggctagggacgagtgcttggaggctctcatcctgacgggatggggcgaggcgtgtgttagaccgcctgtcgccacctaacccacgatccgatcggtctgtgactggtcacagaccggataaacgagcgcgctgcactgcgttacatgcggcgtgacgcgctcgtctaaaccgcaataaatgcggttaggtgagccccgttgtgctcacccaacccatacacgcggggccaaacccacaaggggtcggggcgcctcagccntcggngcccgaagcgggagtggtccgaccn

SEQ ID NO: 21664 - DNA, 1305 bp, Oryza sativa
  unsure (1)..(1305): unsure at all n locations
gaagttctggtattatgctcacggtgaacgctcaacccagctgatggctcactggtctttttcgatcagatacgagaggctgcgcgacgactaacaaatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaaaattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgccccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccctgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacctcctgctggccgagactgacgagccggcgagccgccctgcccccggccgnnnnnnnnnnnnnnnnnnnnnnnnnnnnnnnnnnnaatgaggttgaataacaagggaccatg

SEQ ID NO: 21665 - DNA, 735 bp, Oryza sativa
  unsure (1)..(735): unsure at all n locations
tatgcatgcgtacccattttcaatagcgtaaacatattttggtcatatatatatccatatacatatgcctttgcataacatatatttgtataaatccatatatattatgcatgtatatacgtatgatataatatgatatatatctatataccgataggtttgtatgcatatatatgtattgaaacatatacatgcatggttcatgtctatgtatatatatatatatatagcccgtccatcaccagggctatgctaaaaaaaaaaaggtcagctcgatctttagtcccggattggtactcccggtttggaaaccgggactaaaggggggttacgaaccgggactacaaagggtttctccaccagtgctcttacatatcactttttgtgatctttgatgtacaactttaatcactattatatattaaaacagagttagagtatttacggctaatttttttccagtagtagatgatgtacccatcgatagtgaggtgttcatggtaacttaatcaatctcaagatatgtcgggcccagtttttcggaggtgctcataaggatagaatgtgcgtatgtattcatatagttgagtgcccacgcattgggggcacatgagattgtaatgtgtttattttaaaaaaaaagagtacctagtaaaaatttgtattggtatagtgtcggcaactannnnnnnnnnnnnnnnnnnnnnnnnnnnnnnnnngttatacaatgcgctc

SEQ ID NO: 21666 - DNA, 1302 bp, Oryza sativa
  unsure (1)..(1302): unsure at all n locations
gcggcttgatattgactatcactatatgcctgcacgtcgactctagaggatccccatgcaaatgggttttcaagaaaaagcttagccctgatggtacaatcgaaaagtacaaggcaagacttgtggccaagggttatacccaaaaggaaagcaaggattttgtcgacacatactcaccagttgctcacttgacaatgattcgagtactacttgctctggcagcctctcatggtgttctcgtccatcagatgaacgttaagacagctttcctaaacggagagctggaggaggagatctatatggatcaaccagacgggtatgtactagaaggtcaggagggaatagtgtgtaaactgttgaaatccttgtatggccttaagcaagcacctaagcaatgacatgagaagtttgacaccacgcttacatctgcaggctttgttgtgaacggagctgacaaatgtgtgtactatcgctatggtgggggagaaggagtgatcttgtgcttatatgtcgatgacatattgatctttgggaccaacctcaatgtgattgagggggtcaaggactatctgtccaagagttttgaaatgaaggatttgggagaggctgatgttattcttaacattaaactacaaagaggagatgagggtgagattacacttgtgcaatcccactatgtggacaagattttgagtcactttggatatagtggctgcaagccagcttctactccttatgatcccagcgtgctattaaggaaaaaccgaagaatagcaagggatcaactgagatactcccaaataattggttcattgatgtacttggctagtgcaacgaggcctgacatctcatttgctgtaagcaagctgagccggtttgtcttaaatccgggagatgatcattggcaggctctggaaagagtaatgcgctatctaaagggcattatgagttatggaattcactataccaggtatccaaaagtactagaagggtatagtgactcaaactggatatctgatgctgataagataaaagccacaagtggatatgtgttcgcacttgaaggtggcactgtttcctggaagccttgcaagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 21667 - DNA, 1036 bp, Oryza sativa
  unsure (1)..(1036): unsure at all n locations
ataccgcattgacatgccagttaattagtaattaattatcttgatttgtgattaattaattgttaattaagataattattattagttaatagttaattaggtaattaaccattgacggccgggactgccatgccggtatcgctgcttcaaccagcgataccgagcggactcgctctttgcttccgtgagaccgcgcgatctcgtgtcaataccgcgcgatactgcacggtctcgcgcttttatcgtgcgataccgctggtgacgtcatgtctacgtcattttcgcataacggttgcgcgagatcgatgttatatttgtaaaaaaaattcatctcgaatatttctgaaaaaaatttggataaacagtatattttcaaatttaattcgtactttctgatggattaatcaaaacaaagtagagttcgtggtcgaagtcgtcattgtcttccttccaggcttccagctgtgtgcaaggcatgatcttagtactaccattactagtagtagtggtacctgcaatttttttttctgaattgctaaacggttgaatagctcaataattttgtggtcgttatttgagtgtgcaaatagatgaattaactattataaagttaaaaagtatatttaaagccttttttagaaaaatatttacaaaaagtttttatgaaaatcacatcgtttacaagctcatgattcatgaagcatatgcccacgttaatcttttttttttcgttttgaagaacgggcctaggtagacgaccttttcctgcagtgcaggtggtgaccaattgactaagcaccgacaacgccaagtgtgagcctcctatatatgctttctggatttcctttttcacttctgacctactccattttttcattgtttggacatggtaatgcagtctactatgagattattagagatggtgaccacagctaatgatagttacttaaattaatgtgaagtttgacaaggctttttttcaattttcattcaggtatagtaaaactgccaattaagcttaacttttagccgtgtn

SEQ ID NO: 21668 - DNA, 740 bp, Oryza sativa
  unsure (1)..(740): unsure at all n locations
cgggttggaattcattgcaattccagctcgtacccacaaatattccgtatggtgacacttttgtttggttgtactcttgtttaatatgtgttaataattcgcttatgaacatttattacttatgttgaactaattatttatatgttggggatcaatctatttgatgcaggtgtggcgtacgacacaccggcgctgttcaaccgtgggattgacaggaaccaccgctcgttcctgtcaacagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttacgtgcggcaggccttctaccactttgtaggcttgttgaggcggcggcggacgaccgtgacccagcgaagtggtggaatgcagaccggtcactccttgccgctctggtagaccgctggagacctgagacgcacacgttccaccttccctgtggggagatggctccgacactacaggacgtgtcgtacctgctcgggctaccgctggcgggagcaccagttggtcccgtggacggtgtttttgggtggaaggtggatatcactgcgcgcttcgagcaggtgatgcgcccttccacacctaggaccggccaacaccctttcttcgtactttacagtcgggcctagan

SEQ ID NO: 21669 - DNA, 904 bp, Oryza sativa
  unsure (1)..(904): unsure at all n locations
agttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatcacgaatatcacaaggtcaggtttctgcacacagaaacacaagttaaattctcagtaacaacagtggaatgtgccttgatcaaaagatctttgccaatggttgtgccaatgtaaataccgttgcttctgcaacttgacgcatttcttcgaagagtgcagcctcttgcttgtggcgcccgctagtatcaacaatgatgagatcagacttctccttcctgaacctctccacaccctcaacagcaattttcactgggtctgattccatgtagctgcaatgacaaacagttttctttaatgtcaattttagcaaagtacttttttatactaatatgtaaaggtgtggatgtagagaaccaaccttccatagtaaggaatcttggcctttgtagcattctgttttaactgatcaaaggcaccagctctgaatgtatcagcacaaaccaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21670 - DNA, 3744 bp, Oryza sativa
  unsure (1)..(3744): unsure at all n locations
ccgatgattgtacattgcagattcgagctcggtacctacttcatgagtcgaggagacccattatatcttcggtgatgcctgccttgaacgtcagcagcgcgtcccgctcccgcggtgagcagccggccgccgtcgccacgttgccgtgggcgggcgccggacggcgtgtggcgccgcgtggcagcgcggccaccgccgcctccacttcatggttggtcgtggccaaggcggcgacggcgaggacgctgaggatcaagagagcggcggtggtagtgggacgcatggtggattggtggactagtaagaaccgggggggtctgtatctgagtgtgcgagtgtatcgtatacgtatcgttgttgtttttactgtagtcgacgggtgcgtgtgtgccgtgccgtgccgtggccgccgggacgcgcgtgggcgtggccatgtatacgctgcaaacaacagtagcgacgggccgtacagggacagctttcgttggcccattgtagtgagggcagaacgttactgcctggatcgtgcggcccattagtatggcctaccagaatctggatctccaccaattaaaaccagccacggaagtcgcgcattcgcggaaatttttttatttttaaattttttttattaaaagttttacaaaaataatttttcatttttgaaaattgacagaagtggtcgcctaccgccctctgggagggtgatttttaaaaatcgccatcccaaagggcggcgaaagtgacgtggcagatggccgttcgctctcaggcgacgcccgtcaacgaaatttgcaggcgacccccttgccgccctccgctagggcgattttgtactgtgcggggggccgcctgcaaatgggcggcggggggcctggaattttgcaggcggcccccttgccgccctgggggagggcgattttatactgtgctttatatttttttataaatatcaatagttatcaaatctttttatattgaaaactatacaagattaaaatctccaagactggtaaaatataattttattattttttagggcctatttggaatgttaccgtacaaatttttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctgtccatgatatgatggagtgacattgtcgatccatcgagtaaatccacacatccttggattgccctgtaaaaatagtaatgttattaagtttgggtagtaattttgtgcaaatcatagcggattttgtaaatggttagacatacaacgaaatcgttgtctacattggggcagacaaaatatctccttccaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactaaggagtgatgaaaagaatagttggtattaccacgaaatcatcgtcgacaatgtttggacacacgaaacacctttgtcctcgaggtcggtgccttacggaccttatgaactgacaccggcaacacaacgacccttccgacgctcacgccacgtggggagtcctaggggatttacgtgccattctaaagcctcagcagcaattcgacgttcatgctcatccttccgccttaggtagtccgatcttgtttcactacgtgggtaagcacgtgttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatccccttccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccttaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgccactgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtnnnnnnnnnnnnnnnnnnnnnnnnnnnnnnnnnnnnnnnnngttctatcaaagntnngcaaatcaaagcccg

SEQ ID NO: 21671 - DNA, 1744 bp, Oryza sativa
  unsure (1)..(1744): unsure at all n locations
gcggttgatgtcaaannnnnnnnnnnnnnnnnnnnnnnnnnnnnnnnnnnnnnnnnnccgtaggtcgaggtcctgctccgacggtaggcgcgcgaggccgtggttgtaccggaccagctggaggtacgacgtccacggcgctgtgacaggagaagacgcgcatgaccgcatgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtaattgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcaccagtggtcggcagggaggacggtcggctgcacgttgcccggaaacacctgcctaagtccgaactgtcttatcacacgctgcgggcagtgaggctcaacgaaaatgtcgaacaccatcggcaggatggtgagccagtaagcctggtcgcgtgtgcacaaagacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttgtaacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagcccgaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacgaaggaagggtgttggccggtcctaggtgtggaagnnnnnnnnnnnnnnnnnnnnnnnnnnnnnnnnnnnnnnnnnnnngtataacaatccact

SEQ ID NO: 21672 - DNA, 911 bp, Oryza sativa
  unsure (1)..(911): unsure at all n locations
agagtgtttatttnnnnnnnnnnnnnnnnnnnnnnnnnnnnnnnnnnnnnnnnnnnnntaccattaacacacacaaagcagctcgactgaaataaaaatggccaagaacacctgaaaccccgttcgatcgtgcgctaaagggatagaatgaaaagtatcacgaatagatttctccaacgacgtcgtcactaggagtgaagggcacaatccttgggctgaaacccaatcctccctgcctccatatcgtagacgacctcaacattctgcatctggaagcttccaagaactgctcctggcccattattcgcgccaccaacatcgtcgtcgtcgtcatcgttgtccatcctctggaacagcaagcacttcaccaccaccgagttcttgggcgcggtgaccgcgtagtagcagctgtccttaggcagcgtgagcttcacatcgccgaggaagtgaaagtttatcagaggcagctcatcctgtgtgcatggggtgtgtgtgcaagggatcttgaagcagagatcaaaccccgtcctcatctcgaggtcgtaagatctttcatagagtatgacagaggcaagggatgataggattgcggtgtagaatggatcagggaggtgagtgtatgtcgtcccagtgtcgacgatcatcccgccattgccttcggaatcgatgctgctcaagctgggaggagcagcaatggcggcaccatctccaatgctgacaccctctagcccaatgtagtagaagtttgggttagtgatgctcttcagcattggggtgaagaggaagtcgtccttcgcagacagcgcgaggtcacccatgatcaacgagctggtgaagttcgggttcctcgcgaannnnnnnnnnnnnnnnnnnnnnnnnnnnnnnnnnnnnnnnnnnnatataatgcacgg

SEQ ID NO: 21673 - DNA, 7713 bp, Oryza sativa
  unsure (1)..(7713): unsure at all n locations
ggtgtgattgancccaaaanaannnnnnnnnnnnnnnnnnnnnnnnnnnnnnnnnnnnnnnnnnnctccatctcttactttttgctttccttgttggaacccacataggatcagtagaatataaagagttatatggaacatgtctacaaaagataaccttttgaaaactttcttgattccaaattccaaattccaaaattcttcagcctatacatgttttaaaaactcgggcatcattgtgaagccagatctaaagaaaggcagtttagtccagggagactaaaagttgatgatcaaactattcttgggaatgatggccaaagctgatggcaaattacagcaatgtgttgacaatgtgactgaaattggggcaaatagttgtttaagttaaaactaagatataatcatttataccgagaaaaagaagatgggtattaagaacatacagccatagcggaacatatatacaaattaatatatcatccatgcataaaaagctgggcattcaatcataaatctggatcttaatggccaagctgatattaccaggattagccatcgtgactaatgagaagctataggctgctggcctgctgagtgaatttacagataggtggtttgtcgtggctgtacatgcataccccttgccccactcaatgcctcttggccagtgtcttcttgaggccccttaagatcttggaaaaccatatcatattcatcacgaacagtatggcaggcacaacacaaaccagaagataaccaaaggtctccatctgcttaatctgtatgcgaacaagtatcaagtcagaaatatgtgtttgatagccatcatgtacattgaatccagaagaattaccatgtacctgatcataatgtaaaaagatctgataaaacaagtacatgaacaaaattatccttgcaacctgcacaaaggagtttctttcattgttagcagaccaaggtacttgaagctccaaaatatagtaaaaaaccatattatcgatttagcgacagatttaagtaaacctgagtgttcaaatacaactttggtagtttagtcttaaaactcccatagttaggaaggatcattttcccttagaataattcaatatatctcacttggtagccaataaacctatgtgccaatattatcctcactggaaaacaagcatttgtttgaacatatgtacaaatccgaactagcaagacaactgcttccaaggctagcagaaattcgaaatcacaaaaatttaaataaaacaatattacagttgaaaagttcagatgtaattaaagactaatgctttcacgaaaatgtatgcatagatcacataattcccatttaattatagtcagtgcagaacaatacattctgccacaacacaactagtttagaactttattcttaccagccaagtaagaaacattgcaactccattaacaacgtatcttttggatcttttcattccagcaacatcaaggaaccttgataacacaaaggggagagaatagcagtttagatggactgatggattgaagatgataccaaaacaaaattctatgcaacatatttgtatactcagttaccatcttaggttgattccaggtgtagtagtctctgagatgagactcatgtatgtgtataactgtccttccccagaaagcatagtatacgttacagcagtaagtgacaatacatggtggacaagctgacaaaagacagccaagagtaagttggtaatggctaatgacaaataatgcagtttgcaggagtcaaatggagggcaacggacctaggttagtcagttaggagggaaactgaagagagggtaaaaataagatgaaaaatgtttacttacatactccattccaccgagtgaagggtaaaaccatagtatcatggcaaggtccgcaatgaaatacccaactgagacctagcaaaacatgagattcaagtaactaagtataatgaaatatcacaagtcacaggacaataaagtaattgcatatgtatacccctagcgtgaaattggagaggctcgaacttctaaatgttactggtccatcctgctggtcagagaataaacccgagaagaagactaagtatgctgacataagtgtaatgaatattgcatggacggtggacatgcccctatagtaacaaagggtcagaagatgtatcatcagaagcttataataatagagtgggatgtaggaacttggcaattaagttggttaatgctgctgacctgttattccattcaaccttttgcatctttgtgagagaaccatagcctttgaagtagaatgaactgataaagcgtgtgaaatcatatgactgagctagcaaaagaacacaatagtcaagataacaaaaccattacaaggactatgaaatggatgttggaaataatatgctatattaattatgtgccatcatcattgaccatgattttaatggaacaaataaaaccagtgaatgaaaaaaaaaggtcttacattccaatgcaaaagagcaatggcatagatgttggcattctctttgagtatacacatacgcacaactatgaacatgttattgcacaggtacacagtagaatgatgataattaacagaaaagtgagagtcagaagtgacattaccaacttgcacatcagaattccgccaagcacagaagcgtatggaacatacgaatctgctagcaggtagtccttaacaagtagttctgctttgtacttataggctttagcagccatcaatggcagatccataatcaaatacgtgataactcaacagcctaatgaggaacacaaacagagatgcatataagtgtgacagtattaattgaacaatgtacaagcatgaacagtcacaatatatataggataatattgtacatataagtgttacagtattaattgaacatatcacaatatatataggataatattgtactgctgccaaattatcttaaatgaggtacagtaatctagagccccttttcagaatgcaaggcactaccagttccatgacttgaccaaaacaaaaggagataattgttcaatcaaattccaaatgcagcaactgtaaaatgaaagaattttgctgataggcggctattcatcatttgtaaaaaaccatcaccaacaaggatgcacagcttagctggtccctgtgtcttctctctattgttccatcaaaatttacaagcaagagacaaatgagcatgaaacttttgctagtaatcccaaaacaataaatgcgcaatacacttttccatctacatcgaaacaacaacatagaacttccgaatcacttctttctctcttttctacgcttggactcgagccatccactaaatacaaaacctaaggccaaacggagcatcgatacgaaatacgatctctcccatccaatccaacccataaccaaaaatccaccccgtacatcgcccctaatctccacgcaaaccagatcaaatacaaaaaaaccgagcccccaatccgcgggacgcatgatcgacgggcaacccaagcggcggcggcggcggaagcgggagggggagcgcgaggaggcctcacctgcgcggcgcgggtcgccgccgccgccgacgaggttggattggaggagaagcaaccggattggattggcttgccgattgctcccttccccacggcggaagatgcgggaaaggtggaaactactggaaaagagggaagggaaaggtaacggaatataaccgattggcgtaactagaaaaggaaaaaataaagaaaaacttagcttgcaccctaggccaaggcactattaatagctcgatttatttagtttaatatagtgcttagaactttatgatcgtcacgcatcagatagtaaacgaaataatttgatacggagtatatgatgcaagggaaaaaaaatacggctcgttgtacgcatgtcggtaacccgtgttattgatggtatgtattaaatgtgttggttattttttaaatgtggtggcgtaagattaaaaatgagtccgccccggtcggcagttacaatttcttaaattaaattggtaataataatagtatattaaagtgagagttcaagaaggttgcaacttacagcttcatacttattcgttccgaattttgatatttaaattttgaaaacaaaaaactgacagtaaagagtccgtgatgtttccaatcgtatattttactatttatttaatacaaattatcagtgtcatgctttataacccatctaatcagagaccagatcaatgaccagattcttctggttaaagtggagtgggtgctcactcaaaatgtcaaattagtttaaacatatatgtagatcattattccagatcttattccgatttacagtcaaactatatggctcctttctttctcactaaaccacatgatgcatacattatatggctcctttaaaggaaataagattttttttaggattccaatctcatagaatttttcccctgtatggccccttataacaaagttttgaacgttagtgaatcctattaaattcatttggaatgcctcaatccatgtcagttttggagaaattttagcatgagatccaatatcatggataatttccttttggtctttctatcctaaagtatggctacctttttagtttaattttttactataaagttagcaatatttgagacagagggattactaaatagtttaaatttgtacagtgaagtagctatatttgagacgaaaggaattactaaatttgagatgccctgcagacatgtgaataccgaatattgattcctatgaaacaaaacctcaaaataaagatagtcttaacctagtaagaagaaatgagtccccaactgcaaaagaaaaacatagttctatgacagaatgactagggctatttggatttgtatcctaacttaacttttgagttatacttagacaaaaggcccatatctactaatctaaagccggcggttacgtcgtcttttgattgggccacgtgacgcccatgtcttatcaaataaatcttggattttgtctaaagaaaaaattcataagaacaagaaaaatagaaaactacaatgttatgtgataattctaaaagcaagtagtaccttaacagcttttaaaagaaaaggtaataccttaacaacacaacatctagaacatttcgattagatgggattaaaaggatgtacccccccccccatccctcatatgccgattcacttaaaacttgcatatagaggtatatacttaaagaccctaagcttttctttatttggaagatcgatccagtagaaatcacttaggatgtgttgccactttataaaaggatgtacccctcctcccccccccctcttaatatgttgatccacttaaaacttgcgtatagaggtatttacttaaagaccctaagctttttttatttgaaagagcgatccaactgtagtaatcacttaggatttgttgccactttataacatatattgttgagaattatacatttccataatatttttttaaataggaatatcacaaatattccatttcatatatattttagaattaactatttatgtagataaccccatacattcaatctccctagctcttaagtatatgaacttcaaatatattcgtctatccatgtgaccaattgacttatcttacactactcactccaacttgactttgtggaatatgtctaactaaatgttttccagtgggtactataactatataactatgtgttctggaggtgaatttcattctaatattttctttttttatggtctctttgcttccatttgtatagtcttcaaatctctcaagaaaaaaaaatgatcaatttatgtatctcgaacatgaccaacaataccaccacaggctttattaatcggcgcgccaactagcacgcctattttctagttggatataaatacaatcctctcaaaaggggagaatgagagacaatacaagccacatgagccaacagctaatcccaactacctcaccatgactttatgccgacatagtcgtgtaggctagattactattttcaccccagccaaacaggatgtaaggtcattgcctatctcgagaacctgaaccaaatccatatttcccttttcatcgctccaatttcatttgcatcatcatatccaccttacctgtatagaaaaatacatttttttatacacaaatgctgttgttggaagtttattcaacgatggtgctgtcagaagtttattcaacgatggtctttatctctcctaagatttttgtattttttcggcggtctaatcgtaacgattatttattcctgtttttttatgtgtttacaatcatccgttttatgcatgcattcatgttaacatcatgtgttttttcatattcttttgttttcacaatcccatcgtttcgaaagagcttttatgagatgagatgaatattatgagtataaactaccaaatctttggaaagctagagatacctcttatacaatattggtttgctaacatagcgcaattcggtgagctggatatttgatgaaattccctcaaaaaaaaattctatttggtaaaactggccctactaatttctacctgttgaattggaagcccatataggctgatagtggcctaatgctacacggcccataccaaacacaagctattcaagatgggcccatcgcaagtttgggcgcagcagatttggcccaaggattccgcggaagtagccgattcggtcacctctgaaatcgtctctctgctcccatcggatagcctaatcagtcaaagaaaaagccaaatattaaattttcaagcttaattttaagattgattttgagatatttgtaacatattttttttcaatattggtttttaagttaccaagaacacatttataaaagttttacctacaaattcatttttattttctaataagccgttttgacttattaggaaataaatcaaacgatggggacctctctctccctctcgttatactcgatctcgatgtgctgcttctcgattgcgccatcgccaattcgccatggatcgttcttgagatagggttgccaaggttgtaaagtcagagcccctcgtgcgtggctgcctgcatttactttgcgatcacggaaggtttctgaaaccctgacagtctcaacaaccttctcgttctcccctcaatcgtttccctttttacacaccatctcttcctctctctcttttttcacctttctccaagaacaacttcctcctacgagtactttctggaattaaattttaaaaatatattgtttatctaatttttttaagaatagtcgggatgcaaattattttatagaaatataccgtcgatttcgcgtaatcgttgcgcgaaaatgacatggacgtaatgtcacgaacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccccgcgagaggctgt

SEQ ID NO: 21674 - DNA, 1524 bp, Oryza sativa
  unsure (1)..(1524): unsure at all n locations
cgcggtttgttagtacnnnnnnnnnnnnnnnnnnnnnnnnnnnnnnnnnnnnnnnnnnnnaatgcagtctactatgagattattagagatgtagaccacagctaatgatagttacttagattaatgtgatgtttgacaaggctttttttcaattttcattcaggtatagtcaaactgccaactaagcttcagctttcagccgtgtctcgaaacggccacaaagtgcgaatttttagggcctaattttgctaatcccgtcgcggaaattaatcgcatcggtgtgcagctaattgggcaccaggcaagcatgatccggggaatctgtctcaaagacgtgcgactaaaatagtcagattaggtggttgtgattagcttctcccatgttcagaggtaaacatggcatcaaccaagtacgacagttttcaactgttgtagttgccaatttatttttcgttttgctaactactccagcgaacactgtcgtttgacaattgctacattttactactgatgtgccataagagtttttctatggcgaattacccagtactcagtaagtttggtatgatcggtgaagaaaaaaaatactttgttaaagtttgtagtaatagtttaactgtgtagatacggttttttatacgtagatagtactgatacgtaaacaaagtaacatggtctacccaaccaacatgatgcttcatattttctagatagttatagcatactgtactaacacgagaattttattgggtttgatgacagggctacattttttcctgttcttgggacaataattcagaagttagaaccgacggaagtttctaatgcacgcttctgctgagaatctctcgtttgacagtgctgtatactaatttccaatttcgagaaatttctcatgctgatgaggctactataatcatcgagatcccgaaactcttcagagttcaaggtgacaacagggaaattttcttggtcttttcccaccgacggttcacttgtagtatcagctcataaactccatattgctaagctctctcttcctaggaaagagatgtgcaaataaaacacaacttgatcaggagctactacgatccaaagctacaaactttaatcataattccaacaggatataggcatttcaccagccaaaatgttctgccgacaaaaacagtaccaccactgcttctcccagattattttctactactctttctactggtttgagcaattgagctaagcacaacaaaagatcaggttttttaccatggcaaagtcaatgcaagtcatacagatcgagagtagctagcttaattaaacaacttccatccatggaagctgcactgaatacttatactccctccgtccaaaaaaaaaatacaaaccgtgggttcccgtgccaacgtttgactgtccgtcttatgtgaaatttttttatagttagtactttcattgttgttnnnnnnnnnnnnnnnnnnnnnnnnnnnnnnnnnnnnnnnnngtatntacaagttaatcaaatcctct

SEQ ID NO: 21675 - DNA, 1518 bp, Oryza sativa
aattttttgtataaaaaaaaaaattggtatgttggaaaaaagagggtgggttaaggggggtttcacaaagtataaaagaaggtctttttgggcaaatataaaataataaaaatatcccaaattgggttatagtccacaagcagggttatagctttttaattttcagaggggtggaaggaaagaattttgcccgaaaggcaatctctcgatttaagtaggaaaaccaagaggaggtaggaggtgcccccctggtaagttcacaggacaatttgttggaaaaccaccattgttttgttccactttaacccagttaaaccatcgggaagtcggaaaccagatttgatccttttacctttccgggctttttctttcaatgatcgggtaaaggccgtgtaacagaacaccttttttttttaaaaaaaatcatcattaaatcagcaagaaattaatccttcatactcatcaatggccgtttttctgatgaagatatcgagaagaaatgagaggaactcctgctgttcggccgtttttctccggcggcgccggcagccggaggggggataattgtagctgtggccgtggctgccaccgacagcgcgccatgttgcagcagccgccacaaccgcacgcaacgaattggacgcgacgagacgagacgagacgacgtgcgagcccatccggcggcacgcgcgcgcacgagcccaaccaaccaaaacccaaaccggcaaaccgcggctcggctaacgttaatctcgttgtcaagggaaaacacacgcggtttcatcgtcgtcagggatggaaagaagcagcggcgaagcgtccgtgcgtgagtccagctcgcgagtgtttcaccgttttgccagcttctaggggggtgtttagacgaggatgtaaaattttagcgtgttacatcaggtattgtataaaatgtttaggtacttataaaaaaactaattacggaatcctagtaaactgcaaggtgaatttattaaatttaattaatctatcattagaaaattatactgtagcaccatatcgacacatcgtcaaaccatgaaacaattagacttaaaagattcatctcgtaaattagtcacaatttgtacaattaattattttttaacttatatttaatattttatataggtgttaaacgctcgatgtagcctgatgaaaaattttaaggcgggataacaaaggcattaaccgctggtcactctggctgtgttggttgtgttgtgtgtgcgtccgagaggagagccaaaagaaggcttttttattgggggagtagcgaggagacgacgaaaataaataaaaggagggagaaggaagctgagctctcccgtactactaagaccgacgtggtgagctgttcttgtgcgctctgctgctgccgcgggggccggctggcttattaaggttgaggagttcttgatgagtaggtgaggccggaggaggagggggatcctctagagtcgaccgcgcggcatgccagcaggatgtatctcaatgccacac

SEQ ID NO: 21676 - DNA, 950 bp, Oryza sativa
  unsure (1)..(950): unsure at all n locations
cgccatgtattgtttgtcctgccattcagctcggacccgaagtcgtcgtactctacgatctccggtggtcgtgagtcgacaccgggggagctgaggtagccgtccaactgtttcgtcgaaaccgtgccgagaggctggagtatgacaccgacttccctagagctagactggatcggggccaaggcggatcccgcctaaacctacggggagatgacgctcttgtggtgaaaacgacagccaaatcgttgaggagtttcatcaggattgccggataggctctattgtcttcatcgggtcgtgtgggagtagattggatctcgtccgagtggtttggggccaactcggttgagatgatcttggggtagatctcgccaagtttgggggacgaacgggcgaaaacctggtctctttccgactgggttcgaatcgagtcaaagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaannnnnnnnnnnnnnnnnnnnnnnnnnnnnnnnnnnnnnnnnnnnttatatcaggantcacctcccg

SEQ ID NO: 21677 - DNA, 752 bp, Oryza sativa
  unsure (1)..(752): unsure at all n locations
cgcnncatgtttgtgatcattctactcggtacccagatcgaaagaatctgagcatcccgggacaaaattagcatccactaacacacgcaacttcagatcatcagatgagctagctagcctgtcatctgtgggactaataactacgatttctggacatcatcatcatcatcatcatcaattgcatgccccaaacatcgactcctttcttttcacttccttttgcatcaaaccacctcaattcaaacctaacccatccatgattttcacacgaacactagcacaagattacattttctttttccaagtcacaagacagcatcatatcttgcacacataagtggagctcattttgagagggattattattggagagacaaagccatgggcagccacatctcgcagccagccaagatcctaaacgtgcatgagcccatcagcacagtggcatcggccaactatgccgccgtggatatgctcacgtttaattgtgggtgccttgcttgcttgcttgcttcccatggccagctagaccatggctagtagctgcagtagaagtattaactaggcatagggacacacactgcttcgtgaactgtacagctttgtgggtttggttgccctgcggcttccatcgtttttattcttgcttgctccatgggagtgagggaatcattccatctgcaggttcttggctcccatttttttttttttttcgcggggatggctcccattttttcgactgacacagacat

SEQ ID NO: 21678 - DNA, 750 bp, Oryza sativa
  unsure (1)..(750): unsure at all n locations
ggccatgtttttgatattcgagctcggtacccgtataggctgagctccgaggaccagttgctaccatcatcatctagccactgacccacataataatttgattacatgcaggtcactagtacattactatggcaaatactgcattctgctgtgttgattgtgcgataaaatttggcataaggttgtcttcttgcaagttgggtgaggtttgcttagactgaatatagaaaattccaaacaattaccctctagataacaaattaaaaaaaactgtgggcaaagtacatgcctttctgcaggttgacattggatcctccgaatagaatggaggataaccaacaagcatttcatacataattgcaccaagggaccacctaagatcaaaataaaatgtgagaacaagaacgaagcacatggatgaggaaaaataacatgacttaacaattatggacaattacaagataagagactaaccagtcacattccattccatatcctttcttcagcagaacctctggagcaatgtaatcaggagtaccaaccgttgaatatgcctgcatgccaaaaaaaaaagagtataactaagcatactaccatatattgatgagagcctagaaaactagactcatgtacatattcacttgccaacgtggcaaaacgtagtcagagagcaaaatgtgaaaaattcaagataaacgttaaatgatttttcatataataaatacncagtttcatcaacagctaaataat

SEQ ID NO: 21679 - DNA, 918 bp, Oryza sativa
  unsure (1)..(918): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataccttaacaaacatggtgaagtttttggtcgatggaacaatagctaagcatcaagctacaggaccagtttatcttgcaggaggtgtcttcccaaattacagatatttgataactggtaaccaacagcctgctaccaacataacaccagttcaaccgacggcaccagtttcggctcctgcaccagccgcaccgtcgtcagcaccaaggcaaacaaccaatcctcgattgttgaccagagaacagccacagcatgttggacaaaatatcaatcggttgacccaggagcaggttgctgcgatgtttctaccaaacccactggtggccaacccagcacagtcaatgccgattcagcaaacaccaccaagacagcagacggttctgccgattcaacagcagaatttgcagcatacatcggctgggctaggaacacctgacaatcggtagaggcaacatgttgtgaatcaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21680 - DNA, 1110 bp, Oryza sativa
tggaatgtttgtacctactcggtaccccacatatttgataactggtaaccaacagcctgctaccaacataacaccagttcaaccgacggcaccagttttggcttctgcaccagccgcaccgtcgtcagcaccaaggcaaacaaccaatcctcgattgttgaccagagaacagccacagcatgttggacaaaatatcaatcggttgacccacgagcaggttgctgcgatgtttctaccaaacccactggtggccaacccagcacagtcaatgccgattcagcaaacaccaccaagacagcagacggttctgccgattcaacagcagaatttgcagcatacatcggctgggctaggaacacctgacaatcggtagaggcaacatgttgtgaatcaagttatccctgaacacttggtccataatgttcaacaggatcaatcggtgttgccccaagttattcctgagcatttagtgcataatattcagccgaatttccagaattattatggaggtaatttgagctatcagtaccagcctccattgcctcatgttcagtatcagcaaagaggatcacctcagccccaatttgctcctcaatttaatcagttcgagccgattccacagcagatgcaaggagtaccccagcagagaccttgggccgacatgattgcagatgtgatgaggaagcagtttgggctcaagccaaaggactatggaaacctgtatcagcatccataccctgagtggtttgaaagggttccattgcctggctgatacaaggtaccagacttctcaaaattttcagggcaaaacaatgtttcaacttatgaacatgtcagccgattcttggttcaatgtggcgaggcatcggctattgacgccttgagagttaggttgtttcctttatctttgtccggatcggcgtttacatggttttcttctctaccatataactctgtcaatagttgggccgatttggagaaacagtttcacagctatttttacagtgaaattcatgaaatgaagctatcggacttgacggcaattaggcaaaagcatgatgagtctgtgcagcattacattcagagggtcaaggagatgaaggataatgc

SEQ ID NO: 21681 - DNA, 2275 bp, Oryza sativa
  unsure (1)..(2275): unsure at all n locations
aggcttttcaaggtttatnagctnccatcaagaagaaattttcatctcaggagtttgagagcttatcacatcttgcacagaaggtgactttacatgagcaaagatttgccgaagccaagaagaatttcaagaaaatcaatcatgtctatcctcacatgtatgattttgatgaagaaaatgattccgaagtagcagcagccgagtgggttagaagcaagaaggttgtgccatgccaatgggtgaggagttctggaaaagaagaaagaattgactttgatatcaccaaggctgacaagattttcgatctgttgcttcgggagaaacagattcaacttcctgatggtcatataatcccatcaaccgaagagctaggcgaaaggaggtattgcaaatggcataactctggttctcattctacaaatgactgcaaagttttcagacagcaaatccaggtagctattgaagggggaaagatcaaatttgatgactcaaagaagccgatgaaggttgatggtaatcctttctctgttaacatggtacatacatctggaaggacagccgatggggggaagaattgaaactttcagataaattcggctagaattatcaccaagtaccaaagaaagtatatcaagtagcaggaaaggtattatgaagaagatgatggtggttttgatcctcattgggactgtgagtttttcagattctgctggaatgaaggtatgaggctgccatcgatcgagaattgtcctggatgcagtgacactgcagggagttcaagccgatcctgtaatagaggtaatcggctgattcaaaagaggatacctgttcatcagagattgggacatgtaaatcaagattatcaccatgatgaagatgaagataggaaaacccaatggtgtctacaggcattttcaccaagaatcaaaaaagaatggttcaaagaataaggaacatggagcgctttcaagaagtagaacaagaaatcaatcatcggctgaggaaaacaaagaccaagcaggtgtggcgtgttaagagctcggtcacaacagccgatgaagttgaagctgataaagccaaaagggttgctcaagggcaaggctactgcgtctgcatcggtgaatatggtttttatgctagcagcagagtttaaagctaggctagccgatgttgatgatgttgatgaagcctctgcttgattggttttgtcaccggagcaggcgatttttgagaagccagaggggacaaaaaatcggcatctcaagccgttgtatatcaatagatttgttaatgggaagccgatgtcaaagatgatgtttgatggaggagctgctgtgaatttgatgccatatgctacattcagaaagctgggcagaagcgcagatgatctcatcaagatgaacatggttctcaagaattttggtggcaatccatcggagactaagggagttttgaacgtggaactgacagtcggcaacaaaattgtgcccacaacattttttgtcatcgatgggaagggttcctatagcctgttgctcggaagagattggattcatgccaattgttgtattccttcaaccatgcatcaatgcttgattaaatggcaaggtgacaagattgagattgtgctagccgataggtcagttaatgttgctagtgccgatttagctctttggaagatggatggtattgattgcctatttggaaaagtttgggatgaagattttctaaaagtgtccaattgtgatatacagccaattgaagatggagagtccagattattattttgagggcgtcgtggagggttcaaacgtctacaccaaggatacagtagatgatctcgatgacaagcaaggaaagggtttcatgtcggctgatgatttggaggaaattgacataggtttaggagatagaccaaggccaacattcatcagtaagaacttatccccagaattcagaaccaagttgatagagcttctaaaagaatacagagattgctttgcttaggagtattatgagatgctaggactcagccgatcgattgttgaacatcggcttcctattaaactaggggttaggccatactagcagccaccaaggagatgtaaagccgatatgcttaatgttgtcaaggctgaggttgcatgtttatatggggatcctctagagtcgncgtgcnggctgacanggagagtgattctacccttnnnnnnnnnnggggggggtgggaggaggggcagaagggaaagcnaagaagtgttaccaacgcgatcat

SEQ ID NO: 21682 - DNA, 743 bp, Oryza sativa
  unsure (1)..(743): unsure at all n locations
cgaggattaataacccatnctagcattcctgcaggtcgactctagataattgcactactgcccctgacatggggccgcgggtatcatgactagaggcttgggtagccaccaacacttatttggcctgaccccctcgggggggggcgggcccgaagatgatgtagccacccctccctctgtctccccgaggggganaannntntnnncccttgctcgaatgaaaaaactttcacaaaaatgtaaaaataaacaatccaaactcacaattggtcgcaaggaagaacggccggttgaacataccccggaaacacctgcctaaagtccgacctgtttaataaaaccctgcgggcaggaaggctaaacgaaaatgtcgaacaccatcgctaggatggagagccagaaagcctggtccctgcccacaaagacaaaagtcctatcgggaactctcgcaacgaacggcgtcttttgtgtaccggttccagattaaccccccccgaaaagagacgggcaaaaatcaacacgaaagcccggttaaccccgtcctcacctggacgggagcgtaacgaccctgcaataaacatgatcggaattaaacatgttatgtgaagaaaaaaaaaaagacgactgataaacttgtaaccaaccaaagttgccctaacccaaattcgacaccagtaaagtcccatctggggaaccttccttggcaatggaccctttgaacaaaccctaaggggccctttccc

SEQ ID NO: 21683 - DNA, 740 bp, Oryza sativa
  unsure (1)..(740): unsure at all n locations
gcggacgaaagatgctgaacaagagggcgcacagcggcgggcggccggcgggcaaaagcaatttacccgcccgtcctagaagctgcaaaaacacaccatcgcggatctgcaggggcgctatactctcgtcccccggaggaggtagagcccctcctctttgacagaagagataggccccgacatttttgggaacgctgtctcctgtatatatcgccccgcccgacaggcgggcctctggggcgggcggactgtgaagtacgccggcaatcaggggggcctcgcccagcgcctttcggagatgcccgggacctctccaacggctccccgaggagctcaaggggacgattaagtcatcctcaagggacttcgcccgagaacgcgtggagctcgtactggcgagctaccaggccagggaccccgacttctctccctggacggtgctggatgagttccctcccgggacaaagaacgggggccgccccaaggtcgggaatgccccggaccatatgtccccaagtttgaggggttcggcccttaagctggggttcgccttcaactccgacgaggaggcgattgacgccggtgtgggcgacagtgcccaccaggctgtcgacccgggtgcatcggagtgagcccccaggcccccgccaatcttcagttttttcttcttttctttcttnnnnnnnnnnnnnnnnnnnnnnnnnnnnnnnnnnnnnnnnnnnnnnaatgtattacagcct

SEQ ID NO: 21684 - DNA, 723 bp, Oryza sativa
  unsure (1)..(723): unsure at all n locations
cgtgtcccttgatgattcnnnnnnnnnnnnnnnnnnnnnnnnnnnnnnnnnnnnnnnnnaccataagttgtttgagtcattcatcatctattcttttactcattcatcatgtgatacgtctgacgatcaaaaatcacccaagcatgagatccttaattacccagtacgagatcatgcacgcggggtcaccggccaaaaattacgcatgccagcaaatcagtcgccgcccattttccttcacacgccttcctctgcaaccttccactgagttcgcctagttcgccgctcgccatggccttcctaggccactcccatcggcctcccgtctctttgcaccctctcccacctttgccgccaccgacgccgccgtgcgagggtgagggtgagggtgagttcgaggtcaggtcataatggcccctagcccgaggccatatgctgtcatgtctgccgttgcttccgacgtactccctccgtccaaaaaaagacaaaccctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21685 - DNA, 723 bp, Oryza sativa
  unsure (1)..(723): unsure at all n locations
gtnnnnnnnnnnnnnnnnnnnnnnnnnnnnnnnnnnnnnnnnnnnnnnnnnnnnnnnnacttcttagaagtcaaaatcctaatactgttaaaacaatcaacaaaagagttgaaacatgcctgtactcctggcctgcttgtgctgagatctttcaaactagaacaatccttctcctgcatacaaaggttgtcatgattaaatggtaaatactaaaatctaaaacactggacatctgcatgcagataattgtggagaccaatcatagttgcataatcacaacaaatacaagtaatgcaagattctcataaatcagaatattaaggttttcagtgaacttacttagctcatctaatgaaatgctagcagcactctcgccagatttaatcagccgaatcttacctgtacatataaatatttttccaaggataagcttttacaacaacaaagacaatcaaaataaataagtacaaaagaatagctatcaacattactcaaatgcagtataattaaacaaagcagcaggcttctgtgtccagtttggtaacagagttatggagttaccccgagaaaattgttcaaacttcaaacgttatttattcttgctataaaatattactaccacaaagtttctagtggaatggcagatcaacataccatcgcgtcgaagacaaatctctggtatattnntcacttgatcattaatgctgncattgtatactctgg

SEQ ID NO: 21686 - DNA, 745 bp, Oryza sativa
  unsure (1)..(745): unsure at all n locations
cgcgttccttgtaatacatcnnnnnnnnnnnnnnnnnnnnnnnnnnnnnnnnnnnnnnnnnatcattctttcagcaatatctgccctttgggataccaattgtttaagcagttgtccacgattcagaatgaagaacttttgtcttagctttattttcctcctgtgctttatccgtctggtaaggaacattgcaatgagaacaatgcaaataaagcctgttgcgctaccaactcctataccaatgcttaaacctgaaagtatatatatatatagatatttgtttaccacttttaataaaaaaaagtttcccatgaaaatagtttgttacttccccaaacatgacttgtgcaaaaatatttttcaaaaaagctagtgaatattatatatatacctatggttggagtgcagggtatgatcttgggatctttgctctgagttccagatgggcacgaacacgcatagtttccaatcttgttacgacagttacctttgcaaggatacaaccatggataatcgcactcattgatgtctgtccatcaaacgatgttgggccagggaattaaaaagaagtggtgtcaatttgtatgtttctagttgcaagaaaagggggcatggaaatttttggagagcattctcactttggcagcctccatgtaggtagggatttccttcataaccttgagagcagttgcaaaggtaccctgagcggctaggtctgtcgatgcaaagagcttgttcctaagcc

SEQ ID NO: 21687 - DNA, 1066 bp, Oryza sativa
  unsure (1)..(1066): unsure at all n locations
ccctgttccaataaatatttttaaagaaacaaaaagtcaaagttgtattttggagaccgtgtcgctgtccaaaacgacttctttcatgagtacggagagagtatagagtaaattatatgtactgtactgcacttaagggtgcaaataggatgggtcgtggctatccgcgctgcgtgtcggttccaccggtcatttttggatttgtcctaagtcaaacgcacgttgctcttttaaatttgatcaagttcgtaaaaaaaaacataatgtctatgacacaaaattagttttattaaatggaccattaacatatttccgtagtatactaatttgttttggtatacaccggttttaaatgcgtcggtcaagcacaaggaaatttgacttggaacaaacccaaggtgatagcacattagttgttgctcgccagaccacactcctgcccgcgtatatatcaaataatattggggtttgggtaaacccatgaacctgcccaacaatttctgtactatctcttgagctttaagcctccaccacatagcataaactaaagctatatatgaatgtgagaaattaacttttagattaactattcataaagagagaaatcagaagatgaacagccatgccattcctgattcggatttcatcagatgacagccagaggggtcaaggaactgcagctttgtaaggttgttaagttgaggaagcaccgtgcctgccaacgaatattttgtgataataaattttaaagtaaagaataagagggtattgatgctaatagcacaaaaagtttcttataaacaccaggtgcttcaattgcatccagtttgaagaatttggctgaacataagtacgtgctagccagatctctcacgagtcacaacagtgatatgcaaagtcaaattgatgtgtatacagtggctagtagcttcagtttcgcagcagtgacatgaaccgagtttaaaactataatatactcttagtcataacaacagcattggataattctgccatgttatgagccggctgatagtgaggcatgaaacatataattggtaccaggctn

SEQ ID NO: 21688 - DNA, 754 bp, Oryza sativa
  unsure (1)..(754): unsure at all n locations
ggggtaattgattatccnattgatactcaacttgcatgcctgcaggtctacttgttagatcccccgaacaaaaaggatcaagacaagacataatttctctaccttggtgncagnttctctttatatttcatgaagcctgtcggctttcgtggggctttcttctggttcatgcaactcggaattgcttacaaaaatagaacttttaaagcaatcacccctatcgacagaatgagcacaatctgcatgacaatgtccatgcatgttctctgcgcaatcatgaccatccatatctacatgctgactcatgtcgaaaggaggctcaaatgcctgcagtaatataccttttaaggatagcatcatgtacattaaagttttcacctaacgtacaatcttcccaccccgacaacccaaaccacatatacacaataacacaaacatacctcaagcatgtccatgatgaatgatgcattcatggatatacacctgtgaagtaataaacaatcacaaaacaataataaattccttcacagtaagcaaaaagagcggccataactagtttaaacaacatgcattgatttttcagaaaaattcggccgtgaatttaagaattatacattttttcctgaacttaaaaattgtcacctaaattaataacctccagtcgccttcgttataaccaaaacccttctataagaatcccaatccttaccaattacattctactgtgtaaacctggtctttctaaatatctaaa

SEQ ID NO: 21689 - DNA, 1316 bp, Oryza sativa
  unsure (1)..(1316): unsure at all n locations
tttcgatcaaaggagagntattgagttcgacttgtattatatataataactcttcgtaattgatgcgtcgtnatgtaacgtaggtggtagtatatttttaaacttactatannccccncccnccccccagtgcggccctttgangtggcgtgccgtactcactataggcgaattcgagctcggtaccgtcagatctataattcacctggcggattcaaatccccaaataggagtagggtattacctctcattgagagggccacctgtctaaatcctttgtctctgcatccatccacttttaggtctcgtgcgctaccccttttattattgcggaattcatgtttcgacaggcaccttcccttttaatggcattccggagaagttaagatataccaggttcctgagatagctgacgaaccctgggaatcggccggctggacccacgagattgttgttgctgaggtcaaggtgctctagctgttcgagagcgagcagagaagtacttatgtgccccaccaaagctgttgcttcgttgtaccacgagaagttattttgaaggtgaaggccgaagacatgaccgatgaggttgtcgctgcacctaacgcctctccaccggcagcagtcatggttacctcgcttccacgaggcgaggcgacctgcgggatcgccggtgatgcctcgcttgaaggccagcagggcctccctctcccgcggcacgcagctgccggcggctggagccggcgcatggtttgccgtggacgtcgtggcggttgccccgaccaggaggaggaagagcagcggtaacttggctgccggatgcatgatgcgatcgaatgcgtgaatggctggaagcaattgagtgcagtatttaatgtgagaccgggcccttccattttctgagtaagattcatatttttatctttattttcgttagaatactttacaaactattaaacgatgtctcccgtaaagaaatttatatataagtttctttaaaatattaaatacaattatcaagtttataataattaaaacttaattaattaatgtgctaatgatttttctcgttatcggtttaattatcaaatagtcccaacgcatagtatatgtaccgtgactgatacgacgacaactcagggattgcaatttcggaaatttcggacccccactactacagcaaatattttcatggacgctggaccgtttagttttcaagcgggtcgtaagtgaaatcgcaaggaaaaatagggggaccggagccgggccatcgcccgtataggaaaacagggtacgagtcgaatgcaatcaatnacagg

SEQ ID NO: 21690 - DNA, 766 bp, Oryza sativa
  unsure (1)..(766): unsure at all n locations
gtgtatgattgctaactggttgcacgcagcncgactntataagatcccccaccccgggagaggtggagaggggagagtaaataggaaagaggcggcctgacaagaatcagcgcgtggggatgaaaagtcgagaaaagcggggtggggattagattgaggaggaaggcgtggggtaccagcactgtggggtgggtgacctagagatgaatttttggccaaaatccttgttggaatgggctggaggcacgccaagcatgtcttgcactgctactggcctaataactgttgtcttggctggcgatgggatggcttcgaggggaaagaagtgggcatggtggcataggggcggcgacagtggcatgagctcggctcacactttccgcgaggacgcgtgactgcgggagctggagcacgaaaacgcgaggcggttcaccgagtgcatcggcgttggtgcggcacggacaatagggaaaaagacagggctagggcgaggtgtcgtgcggctacagtttgggcggcatcggagtggggccagcgtgatgatgccagccacatcagccaacatgagtggtgtactggaaggcgagaaagtcgttttttggggccggcaagtggaggtgtgtccgaattttctcgtggaccggtatcattaatgcaacacatctcgcacaggataataatttgtgtccctttaaaacgccaattggtgcgtttttcccccccctaaatttttctaaaaaaagtgggggatatttaaaatcttctt

SEQ ID NO: 21691 - DNA, 774 bp, Oryza sativa
  unsure (1)..(774): unsure at all n locations
gcgtgttgattgcncatttgaatcgnngcnngcccgcaggtcgactctagaggatccccaataacacacatacagtctactgctccctccgttacagattataagtcattttaactttgatcaaagttaaattgtttcaagtttgaccaacttaatttatagaaaaaatagtaacattttcaacccaaaataaatttattataaaaatatatttaattattgatttaataaaactaatttgctaatataaatatattatatttgcgtataaatttggttaaacttgaagcagtttgactttgaccaaaatcaaattaaacaacttataacctgaaatagaggcaacaagcaagatgatatcattttggtagctcagagactagctacctgatgtccttcttgacctgttcgacctgctccttcttggtgcccttgatgacattgttggcgcgggagccctggttggcggcgatgaagtcagggttgtagacgccggggaggggcaccatggactccatgtgatgccggagctgcttctgcaggtcgatgtccagcacccgagccctggtcatggcgtcggccaggttcatgctgctgatgtcccacccaccgaacacgatgtcgtttgggttaccttcaaaaaccgaatcaaattaattatcatcatcagtgtctgcctgtctcaaagtattacgattcatcaattctggtatgtttgtatctcaaattgacataantagttagtgtcagaaatattacgattctttattgtat

SEQ ID NO: 21692 - DNA, 5785 bp, Oryza sativa
  unsure (1)..(5785): unsure at all n locations
ntatgagtgaaaatagaatatgaagaaaaaaacttggtgtcaatgaattaagaaaagcgtgagaaatacgactgtatatttaaaaataaatattttgaaatacagtacacttaataaactacgtataagacccgatcgcttacaggaaaataggttggattgttcgcatacgcaaatccatatatatatgggtgcatcgtataataatcagaatgtttttacattgtcaaaaaccataaatagagtcgttttttatatatcttttcatgatagaaaatgtagataaaggggaaattttatgatatgatctgagtggtagaaggttaatttgagaagatggggtcaccatgggtacaaggctcttaaaaggcgcatagatctcctccccgttgtagctcccaaccctgatggtggatgattgtgtcagggaaccaaagtagttggccttgtgcaccttctccttggtcgcccatgaaattcccctgaaatattttttgaaattagaacaattaattaaccatgtgggataaatgaggaattcagttgcacactatatcatttttaatttggcaatcaggatccatggagacgatttttttaaataaataaataaataaatgatgagttcatatagttatgcactaattgcaaactacatcagggtttaaattttcggtttggccgattcaatcagaggtcactgatataccgaaattttgaacaaatgttggtcaaattagaacaaaatattactgaattcacaaaaaaaagtgaaaaaaaaaataaaacttcagccaaaattttttcgtatctagagagtccaaaatgaccgaaattcattccggaattttgaaccctgcactacatatagtaggagtatcactgtttggcagtccaaagcaggcaggcaggcatgcatttttggataaatgaggaataattcatattctgccacactacatatcattcttggcattcaaaaaagacaggacgcattgcatgcattattttggataaaccataatccaatgcaactgcaccatatcatttcttgacaagtgaggaattcaataatgatgcaatgaactcatgcatttttgtggatgaactagaatccaattacaacatctggataaacgagcaattcaacataacgttataattaagattttatctaattaattaattaattactctctgttggcgatgacaccagccgtgagcgtggtgccgttgttgcctccccatccaaccagcatcaccctgcatttcatccattgcatacataaacaactccaaaagttaatcaaatcgaacacaattaagtaattaagtgaaaaacaaacaggtactactacccaatttcaaaattcctctccatcgatcgtctcatctcatcaacaagatgagaagaaagatgagcagctagcatttcgtgtttaatatacatgcgtagtacccgagcttggggacggtggtggtggtcttgaagtggtaggtgacggacttggggcggacgacccacccctttttcggcgacggcggcgccaccacctccgtcgtgtcatatcggtactccgactcgatctccccgtcgccgaccgcacgcgcgggctctccaccctgaagccctccacgaacatactcctcctcctcctccggctccgatcagatcacccgcgagttcagccagcggcggcggatgggtgtttggatgggtcgcggaagaggcccaaggcgccggctttatatagcgttcccggacgtacacgtggcgcgttgacggtggtggaagctggtgccatgcgatgcgagggagtagatgacgaatttgcggagattctaagggtggatatggaaaatggcagtgccgcagcgagagggatcaccgctctctatccatagaccaattcttgggcggtctacaccacgccgcgggcccgtcagttgcggggcgtcgcgggggtttctccgtacacccggcgtatgcaccccgtgaaatataggtgtgtttggttgcctgcatctgcatgaggcttggcccgtatctgtggatgcaattttcggttgtctggatggccttcccatgcaaaaagagctcctcagccaggctgagcagaaacgctcaaatcgagcttcacaactcggcctggccaggagcgtgcgagcaaaaacgagggtttggtgaggctcagccctggcctgcgccgccgccgccatcttcctcgcatgccactaccgccctccttcttcaactccgacgaactgcatatgcatggcggccatgaggtgcagcaaacaacagggcaacaggaagacgagaggcgatgagtgattgcctctctttcttccacggctgcaagaggcggcagtgagctcgctggccccagatccgccggccacgaggagcagataggggcagcgagcggcgggggtggaggaccagaccagcggcgagctttcttccccgaggaaccgattgaatgcatcgaggattttcttttttttttttcatttctttctccatcgacagtattaagcactgtgataagcaccacaagaggcgacgaatgcatcgaggaattattttattccttcctccattggttagacagtaataagcactatgatttttattgtgcatttgctccgtgataaatttctttaaaaattatcatacgaatttagtgcactggcggaattcggaatttcgcgaaatccggtgaaaaactggtaaattccgaacaaatttcataaaccaaaatttgaatacaaattccctaagtttgtcaacaagttctcgaaaaccggtcggttttggcgaaattccgatcgaaacagtaatttgttttcctttttttaattctttattcttttatttcctgatgtaagtttcagtaaatacacacaatacataatgtttttcgaaaatttatatcctaataagttctatgaatatcatagtatttataagattttattttatttttttatcaattcaaatttcaatttggatgaaacttctcgaaatctcagacggtttctacttttgagcctcgtcgaaacgtcgaaatttcgtgaaatccggttggatttcgtcggaatcgtaaaccctgctggaaatagtgagttcgtaggaatctcaccctcaaaaaaaaataattcatcattcatacaaccaaccaaacaaaatctcttttgaatcgtatctccaggacagtcaaccaaacaacatcttatactagcctggttaaaccaatgcaaactaggggtgaaaacgatacggaaacttttcggattccgggcctgttttcgaaaacggaatcagccggtcggaatttctcggaaacggaatcgaaaacgaaaatatttcctcagaaacagaatcaaatatgatattagcggtttccgttggaactcggaatcggtacgaaaaattccaaaatttttttcggaattccgaagttaaaaaggcacatagaatcaatagtccataagtcgtccccaagttcccaacccaacccaaatcgtggctagccctagagcgagacagatagatcgtggcacaacatcacgcaactgcgagccggcggcggagcaacgcatccaaatcgcggcatcacgcatccccgcgcggctgttgacggtcgttatcgaccaatttcgatcgtcaatattacccaatatatgaagactagctatgcttgcaatgcataattcccaaataaaatattctattccactatgtgcttggcgaactaacatgtacgcaggagaagcacgcatgagtggaggagaatcgacagaaaatagacaaacgatcaatcagatactgtgaggatcagacttatggatagatgggctgagaactcagaaaagacatgatcaattaagcccaaaattccatgttttggaatgcggagcaaacgaggagtcggcctgccagaaccctctagtttggccaaacccccatcacagccgtttaggctggggtttggcatggacgctctggatgaactcctgatggcagttgcggagcatttccgacaattctcatgctctacaaccgtcatacctgcctatttaaggaggtctcatcctcacttcacaacacacacaagcaaggattgaagctccatttctccaaagttagaattagtatagtgctagtggaataggaatagaatagttcagagtccgtggaagcttcggagagttcggtaaagttcttagcttttccttttctcttttctaagacttccttttcggtaatataatattcttctttttatacaagtttagtactttattccaattatagaatatgagtgctatgcttagtctatttatatttagtataatctcattggttaaaccttctgggatctgtattgatgctggtataatgtttgtttaccgggccatacgtcagcccaggctaagccgagggctatggttccggaacacaaatgctctgcaccgattgcaaggctgcagagtaataagtagtagcttaagcatggggtttaggctaagacttatcgtaattttggagtatattcgcgggagagcacgggccccctgatggtgacagctcagtatgggaatcttcccgcagtttatattcctacatacaatttcctggggttggatactcccccgtatacttcttcagttgaatggttatgacaggttgtcgtaagaaactcgccaacccgggggtacctttgcgatgcatcgggagggcacagtttagtctcggctcagctgtgctgcattgttaaaggggttataccccagaagagtatactaattatgatagactaggtacttgtatactagaagtacaggaatagaatatttctatacttttccacttagccataattagaagatgtaggagttagctaaatcttaagctgtgtgtcaacctaccatttgaactgaattaaccaatgcatagactttaatgtgtataagtaatatatgaattgttagcatagttctctcttatcaatatcttccctgggaataaaataaatacgataccttagaatactctcgggtgaaatgctacaatggtatatccgcgcgcttgcggattacatctgtgaccataatataccagggttatttctagtgctattgctgggaattaaatttccagtagtgtcgctaagaaataccaacagcggccgcgcccaccacccgcgccaccactggtccatcatcctcgccaccgctggtccgccgttccaccgctcacgccatctcgcgccgccacccttcctctctcgtagagtcgcaatcgcaccatcctcgcccccaccatctcgcgccgccctcgcttttcgccgtctcacaccgccggctcggtcccgccatctcgcggcgccgtcccaccgtttcgccgccaccaccaccactgacgacgacgccacaggcccacagccacaccgacgaggcgactcttactcactgtcacgcccagaaattcccgaatagaattccaagcagaatgtgcattaaaacccctgtccaggactggccagggtacacaaacgacaaagttgacatacaggtccacgtcttacaaacacactaaaaatcgtacataaatgcagtggaaattaaaggataatctaaagctaggtcttgacttggatagcagcgggtgacaccattccacaggcatcctcgacagcacggatgaagcctactcctccgagtagccaccatctgacgcatactcaaactctgggggttgggagatagagcaagactt

SEQ ID NO: 21693 - DNA, 772 bp, Oryza sativa
  unsure (1)..(772): unsure at all n locations
gtgtcttgattgcatgacaaacccaangngaccgcccgcangtcgactctagaggatccccccgcctctgcctccgtctggctagacagtcattgaggctgccgctgccgcccttgccctggcccggaccgccattgcaccaagtcaggctcccgcgtgaccgtctcctcgaacgcctcctctaggacaccgacagccagcccgcatcaactcctccccacacctcctttgccccgctgcctccctccatcgctgcgccgaccactgtccaccgccctctatctcgacctcgctggaataaaagaaggggatcgagagagagacaaggactcaaggagagatcgagaaggagaggagagaagagaacaaaagggaaagaggagaggaataggacattgacaggtggcatcccgttggccccataatcttgcttaatcttgcacaataattacctccctttttcttaattaatcttgcacaataattacctccctaatccctctctattgtatcactgacaagtgggctccaccatggttaatttctgtttaaactctcttaatctttgagtcacttacaagtgggaccccaccttatccacccggtcgacacgcacccagtcaccgactgccaaatccgacgctcactggcaggcggccatggaccggttccaccaccgncacctaaccgttccgnacgccgggttccaccacaaccgacctctccaacttgtgaaagcgggccccgcaaggaatattcctttccaaataaa

SEQ ID NO: 21694 - DNA, 2135 bp, Oryza sativa
  unsure (1)..(2135): unsure at all n locations
tggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttcttccgccagggtgtagtacgctgcacatgcgaatagtttttctcttagagattgatttttaaaaaaaatctccctcgttgcaaaatatagtaatttaaaagattttaaaatttatctaaaacataacaacttttccaccaacaaacgcttcttaaccaatcataacctttttcatgtttaatttcttcgtcttctctttttttccttggtcaatcacaaactcgcttcatttaattacacatactctcttaatatttaatatcgtgtatccagactcaaagtttattatattttaaacaaagcgatacctttcatatctacgtaacacactaaaaacctaaagcttaagatgcaagcataacaattattaattactccctctgtttcgggttataagacgttttgactttggtcaaagtcaaattgctttaagttcgatcaagtttataaaaaaattagtaactttttgaacccaatacaaatttattatgaaaatatattcaattattagtatgatgaaactaacttagtattataaaaattgttatatttatctataaacttagtcaaacttagaacagtttggctttaaccaaagtcaaaacatgttataacctaaaacggagtaagaagcatgcaaggaagtcaaacgcaccaaacactaaaacataaatataactacatacatcatctacatattattacattttaaagctcagtatatgaacatgttaaatcgttatttctcatgtcattctcacaatatttttatccaaattcattcatcatttctacgtatcagcgccggactgactatatatatgtctacctgacaaaattaagaagctcacgcagccaatagaatttgcccgcgccgctgaatccacacccctggatcggaactaatccgtatacgttatccaatctgacgattatctgaagatcgatgcgatatccgttcgatgagcatccgacggccaccggcggagtttgacgggtcaaaccaaatggcatccggccagccgcaccatcgatcggacggctgcggtcaaacgtcaaagcagcttcattattaagcgtgcaggacgccaacaacgtcgcacgtaggcatcaagctattcaactctggatgtccacatttttattctaagcacgcacgtctatccattaattacgcagttcgtacacgcacatgcatcgatcgctgcactacgttgtgtatatatatacattggcaagctgagctaagatagtcatcaagagctgaaaaatcttcgtcttcatcatgcgccattttgagctcctcctcttcctcctcctctgctcgccgtgcctcttctcagtctccgatgggaggacggtgcggcccgcgaaacggggcgccccgtcgccccccattcgggcggtgaacctcggaggttggctcgtcacggagggctggatccttccctccctcttcgacgacattccaaacaaagacctcctggtaagtacatttggatgattaaaaacttcaaaaatcttatcaaatcttattctaaacatcaaacatttatgatcagagaacacgcttttctatgcattttaggatggaacccagctgcaattcaagtcggtgacgcagaacatgtacctgcgcgccgagcagggcggcggcaccatcctggtggcgaaccggacgagcgcctcggggtgggagaccttcaagctgtggaggatcgacgaggggatcctctagagtcgacctgcgggcgtgctagatgagttgttctaccngacgcg

SEQ ID NO: 21695 - DNA, 3135 bp, Oryza sativa
  unsure (1)..(3135): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcataatagtactccaatggcaacaagtagctatagttaagttagtagtggagtaggttgggatacatacatacatgggctgatgatagctgccaacaggcgagaatggtccatatgcatgttggcttgtattgtctttgaacaatattggtgacaacgcaaaatgtggccagcgcatttcatgcagatcaataaagatcaagctagctggaggatcaaataatgtagtgctaaaagatagttaattagtacttagtaataataagtgataaagttagggatggcatgtttaaagttaaagcctgttatgagcccttaaactatgcaagactgtcatcccatgtgacagttgagacaacaaaacctctaaccattaattttatttatctttatttccttctttccatccttatgcagctaagttttaactttaaaaaaattaagagtcgttgttaatcgtagcaacgatgttttatctcctatttctttcttttttttcagcactaattagtatagctaagagtgttattataataactgttctacatgtcctaagtgataaaatgagaaacatagttagtaatattaagtgataataaagctagctatagggcgaattaatctactttagcatgatggtgacggcttcctgctttttttttagcaaagagaagtgagccaatgttcctttggactatctttacatgggtcaaagggattcaacgtagacaaaataaactcgagcttactaaatcaaagagtcaaagtgttcggcagtcaaattttatacggctaaaattaattgtttttttcttgcccgctaagcttgaccaatactatatatattagcttgaaacatttttcggtttttgttgactaattacatatttagtctaacctgagaaggtatatttaagagtagaaggttagttagtcaatttgcttctttactggttaacttatgtcaagtgtaaaggtagaacccgataaaaactcttaaacaatacacattaaatgattgtacttacaacggtcataacaattaataaagactgaccattaatataatataaaactattactgttctgttctttttccaaccatcatgtagcaacaatatttatctatccactcattttctctcttttgtatcagcaaatattcttaactagtaagattaaaagccatatgcctttgtagtggtaggttaagggttccacttgagtcctagttttgaggattaatttaggttttttaatcccttacaaaccatagccactcgttttctttgcttggatgcatagcataggtggaatacaatatatctcttgtagctgaatttaaatagaaacgaaatattgctaattaaattcagcaagtcaaaataaatttttagtatgccttgctaaatttattctaatccttaccaagattatttcttttggtttgatgcaaaatctgaatcctttttctcttgtgatgatgctaggcgaagacaagcgactcagttacagcagattatgatggggagacaaattggggcgacgatgacccctctgtgtttgtggtcactagggtaggcggtctacaaggggagtaccaaatatgcaatggatatggtaaagcaaaggccacacaagtgctcagggtaagacacatgttaaactcatttcagctccacttgttacttggacgtatgatacaaaacgtacaattaaagatatatagtcttgaatggggtaaatatctgaacactcgaaatatagtaaaaggaatatgcaaattgcagaaccaattacttgactacttcctccatatcccaaaataaattagcctagtacgaaatgcatcatattctaatatactaagttggttatgacacatatttcccaaacaaaattagcctagtacgaaatgcctgtttggaggagcttaagattctgagaagcagctgctgagaagctagctggtgagaatctggagaagctggaaaatccagcttctggcttctagttcatttccagattctacaactacagattctcagaatctagacaaaaagctagactgtttggggggagcttctcgaagctgcagctgctagaagctcctccaaacaagccctaagttggagtattactaggatatatcacatccgtactagttttatttttttaagaatggagggagtatatatatggcaaaagagaagaaacatgaggatagctctgttttcatatatgtgctattgttatactccgtctgattttaaatttatattgttgctgatttttagacataacgtttgactatttattttattaaaaaacttagtgtaaatataaataatttatacttaaaatatctttagtgataaaataaatcacaagaatcaaacataattaacgtgtaaagttaatagtattgtatatttaaatatagaggaaatattaatgtaaatatccttatgatcgaagtaaaatatgtttgacttggttaaccacaaaccagtaagattgaacataaaaaaaagactaattgaccaacttgaattaatctttagtataccaacttttcagctgttcaattcccagaaagtgatatttatattggcttccatagtccaatgggaaatgactgtggtaccagctcgaagtcaagacaaacg

SEQ ID NO: 21696 - DNA, 14766 bp, Oryza sativa
  unsure (1)..(14766): unsure at all n locations
tatgtttgactattcgtcttattaaaaaattttatgccaatgtgtaagaaataaatcacacttaaagtactatgaatgataaaacaactcataacaaaataaattataattacgtaaattttttgaataagacgaagggtcaaacatgtgagaaaaagtcaacggcgtcatctattaaaaaacggaggtagtactagtcaacaaatgacagccaggatatatatatagataagcacacagaaatccttgcattttgatgagaattacctacatatctcgtgatattgatgcaaattttttttataacaggcagattgccacctctttttaattattgcacatgtacaaattataagtatatatcctatttttttgtgttttgcaggaacactggcgcacatacatagttgagagcgacttcaagttcatatcaacaagtgggctaaacgcagtgagaattccagttggatggtggattgctagcgaccccaatcctcctgctcctttcgttggaggatccctccaagccttggataatgcattcaaatgggcagagtaagtgtataattgttccatatttagtcaaaattaaaagcatatgctcattttttttaatttccagcataagtcaagtatgattaaattctctgtctccaacaattttgattttgggggaagaataaattggtttggaatcaggacaatgagcagtcccttgatagatggttgtactttacaaatgacagagattttctatgcatgtgtcctccgtatgtacattgcaggaagtataatttgggagtcattgtggacctgcacgctgcacctgggtcgcagaacccgtttgagcacagtgcctccagagatggttcacaggactggggcaccacggatgccaacatcgcccaaactgtccaagtcatcgatttcctcacacacaggtcacaattttaattattccacatagatatttcaattcactacacaaaataggtttaatttgtcttgtctagtttatccattatctcttcggaagtaaaatacgaggaatttccattaatcatgaatggtttgtcctaatttaatttacttattgtaaaataaacagtaaattttagtaagctataagtttttttttcaaaactattagtttgctgcaatttttgcttgtcattccaaataactgcaagtgattgtaagtctataataatagtatactccctccgtttctaaatatttgacgccgttaacttttttaaatacgtttgcccgttcgtcttatttaaaaattttaagtaattattaattttttttctatcatttgattcattgctaaatatacttatatgtatacatctagttttacatatttcacatatgtttctgaataagacgaacggtcaaatatgtgctaaaaaatcaacgatgtcaaatatttagaaacggagggagtatatgacaatccgaaagatggttcaaccactaggggatacagttatagttttagagcaattctacggttcttaaggagatatcatgaggtaccaaaattttcatggtacatcatcgtacctaggtaccatgaggtaccatgagataccaaatttacaatagaaaaaatggtacttacctcctcaaggaccgtaaaattgctcatagttgtatgataaacccgttgtgaaatacagcacaaaactaaagttgtagcgaaatgatagtttcattcaaataattattatagtttgctgaactttactctcaaataattaaattactctacacagatacgcgagtagccccagcctcctggccgtggagctcctgaacgagccactggcacccggggtgactctcccggctctcatgagatactacaaggacggctacaacgccgtccgcaagtacacctcgacggcgtacgtggtcatgtccaaccgcctttccgccagcaacacggagctcctcggcttcgccgccggcttccccggcgccgtcctcgacgtccactactacaaccttttcaccagcagcttcaacggcctcaccgtcgaccagaacatcgactacgtcaggaccaaccgctccgacgaactcagcaccgtcacaaggccgaatgggccgctgacgttcgtgggtaagttcatttgcaagtttctctagcgaatttaattactttcaacatggagcactcgcttcatgttgaaagtaaatgtcgttttggaggacacggtctcaaagaaataattctaatcagtattttttactacaatatatgtaaatattaacaaatatattattttattaaagtgtattttaagattaatttatatatatggtcttcatattcagaagaaaaaaatattttagaagatatttgtagtcgaaattcttgaaatttaatattggccatatccaaaatgacaattactttcaaccaacctagagagggagtgagtactgtttatacatgaagattacaagttcttgaacgtgatcgatacatatatgttgcttaattatatatgcaggagagtgggtggctgagtggaatgtgcagggagcatctaaccaggattatcagaggtttgcacaagcccagctagatgtttatggacgagctaccttcggatgggcctattggacttacaagaacgtcaacaaccactggagcatgcagtggaatatccagaatgggatcatctctctcaaaagctagaaataatgactaataattaaatatgtctctagttatcaccaattagaacacgtaaataagcctaaccaaggccaattagtgagtaattactgttgcctaataattggaaatgtgtatgtacttgcagtcatatgtaatccgtgagcaaataagacgttgcggaagcgcagataaaacgtcaggtactcaggttgagtgtaactttctcttgtgaagctgaattaaagaaataaagattcttcttcctagatgcttacattaattggaggtttagttccacaacgggaggtgttctagtattatactcggtcaaatttatttttaagagcaaatttatacagtaaaaaataattaacatctccaatactaaataaatacactatcagaacaacatgttttatagtggattttaattaacatgttttagagcaagtttaatagtatagccaactaatagctttaaatcatctatagttaatttaatagctaattcatacaacagttacatactaccctattaaatctggtctcatctatcatacacacacaatgtgtctcagagtccatactatagctggctacaaatatgtagccgactgcttttctctcccctattttatcttcttaaaatatgtgtatagctagcttataatttgctattgtacctgctcttatagtggagtagtatttacttttatatgtaactcgatcaaaactatacaagttcaacttagaatataactaaaaacgacatgtaatatggaacagaggtaacagagatagttacccgttaccacgctatgctctctgtatctctgtctagctgaaatggcgctgtgatgctccgttcccgccgcaggacagctcgccctgagtcccactactctggtggatgctcgcagcgccgagcagcctcgccatcttcgccggaaggctcgccagcgcggcggagatatcggattcctccctagccggcctcttgacgtcgccggcggccaccaccgaagccaccgccgccggtgccatcgcagaattgctctctcctgctgcaggcgcggcagcagcagcagcacccacccgccgccgatcgacgacgtcttccgctccgacgaacaccaccttgggccgcttcgggtgccgcctcgccgcgtccttccactgctccttcgccgtctcacgaactccgtcgtcaagaacaatctccctgaggcacccgagcccgagggagtcgatcctgatgcctccatggccgcaggggccatccagatccttgcagaggagatggaacgactccagattcggcagggctccctcctggatctctggctgctgcttgctcatcgtcgtcatggacaccaccacgatgtgcaggcgtcgcaggctctgcagatcgccgcgttcgatcacgaacctgtccaggtgacgcgcgatcagcttcaggtaacgcagcgcgcggacgttgctcagggccgcaagaacatcagagctgaggcgatcagaggatgagaggcacagatcagtgagaacggccagcgaggtgacgaacggtggcaacctgcatatcttgtttcctttcagcttcagggagcttaggtagcatgaatctcctaaagagaagttgagaaattcttgggagcattcgccgacatcgagagagagtgatcggacatcgttcacatctgtgcctctctggatgaactcctgaatggcctctgacaggtgaacatcagagttgctgctgctgctggcatctgcggtgttctcgcaccatattttcacctttgccaagttggtcatatgtttcatgagctgaggaaatgtttggcacctatcggtgacaaatccggccagtgtctccaacttgcttttctccgtcaggaaggatttgagcttcctcatttgctggtcagcatcttggatcttgaacactccaaacagatgaatcagacatggcagctcgagcacttgtatgggaagaaacttaatcaccgttcgccgtaaatcgagcgtctcaagaaatttcagctttgcgatctcctttggaagcactgtaattccacggccgaggcttaggtacttgagaagcaaccgcttgcatatcttcttcagatgctcgtcctccaattcatcacactcttcgagatccaaaacccggagaagtttatacctggagaaattcaggaaagacttgtgcgcttttccgaagatcgtcagagaccggacaagggacagatcaatgtctgaatccactctggtcttactaccactgttctgttgtatggaaacgcaacggatcttgtcaggcaggcgagcctgaccgtacagaaatgtgatgaagttgtcacatatggatttgtgcaggatgaactcaagcatcataccgtgagtttggcaggtcttcacctcagtgttgctgctcacatcaacaggctggatgatgctccggttaacgagctcctcgaagctgtcgatggcgacatctagagagctccggtgatggtctgctcccacgaatccttcagctgaccatctccttatcagagtttttctcctgacaggatgaccactggggaaaattcccaggtagagcaagcaggccttgatgacatggccagggaggctgctgtaatggtgaacaagcacacgcttcattcttgctaaggtgtcttctgtcacaagatgcttacccaggttgtcgcacagctttgcgcatcccagaggctgctgctgacatctgctttgcaagaattgggctgttgtgacgagagcaagcggcagaccatcacatttcttcaggattgcttctgaacctggtgggtaatctttccatgatgcttctttcaagaatagctgtcttgagtgttcctcattcagggttctcatcacgtacacatggctgttgcgagagctgcaggcatttgctatggactggatggccgtcgttacgatcacaatgctgctcagtcccgtatcagaaggaaaggcatttctgaaagagctgttccaatattccctctgcatgtcgtcaattacaacaaagaacctgaaaataagcattcagaatgggtcacttggtgcagagtcaaaggacagttttctgaaaaactacatcaataaggtgaccagatctacatgcgtgatgcatatacagggaaatcagaactgttaatgcatgcacacagcaattcatacatcttttgtttactcctattctggctttctatcacacggattaaggcgaaactgaacttgagggataccgcatacatgtgattctttctgcacttgagggctaactttttgtactcaccttactctgtatgactgaaatgtagattagtactaaaatacgttgtaccttctgatacttcgtttaagttgagtataaaacaaatcaagaaaaacaactctagtgctcctcaatccctcgtagttcttggaagcaattgctttcagaggccgcaaaaggtgtaggatgaaggacacacaacagagattgatttggtaacaaacagtaacaacagttgaacatgtcagtggttggtttcttacctcttggattcaaggcaatttctgagatttacaacgagattgctggcatggcagtgatgtaccggcatccccagctgctggagaatgtccatgaggacatcctctgcgttcttccccgcggcacgaacccaaatccgtggatggaattgcgcggcgacggcgtcgctctcgtagatttgcctggcaagaagcgtcttccctaacccaccaaacccaacaatggagatcaccttgagctggccctgggtttcccctatcagctcaagaatctcgtcccggggcccgtccatccccacgatgtcagatgcaagggtgtgcgcctcagacgacgacgccggcagggtcaacgcggatgatcctgtagccacccagcagctgggctcgccggcggcggcggcgtaactggctctgaggcgggacagctcctcggatttcctcctgagctcctggatcacggcggcgaacttggcgcgggcgcccatggaggccaggccgtggccggtggcgcggtgcacgaagcggtcgacgcagtcctccatgtcgcaggccaggtcgcgcacgccgcggatccaggcgctccgcacgtcgcctgcggcgggcggcgggcggcggtcgtgctcctcgatcgcggcggcgatcatggcgagctcgttccggatgtagtggacgtcgcgctccaggtcccgccgcaacaggtcgtgcccgtcacggaggaacgcgtagagcttcggccccagcgttctgagcacggcgctcagcaccgcggtctccatggccgccaaccacaatctgcttgcgctagcgctactggttcttccctctccactcgaattttttaggacacacaagaacgataggcagcaacgaagacctctctctaggaaaccatgcctgctagagttgactcttgacaccttaatcctaattcctaagctcgtcaacgggcaacagacagaacgctcaagtctcaacaccttggtcgtaggcaagatttttttttcttttattctcctttaaaaagtgggattggaaaaaaaaacgaattaatagaaaaacataggattttaagagaaatacaagtgcaaaatacaatgttataaaacacatgaaaaaccataggattttaaaaaaaatataaggttacagaacacaggaaaaacttatagggatggtatttaattaggcaggttggagctcatactaactatccttcaaaatctcaatacgattatccaatccataaaagtttaaatattttgtatcaaatgccttcataatatatttttctctgctggattgaaattctcaaaaattcgaatgttttgattacaaattaaataggaccctagtctcgatcccttgtttgctaggaatgcctagaatttctaaagagattcgatgggtctagattttttgtgatgatcaagggctgagatagtctcccaactcccaccccaaagcaggtattaaaaagcaaggggtcactcctcaattcccccaaccgcatctcaaaattccattccctctttataattttcccaccaaacgcaccctcgattcaggaaatcgataataataaaaggggatagcacatgagactaaaagttgatggatgtgaagacaataatttagacaggttcaagacaccaaccgtagaagcagttgtggcggccggcggcaaagataaagttatcaagcaatgacggcaaagtcgcaaaaccatggaggcgagaagaccaattgatggtggtagaggcgaccgacagtgaagacgaggttgcccatcaacggcggtggcgcagtccaccaaccgtggaggcgaggatgcaaatcaacggcagatgatcgagaggacctgaaagcgaagactccagtcagcggaggcaaaggcggccggtggtttatacgaagaagcccatcagcaacaacgtaatatgccagccgtgaaggcgaggtcactagtcggtggcggcaaaggaggcgggcggtgaagatgaagacgcatagcaacgatgaaatcatgcagccacagaggcaaaggcaccagtcagcagtggacggcagtgaagatgaagacacccatcagcgggggcataataggccaatcgtgaaggtaaagacaccagtctgcagcgacgaaggtagctggcggtgaagacaaagatgcccatcaacggcaacgtaataggccagccatgaaggtgagattactagtcggcgacagaatagggcagtagtaaaagcgaagatactagtcggcggaggcgaaggcggtcggctgtgaagacgaagacgcccatcaacggcaacttaataggccagccgtgaaggcaagatcactagtcggtggcattataagctagccatgagggcaaaacactagttggcggaggtgaagcggccggcggttaagacgaagactcccatggcggcggagtccaccaaccatggaggtgaagccacttgtcgacagcaataatgccgcaacatcacatgtgattaatgggtgattagaaatcaatctaatgaacaatgataaagtggaagggaaaaaaacccaggaatatcggaaattaaatattcgaactcgccaagattgatctccataactggattgaatccgagttggagagaacgagcttggagcaagtcctcatgacatacgggaaaccaaacaagattgaagtgatcgtgagccttcctgactagtttgaatttgttaaccacgaaaattagcatcagattcagagatgaagaggaaaatcaaagcagatttgagatagagagcgcatcggctggaagcagagtcggattcaaatgagccgatatgggaagacagccgatacggtttcacttgggctcggtttgggcctagattaagatagctgatgtattgccgtatagagatagagtccatttaacgcaattatatctattaattaggatattgataccggcttgaattagagatatggtaagagtccgccatatggactttttttttgtttttttccttttatctcctaaatttgagtctttttgtttttccttttgtctttaggaaagtttgagtcgtgtctataatggacaggttttgtaatttgggtataaatataaacccaagatcatgtaaaaagggacgaacatccaatcaatacaactttcggcgcattgcccccttttttcttttaagtttttcgacgagttcttgcttcaagtcggggcatcggttgcgatctctcaacaagaggtgacttataccatacaatctgaaacgtgattgataaaaacaagatagatggtattatagccgatgggacatatttagggtttgctttgttcagttcatcatanagattgagccaattttgtttaactgcatccgctaaaccctaacgatacgacatcggcttatcggtcgatcggctatcgttcatctaactatatttgttgtgtcattgctagttgtaggatcaaatcaactagcacgctctttacacttgagacaagtctttgtacctgcactggagttaagcaaatctcccgggctgtcgtattttgcagtaacagaatccgagttagaaaggggaagctcgcctaagtccccgccaaagaagtcgaagctcccaaagtgaaaggttcgccctagggcgaaattgaatccaacgacgtcgatgattggctccgtcgcacttgtcgacaggaaactcggcgcaacccctagttggtgcgccaactgttgattctagaaatcggcaataataaaaggggtagccctcgatacctaaaagtgtatggatgcggagataaggatttagacatgttcatactctctcaatgagaggtaatatcctactcttgtttaggtattgtatccgctgagtgtagtattgatctggcgatctgactgtggttatcttgctatctctcctactcgctctgtcaaaaaaagaccaagcaatatatacattagtttatatttaattgaactaatttcttgtcatagatatcattaaaattttatatacacttgatcaaattttgaaaaaaaagttaattaaaaaaatatcaaagcgtcttatattgaaagtaatagacgttgacccattgtactgggtcaaaacatgctgataaggtagatgatcatgtccttcggaacgaaaagctcttgctgtgtcttgcgccgatccgtctttggtctctgcggccttcaccagtgctcttccaacttccaagttccgatagctgggttcgtatcttcattgggctgcgattttctcgataccgtccaggatgaatctcatccaatttgcttttctctatattgctgatacaagcagctcggtgagtatatcatcatcgttctccccattttcccagttcttcaatctgtactccatggttgattcgatctccgtcctcagggatggaggccccgcccctcgccgccccgatttgtgcttcacagggagccatgggatcccttcttgggaagatgaagaagctgcttgtggctcccgatggcagcaggctacccaagggggtgaaggatcggatgctcctcctggaaggcgaccttggagtggtcgccgcgtacctcgccgatctgtcggagctgaaggaccctcccccgacggccaagcgctgtatgagaaaggtgcgcgagctgtcctacgacatcgaggactacatcgacgagttttgcgcagcgccgcggcctggccgccgcgcgaacaccatggccagattcgtctgcagaatcgaccgtgtcaaggttgctcgtcttcccaagaggctcaagaggcaccagcagatggggaagatggtgtcgcagttcaggatttatgttgaggaggccattgagcggcatgggaggtatggtctggattgctgcgaccacaggcggagatatgtgtcatttggccctatgttgccatctaggccgtatggggaagaagatgcccagctagtgattgatggccgggtgagcgagttcatcgagcggctcgccaatgatgaggatcagaagctcaaggtggtgtctgttgttggatcttcaggtattggtaagaccacacttgccaaactgttgtacaacagaattgggggacaatttgactgtcgagctttcgtccggatctcccggaagcctgatatgaagagggttttccgcgagatgttctttcaactccagcggaagcagccacctgacgattataaggagcttgcgcttattgacagcatcagggagtatcttcaagatagaaggtatactttactaagtagtgcctcttgtgtccatttttatatcagtgctagaacttggaacatgccaaagaaaccaatccatcacaaaatgcatcagatcctttggttgccaatagtccatgcatcaattctgtacatagatagtactccctccgtttcatattataagtcgtttgacttttttcctagtcaaacttctttaagtttgaccaattttatagaaaaatatattaggattatcaacacaaaacaagcatattatcaaaatatattacatgttagatttaatgaaactaatttgatattttagatattgctaatttttttataaacttggtcaaactcaacaaagtttgactagaaaaaaaatcaaacgacttataatatgaaacggaaggagtactaagcaaaataatctagagaataaataggatatggtctaagtctctagacttccctatgataattgcaatgatttccccatcttgagattctaatttgtttgaagtatataatcctatgcttatatatagattatccaaactgaaactaatgtacattccgaaatcgagttctttattttcattcaattactcacaggggtgcatacactagttatccactcttatttattctgtttaatgatggtactatttttaatgattcttgcaaaactgctcaatagaatgaccgttgaccattgattattggggatacatattctcaagggccatacctacagctatgttaatggggatgtggtttttgataataagccaatttggccactttagctggcccatttgaattctattgcatataccgtcaagcaatacgtagacagacactattgcataacagtttggactctatagtgaacccaacatttataggaagggtcaaaatttgaacatcttttccattacatctcttcctgtaaaacttgcttcctcatttatttacttattcgatttatatatttctcatgaatgttactatattagctgaaaaaatgtatctaatatgcataaaatattgccaggtatttaattattattgatgacttatgggctgcctccgtatgggatcttatcaatcaagcttttccagaggtaattctgagcagcaggatagtaataattacacaggttgaagatcttgcattaacatgttgctgttatgacaccgaatatatttttgagatgaaacccatggatgatgagcactcaacaacgttgtttcttcagagattttttggttttgtaagtgattgccctcaacaattcaaagaagtttcaaacaaaattgttcaaatatgtggtggtttgcctttagcaacaatcagcctagctagccttttagcaagtcagcctgtcatcttaatggatctatgtttatacatacgtaattctttaagctctgcttttaggacaaattcttctatagaaggaacgcggcaagtattaaacctcagctacaataatcttcctcattacttgaagacatgcttgctatatcttaatatgtatccagagggttataaaatatgcaaggatgatgttgtggaaaaatgggtggctgaaggttttattgatcaaatagagggccgagacttggagaaagttgcagggagctatttcgatgaacttattgacagaagattcctccaacctagcagactcaactacaacaatgaggtgtcaacttgtacaattcatgatgaggtacgagatcttattgcatacaagtctgtagaggagaactttgttctggtattagatttttaccggaaggatgtggaactttctgataaagttcgtcgactttctgtccactttggtgacataaagtatgcaaaaataccaacaaacatcagaacatcagaagttcgatcacttacattttttggattatgtaagtgtatgccttctcttacagagtttaagcttcttcgtgttctaaaccttcaattatctggtcatgttggtgatgaactcttagacctcagtgggatttctgaactatttcaactgagatatttgaagattgcatgcgatattcgcacagaactaccaagccaaatgcgagggctaaaatatttagaaacgttgcagatggatacaacactcactgctgttccttgggatattatctttctcccgtgcttgttacacctccatcttcgttttgatatgaatctgattgatttgatgggccacatgacacctcccagcgaactaggatcaagcagtagtaactcatcacccagtgggggcatcattagcaatctgaacaacgtacgggatattcatctcaccttctgtgcactgccttccaaacatctagagagaaacatggaaattttgggctctttgcttggaagacttggtaatctgaaaaatctaactctagtttcttcttcctctcaaaagaaaattgcggcttcaggagcctcagaagtaactattttgtgggataatttggcacctccacctcttctccagagatttgagtggttgctgcacagctgcatcttttacagagttcctaagtggattggagaacttggcaacctatgcattttaaagattgcagtaagggagcttgtaaagaacagtgttgatattctcaggggattgcctgccctcatggctctatctttgaatgtgcacagagcatctgtagaaaacattttctttgataaggtaggattctcagttctcaagtacttcaagtataattgtagtgtaccttggctgaaatttgaggcaggggcaatgcctaatctcaggaagctcaagttaggtttcagtgcccttggggatctatatggtactgcacctatcaggattggacacttgttaggcctcaaagaaatctcagtaaaaattcatggtgcaagtgtcgacgcagagtctgcattgacatctgctgttagcaatcacccaagcaatcctagaatcaacgtacagttggtggataagattttttatggtgatagagtgacaaaagagaaagatcatgggtctgaggaagaacaaaatgctatcatgagcgccaacttcgatgaatatcatcaaactcaagataaagagtcaagtgatgcgaacaaacaagttggaagtattgtgcgtctgccacgggagcaagaacatgggattttagaacatggggatcctatagagtcgactgcgggctgcacaatgggtttgtcatgcaatcaagacgcg

SEQ ID NO: 21697 - DNA, 2215 bp, Oryza sativa
  unsure (1)..(2215): unsure at all n locations
gattgtagatcacttgtacatacaacacccctataaacgagttgtagcaggaaactttgtttaattaaccaatcattttcaactctacaccacgattattatttgtccaaaccaccaccttaactaattggggggattaactaaactaggggtgagactaatactatgaatctggtcaacctccatactgatggcacggctattcgaggtgtacaactgtacccacaagacacagacccacgacatgtttccgtgagccgccatgcagccacgacataccggaaagaggccgtgacaggacccttcgcataaccccctctaaccaagcacaccacaccttaggtttcgcccttggtcctcaacaggcagcgggcagccccttctcgtgcttaggcgaatcagcaagccgcataggccgtcgcaggacccattcgaactccatcacgtccacccttgcctggatgtgtcagctagaggaaagctacactacaagcccagccgttgcccatgctggcttgtggtaagtacgataaattcttccaaggtttcccgtgaaccggtccttaatcgctatgggcacgaccagcaaaaccatgcacccacagcccaccatttagtgtattttaattaaccaacaccattgcggtggcactagtccaaagatatgctagaagccaatgtctatgcattaatgtaactagttggcaccctcgcgccttgccgcgggatttgctaattttatcatcgaataaaatcaatgttttaaatggttagatgcaactcttttttatatacaaaatagatgataatacggcttcatatatagcttctgttattataatacaattaatgttttattttttgaaacgccattgtgtattgttatgatatatgaaagttattttcatgcacaatctggatatcgtcacaattaggcagtgtagcacttctctgcttcacctcaagcatgtttccaaaatgagtttggattaatgatacctaattattgtatgttatccaattgtttataacaaaacaaagctcacatcttatataataattggagttgtatttagaaaaaaagattagtattatctttgaggatttgtatgtatgcgtagaatggataacaatgtcacgcatgattatgagctaaagggaggtgaatggataagtaatcaatgattaaattagatggatgagtagctagcttcttgatccaacggctgataactctatactaatgcgatccgatggcttaaaattgttgatgatgtggcttcttgcatgtcttgctttataggagtaaatgcttcttagtgggtaccaattatataggaagataggattcccctttgtttactagttgaactaagcatggtaagcaattcctagtccaacatctagtcatgttacatcccaagctaacaaagaaataaggtacacaaataatatggctgagaacagtaggtaaaacatcccatatcgtaacattataaaccatgcataaatttaaaggaaacatagagcatttgcaatatgggatcaatattttcaagtgacaagtataactttccttgttctgctgctggagggacattggcgactacttcgaagtacaccgaagcgtcgggagagccggattctaaccgacattcaaagtaaacaatgcaaacaggctataagactactgaaacaaagaacaaaaccattttaatggattctttacatttttcttgatttactgagacttgaatgggcttaaacagagtacggatgaattctctatgaattttagaagattcattgtgtttattactataacagaaaagtccttaattgattcattgtgcattaaataccccggattacgtctgcggacagcggtggcggctcacggccgttcactcatgggctcatctcaagccagccctgtgggccatggtgacacggcggcgctgcatggatcggcggcggcgcatgtcggnnnnnnnnnnnnnnnnnnnnnnnnnntgcatcggcatggatcggcgctagcggctgtgctaattggcgggcggcgcggcaccgagagggagagaaagggagaggagggcctcaccgatgattatcaacgacatctagcggctagtctgctactgcgactggcggacgagctcccgggtttcctaagggacacaacgagagaaattatatagggagaaagaaatcacat

SEQ ID NO: 21698 - DNA, 4531 bp, Oryza sativa
  unsure (1)..(4531): unsure at all n locations
cggaagggggaggcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcctcggcctcgggccagctcagctaaggacgcgcgggggagagaagggaataggccggcggcccaagaaggaaggaaaaagggagaaaaagaaaagaaaaggaaaaagaattttcagggttttttttaatgcttatgctcgattttaattagttgaaattccaataaaaatcttgttagcatattttgacatgtagaacccaagaaaaattccatatgccaattccgattattattttcattcattaatttaggatttctctcttgcctttaaacaaataatttcttgcaatgatttattaattgcatttaggattgggagaggacctttagggcgtgacactcagagctgacgccgcctcgcctcgcagcaaccagcagcccagctgatgtgtgtactgtattgatagactgatgtgtgttgctgttctgtgatgattgatgaactatgtactgaatactgatgatgtactgatggattgatggatcgatggagtgttttgctgtaatttttttagaatatttgttatgcaaaatatatgaagttatagaagaatatattttgctgttgggacataataattagacctgatataattatgttttatgatgaattgttggctgttgagacttgagaattggacttaacaaaagtttgaagctcagtttgaggggtttttgtattccgataaattttcgttgccatatccgcgccggttcgttttcgctctgtttttggtttcgataatatttgtttccgaggtttccgattccggttccgattccgaaaaaaaatgaaaatgaaaatgataaaggttgtttccgtaccgttttcacctttaatgcaaacaaccaaacacctgcatgtgtatcctctcagccaggctaaactcagcctggatggaaaagatgagctaggataaagggatgcgagcaaccaatcacacccataatgctgcgggtgttgcaatttgaaattttgctcaaacccaagatcgagttgggatgaaaatgaagcggatacggatgggacagaataatgttcatatcatatttggttttttctattttttataggtatgaataactcggttacaaaatcaaatacgaattatctatcgaatattatatgacacgaatatgaaaacaaatatttcttggaacaaaaaaaccacctataaacttttaatacgacaaataccatcacacataattagctcgtttggtaaaaaaagtttgatcatagactaaacattgctaattaaattcaacatgtacaacattgttcatattaatacaagtctaactaatattataacatataatttatattataatttataaaatattttaagatttaaataatattaatggtttggactagtgttgtgagaggcatgagaaatatggggtatgtttcatgcctttagcaaatatctaaatattttaaaaactaaataatattaaggttcacttgatatttgtatatgttggaaactccgatatcatatgtgtattcgtactggagaaaaaatatatcaattttcttatccatatctgaattatctgagaattatccactccgaatgacatccgtatttggtttcactagagcgggcagaaactatccactccattttcatcctaaattgagttcatcaaggtttattgcaagtggacctcttaagaccacgcctgtaaaaaatgattttttgtagacgggactagatttattgtatttttagctatttttgcaaacagtgattttataatctgcgtgaaaaataaaagagtgatgttgtttgcaaacaattaatgattttatagtctgcttgaaaacataaaaatcgtgatgttgggaaaaatttctagtagggcaaagtattgcactttgcatctcatgcataggattttccttggcaaaattcacaccccaaacacgtagtctgttaattaataaatataggataatgctataaattaaataagttacacttaattcaaaccgaccaaaacctctagatttgacacgagtgctcgtatttatggccaattattctttcagtggtagtcgatgtactcattaataatgagacgctcgtggtgactttatcaataaatatgttagcttagtcatttgaaggtacttatagagaaagggcgtgcgtgtgtacgtacatagggatgaatgtgcgcgcgttatgggcacatatttgtactttgtttttaaaagtaaaaacctccatcattagcttgcctagcttaaaaggagtatatatatatatatgcctattatatgtttcgaatatttgtgagtgacaatggtccacgccattgcctaatataaataatttgacttttttaatttttttagtttaaaataataattttaaccccaaataaacatactaatacaatatactatatatttgtttagtttcaatgagaataattttgtttagttttaataaataaactaatttggtgttgtagatgttgttaacttttttatattttttttataaatttacttaaagttaaaaatgtttaacttgatgaaaaaatcaaagtaacttataatataaaatggagggaacactaataatgattttattcttagctgagatgctaattagggtagtactgattctatgggctaactaaatttcccctaggaataagcaggtgattaagtggctggccttggagcatataataatattttgcaagatggtctccttaatctcgttgagatgctccatccatctatatatctatccaagtcgacctctctcttggaaaaaaaaaaagatgcgattcttcaaagaatagtgctcctcattttggtcttcatactctctgtttcgaatgacacctatcatgctaattgaaaaggttggcttggctgtgatgctgatagcccatgtatagtgtactttgtgccttttaattccaaatgctactttttacatgtttgtacgtgagaactgagaaccttccccggcgttctcgtcgcgttctcgtgcaagggaaatgatcgacacgaagctgcttaatttgcctatgaacttttttactttcactgtcattttttataatatctaaagtaacggaaatataattaattgtgcaactattttggtggaatggattccaccgttgggaaatatataatgctagccaaatacccgtgtgttgcagtggattaaaaaataaaaaaatgagtcaattttctgaaaaaaatatacttcatccgtttcacaatgtaagtcattctagcatttctcacatagaatgacttacattgtgaaacggagagagtaattgcttttatttggttgaaacaaaatgcttcatctttgcaaaagtgcctgtagcctagtggttacaagagcctcatagcattttaggtcctgagttcgacttttcgtgagagcgaatcttcaggatttaacgactttgtgctttcagtggtagacgacatatccgtcgataacgagacgcctatggtaactttaatctccaggatttatcggcccagtctttgaagatgttcatagggataggatttacgcgcatgcttgataggggtgagtgtgcgtgcgttgtgagtgtctgcgttgtactgtgtaattaaaaaaaatgcttcatctttaagaaacaaaaagaacagagacatgcttagggttgtagttttctaaagtgagacataaatccttaaatgcattttcacctgacaatagaacacgtattaattataagttgtgcagcgtgaccaattaaaaactacaaataaaactaagatgttcatgagtttttcacttgaatcaaggtgaaaaagaagaaaaccatcagagacaacacatatacagtgagagacaacacatatacagtgagtatagcactcgtgtatactggtctcatacaccaccagtcttttaaaagactacaaaacaaataaacgagaaacacatgaataagactacaagacactactaaaatacgatttttcatggcatcacagccttttatttttgctgatggactaacaaaacaaataaacgcttgtaaaaatatatggaggattctgggtcacgagctattagcgaaaaccgattttcgctgacagatacttaggaggtccatcataaaaaaaacaactctatttttttaggcagacctcttaagcgcccgctagcgaaaattgggttttcattgggggaagcaagcaccgctcgagaaacaaaaccactctatttaaatactctcccataccactccctcttcctctccttcaactctcacccatggggatcctctagagtcgacgtgcgggcgttcacatgaagntgtcaaccngacg

SEQ ID NO: 21699 - DNA, 8479 bp, Oryza sativa
  unsure (1)..(8479): unsure at all n locations
ccttgcnggtagatcaacgctcagcacncancgcggctggctaggtcgnctgccaagggaggcatctacgttggtagctggtaaccgtaagttgaaaatggtgtattttcattggtcattagtcgtggacggtagcgtcggctgccgggggaaacttaaaatgaccgtcaggaaaaatttgtttttagtaacgagagaatttcaagaaaaataatcgtaattgcttctggatgtgcagcagagacggatgctgtagcaagagataatacctttcgctacttttggcgagcgtgtgtgaaggaatatcagtcgggataaggcatggaggcggatacagaggctacctgagagttttttctcgaatggttactctgatcctcacttactataaaattataatacactaacttcaaaaaattaacatgcaaagatgccatatcatcatccactaataatcattaaatttaaacatcatacaaacatgctatataatctataattttataatttattaaattttatagcttttaaaatgtaagcatgttaaatcatcatcccacgtaattcacgtaatatttcaatatatatctttattatttttataatatgttatgtacctatatagttcattctcaatatcatttctcttttctctcgttatgctatatcactatatcacatcaattggtttttagtgcttaaatgaataatctatggtccaaattatctctctcattttcttctctcattaatctatatcacctcaattatatttagcatttagatgattaatctacggtccaaactatctcaatacttttcttcttttataaagtcatatgatcttccttttacatttgaatcatcattctatatactatttaaatttaaattatcataaaccatgttaacttacgtaatcttatattgtcaagcactctggctatcttacatattatttttacttatcgttattatactaaactcccgcagcaacgcgcggggtttggtttaaattgaagcccaacttcttagcgatcagctcttcatgtcaacttggctgcacattacaatactaggtttatggaaaagcaggagagaatgatttaattgatgatgatggtaaatgatgagcataggttatattattttcagggaatgccgaggctatattttactcatgcttgttatcacacgtaagacggtgaccaagtacgtaggggtggatccagaaaagttttagggcccctttaaatcgcaggattgagaaaacataggaataggaaaaacgtaggatttcgatatgaatataagtgtaaaacagaggattacaaaacaaaacacaggaatgaccgtttgattcaaccgcaggaaaaacgcaggaattggatgagagagatagactcaaaggaaagttaccaagaggttgaagctcttgctaaatttcctctaaaatctctataggaatgtccatttcataggaatttcaaaggattagatagaattcaatcctttgtttcaaagggcatcataggaaattttcctataggattgaaatcctctaaaatttctatgtttttcctccaattcaaaggggcccttagatcctaagcaaatctcattatatcaagtgtttgctatgaaaacttcatttctaattcataaaaaaacatttaaattctattccacatccacccgacgagtttgggtggttgtccagggctgccaggcggtagatccctgacaatatattggcaaaactaattttgattctagtttttgaatatgtatcaaatccatcttcttttgtaagttatccatggttacatatcaaaaggagaaatagaacagggttcatgctcaaccgttatgtctatcaaaagtggcaacctagtcgtgtctaaaaaaatattttctgtctggaaaccagtactagcaaccggtttttatagaaaaaacagagttcaaatgtttgtttggtataaacaattattacaagtctttttttttccaaattagtatttatagtgttggattgtatggaaattaatgcgcaacgtctgatggttctcccttgaaaaaacatttagaattagttcgaattagatattcagataggattttttgccacatgaaacaatataggacattaacgtccgattagttgagtattaaatattataaactttgataaatttatttaattaattttttaaaacttttttatatagaaaatttttttgtacaaaacgtattgcttaacaatccgatatatttctggcgaaaaaggtagcatttccgaatagctttagaacttagctactttcttcatcggcttcccatcattatttatatttgctaggtactaaaacctgtctctaactcacacaaaaacttgcttctttgtccatgatttttgaaaactaatatttctttaaaaaacatgtttcgtcatttataaaactcatattgaataaaaacgcatttggacaattcgatgaaatggccgtcgtcatataagtcaagatacggttttgaagtgacggcatgccattaatagagggaaatgcttgaagcaaaaggattttctgtgatggtggtggatggatgggttggacagggtacatcgtcgttgtctgccatcatccgaaacagaacacgggcaacacgacatacacacaccagtccaccacatcacgcgctcgtattaccacggctgcgctgcaacacaaaaaatgcccagaaaaaaaatatatactactcccagaacgaaagaggaaataaaatattaatgttatagccactcaacaagacttaaatcctgaattttataaacacgtgaatacgttttcaatatatatttagggggaatttaaaatagaaggctctcatcgtttgaccagatacgtattagcataataataatttatgggtaaaacttatatatatatatatatatatgtatatatctgtgtgtttattcttgatgacttaaatgctaacgctgaagaataatctttgataaaaaaattcttgacgacttaaataccaatgctaaaaataatttttgatgaaaaaactttaaaatcagctttaaatttaacttttaaaatttaaattttaacgtcggttgatgctgaattggagaaactacgggagccgagctttagtaagagaaagttgtcgctcataacatgagtcagaagaggaagcattagtgagtagcttagcatggagtgtgtgcattgcggcgtgcgcgtattagtttttcgttcaagggaaaagggaaataaaggacaaaacgaaaagtggaaataaataaataataaataaataaaagtaaataataaaaaagtgattttcctcggcggcgaactgtctggccgtcagttcattctcccttttgcttttctttttctttcaacaaaaaaaaagaaaaaaaaaacgtcttttttagaccatccatccatccgttccgtcaccgagcgaagcagccgcagtcgtcgttttctccactccaccccccacgcctccttccttcccttcgcttttacctccccgattcccctttctcctcctccctcctcctgctgctctctccctctacctctgttgccggtggaggatctggccggcttcgaggacgcctgtttcttgggatggtatgtcatttcttctctttctcgcggttcttgctgttcttgattttggggggtgatttcgggttgtgcgattgatgtagcttctccggggttggtggtgataattagtatttagttcgtcttaattttgggtcatgaggggtgtgtggtgtattttgctgctgattgttggtttgttatgtaaatcgtttcttctaatcaatttgccatggattcttggctctgtgtgtatcttgactccaaaccctatggtgaaagtgagacccttgagttgggagattaaagaacgaggtaggtttagttgctttggccctagtcttagggtggtttatcatattagtatattttttatgttttaatgtagtaaaatatttatgtttggtttgctgttagatacacaggagttaagcaccaatgatttcattcctaggttctcctttttcatataggggttctgcttctgaccagaagtagtagtgacctgtgtgcctttttttctgatctccacatgtttgggagttttgatctctcaattgctagcgaaaagttgtcataatgccagcctaatgggatcaatgccctaccaatttcttcgcatcctgccggatccattggaacagaaattaattagttgacccagtagaactgaacttttgggacatttattgctgtgtttctagttaatcaacttcttggatagctttccattaattctgaacaaaactggttcttttggatagctttcttgtgtcacatggttccctttttcccctaatttggtaatagcatattgtggttcttttgtatagttacacgattttgtaattatgaaatataaaagataaacacgatagcgcaggtttcttatgatttgagcttactttgcttgaaccaaacgggcctgttaggtaacaaagattaagtttcttatatgggttatttattttgtttttgaagcaagaggtcacatgccattaataacttgtaatgtgaaaaaatgcttcttgtttgtaatggttcccaattgcatttataatgttggggacctatgtctggtctttggctgctttttatagctaatatgttgatggccatgcctgcgtatctattacaaagcgggtcccaagtcccaactatttcattgattagcaagatttcttgatttcagatgtaacttatgctgaaagctaatccattgaacaaatacccttgattctgtttgctttaatcgtactttccaaaatataattttagttgaacaccatatgctatggcatagtggaagtcgatatgaagcttaggtgttaaatgaaaaaacctttttaacaatgtgcttatgtatccgtctcttacatggatcaatcttgtttgtattgcagttgatggtatcaacatactgaacatgtttgtgaaaaggacggcaggatcaactccctgttgagtaccattccacaagatttcaccagtatgtcagctagggcttcaaaccatgcatatatatgttcagatgattctcaaatgccgtactataataactcagtgccttcagggggaaatggtaggttctatataacacaaaatcatcaggatgctcactacgcttcttctgatgatgggtcacagaagattggttcgagccctcaagcatttgaagcgccgtactgcactctagaatcatcctcagcaaatggtgctcatcctgcccatagctctgcatcttctcacagcatctctcctattagcgggagccccctgtctcatcatgatagccactcagaccacacgtacaattcccctccaagtgcatcctgtgtcacagagattacagatctccagattaaactgagggagctggagaatgcaattcttgggcctgagctagacatagcttatgacagccctgagagcgccttgcaaccaaacataatggcaacaccagaaaattggagacagcttctgggaattaatacaggagatttgaagcaagtaatcatagcatgtggcaaggctgttgccgagaatgatgttcggctgacagaactactgatatctgagttaggtcagatggtgtctgtctctggtgatccattgcaacgattgggggcttatatgttggaaggccttgttgccagactttcttcctctggcagtaagatatataaatccttgaagtgtaaggagcctacaagctctgagctcatgtcatacatgcatcttctttacgagatatgcccattcttcaaatttggttatatgtcagctaatggcgccatcgctgaagctattaagggagagaactttgttcacataattgacttccaaattgcacaagggagtcaatggatgacattaatacaggcccttgcagcgaggcctggaggaccaccatttctacgaatcactggtatagatgactcgaattctgcttacgccagaggtggtggactggatatagttggtatgagattgtataaagttgctcagtcttttggtctgccctttgagttcaatgctgttccagctgctagccatgaggtttatcttgagcatcttgatataagagttggtgaagttattgttgtgaattttgcctatcagctgcatcacactccagatgaaagtgtaagcacagaaaaccatcgggataggattttaagaatggtcaagagcctctcccctaggttggtgactcttgttgagcaggagtcaaatacaaacacacggccattcttcccaagatacttggagactcttgactactacacagccatgtttgagtcgatagatgtcgctctcccaagggatgataagagacggatgagcgcagagcaacactgtgtggcgcgggacattgtcaatttaatcgcatgtgagggtgctgagagggtagagaggcatgaggtctttggaaaatggaaggcaagattaacgatggcagggtttcggccatacccgttgagttcagtggtgaacagtaccatcaaaacgctgttgcatacttacaatagcttctacaggcttgaggagcgagatggtgttctttaccttggatggaagaacagagtattggttgtatcttctgcatggtgttgacatgtctttggaagaagaagctcatgtacgtgcattgtttgcatctcacaatttttcatcttccagtgatttgtacttaaattattttgcatgttcctacatctgaaatcatatgcttaatttgtacactgccatcgtttcgcaggtcccatcacatctccatctccagcttgcaggtgcaagatgtaacacgagctttgctttgcagtggtgtagaataatgcaaactataactgtggatatctctagtcctcaattctccccatgctcaccatccatctaattcaacgcttatctgatcatctgagatactcaacatcagctggtgcgacaatcgtagcatagaagtcgtaaccttgttctatccatgctaaatatgtataatataggaatctggtattgcatccaaggctggatgctcttgctcttaggtttgacatgttgtaatgttcagtgatcaagctagacaggcccaagttggctgctagttttctatgtcagttgtgtacctgtgtagttgcttgtaaatttgggtgaatgctatataacatcagtattattgtctgttaatgatgctattttctggcacgtgtatttgtgtacctgtgttgtatcatgcagttagtacatatatatatatttttattttgtgtgtgcgtgcgcctttggtatgcagcagcatggtgttctgcatgcttgaaaatagctcaggttgaagaatttttctgatgagagactgcctggagcatgatggccatcgcagtgctataatttttcctatacaactccgttgaataggattaatctttttttttaaggagaataggattgatcttgctgattgctatttctaatgacaaagtgtatacgcttgattatacttttatgcagttttctagctgcgcaaatgcgaaatatgcaacatgatcgtctaaactaaatccttctgtagttttgtttaatatactctcttggtcgtgatttccacaagatgcatttttctctaatctctatcatggtcgcgatgaaccacacagacacactccatctggtcgccaaaatttaaaacctaaaccttttttaaacatctaaagagatgtatggaaattttatatctagtttgtcctcaaaagtataacattttataggagtttttatatgctttttgtaatagaagttgactatcaaggctgtattttgaagatcgtgttaatagaaacctaccctgaatttttaccataggcagaattccaccaaacaaaaccatgaccaagggtgtgtctagttcacgctaaaattggaagttcggttgaaattagaacgatgtgacggaaaagttgaaagtttatgtgtgtatggaaattttgatgtgatggaaaagttggaagttttggaactaaaattggcccaagctaagatggggtccagatcccctagagttagctataactccaccaggtggatttgaccaaatccatgccatcaattgtttcctctggctaagatgaagccacgtattaacttatattaattaactccctcaatcacatatgctcattactagagaaacgatctttgctaggtagacccaaaaccacgatagtcccggttccaaaaaagctgggactaaaaataatctttagtcccggttaaaacccctatagctattttatgatctttagtcttgtgtgggtgtccagagatgtaatntcaacaaacacatg

SEQ ID NO: 21700 - DNA, 13700 bp, Oryza sativa
  unsure (1)..(13700): unsure at all n locations
cggttgaaatcacttgctaccttncatacaccaaaacaagctatgtgattttctgtttgacatgaactgacaaaattcagcaaaagtttgtatgtacattaattttggttttgatggacatgggtgggatttgttggtataagggagttcaaggagagagcaaggtggacaaggtggtggtgctgtggacggtcaacacggagcggtacagcaacgtggtggccgggatgaacgacaccatggacaacctgctggcgtcgctggacaaggacgagccggagatgtcgccgtcgacgctctacgccatcgcctgcgtcatggagggcgtccccttcatcaacggcagcccccagaacaccttcgtgcccggtgcgccgcccgccgtctgctagctacatcctccattaacgacgacgacgagacattgtttcatgaatcccgttcttaggttgacgatgatgtgctgatgcatggacagggctgatcgagctcgccatcaagaagaactcggtgatcggcggcgacgacttcaagagtgggcagaccaagatgaagtccgtcctcgtcgacttcctcgtcggcgccggcatcaaggtatatatgtacatatgatgaactccaactcgggtgatcgcgatcgatgaaacatgaattggtttgttgtgcatatggaaattggcaatggcagccgacgtcgatcgcgagctacaaccacctaggcaacaacgacggcatgaacctgtcggcgccgcagacgttccggtccaaggagatctccaagagcggcgtcgtcgacgacatggtctccagcaacgccatcctttacgagcccggcgagcaccccgaccacgtcatcgtcatcaaggtccgcccgcccccattcttgatccaattcattcttgcagtagtggcactcatcatgcatatggtgtggctgatgatttggttgctgtttctatggattaattgttaattgctttggcactcatgcacagggttagaaattccggaatgaaatttctgaaattcagtcatttcgaatcctcctattccggaatgaaatttctgaaattcagtcatttcgaatcctcctattcgatattatttcggctgaattttttttttgtttttttaaattcggtaatattttgttcaaattcaaatttggtgacctccgatagaatctgccagaccgaaaaattataccccgctgatgcacggtggctgatgatttggttgctgtttctattgagtaattgttaattgttgcagtatattccatacgttggggacagcaagagggccatggacgagtacacctcggagatcttcatgggagggaagaacaccatcgtgctgcacaacacctgcgaggactcgctcctcgccgcgcccatcatcctcgacctcgtcctcctcgccgagctcagcaccaggatccagctcaaagctgaagaccaggtaacaacagcaatgcaatcacatcttgcacagatattggaatggacccagttcatctctgacaacgaactctctgaatctactgtccgttctgctcattgtgcaggataagtaccattctttccatccagtggctaccatcctgagctacctcagcaaggctcctcttgtgagtgcattcatttcctgaaatcaaatgcacttttggcctgttaactttattgccattttagaccataacaaattttagcgttaccaaattttagtaggataacaaactaaatataatcttattattgccatcataccaaaatttcgtagttccagaagttctctcatgagaacactactcaaatttgacaaacctccaaaccaaacacgttacacatctaacgctagctaccaaaatttgataacatcaaaatgtaccaaaatttggtaattttggtaaggttgattttgacaacaagtgaacaagcccttccattttcacttgcaggaacaaaacaaatttctgttagtttctgttgcaatgcaatgtgctgaaaaatcatttgaaattgatgaggagtttggttgatgaaactgcaggttcccccaggcacaccagtggtgaatgcactggccaagcagagggccatgctggagaacatcctgagggcctgtgttggactggcccttagaacaacatgatgcttaggtacaagtgatataggccttgacaggtcctcttatcaggagggatgatgacaagcaagtggtgaagaaaggtgacagttttcttcaacaagaaaaagaccaaaaaaagagagaaaatgagggaacacctgaaagaaataccaaaaggccaagtggggaagcaaataaaatgatcaagtgatattcattcagaaaatgggtgtcattcacttggatcctcttaattgggggcatctattgacagtttgacactctgctccatgattttttttttcattttttgtttttttaattaagatggagacttttttcagctctgctgctagtatgctgtgagctgcatgaacattggttaatattgtgtatgatgataggtgaagcaaggaactaatcgtcttctatgcttatggatctatagtacaagttgtcagtattactgttaagtcttatatctggaacacttttgaatcaaagaacagctttggtcctagtctgtatttatgaggccatgttctgcttatcaaaatgcagcaatttcctgttattatcctgtaattatgcagatagtgaaaaaaagcaaccttcttcaacatctgcatatgctgtgcaaattctgtactaatggctaaaacatcttggcatccatgggtaaacatcaggttaatgtgaaatgaggtgtgatggttacagttgccagtgccaggaggtgtcttgcggcaatttccagttcatgtcacataatcaatgtatgttcctttcctatgcacggttgtctctcacacacacggcagatttcttccaccggtttacaactcgaaccaaggatcacaatattactttccaatgctaaattagcccaaaaaccgcgagcaattcggctcaaagatacttacacaggttaatggcctcttgctcctcgctcacagatagtctttttcagcagctgcacttctggttgtacaatatattgatgagtgtggtgcaccttgctaggaggctaggagtgcagcttcaaccaaacttgagagggggacatcatggatcatggatgtcttttacaatttagatttcagatttcctgacaatggacacgacgacggctatgtcatcgagtttgcccccgctgaaacccaggtaccccactgcaagagcggcatctgagaatggggtacttccggctgcagatctaccaacttcctgcgccttggcagccaggtgttcagcaatctcctgcaagtggaatagccatgcaatgattcaatgttcagattcgctaggcattttatttatgaggcaagttgattctaaccgttggtttgagatcggcttgtaaagatttcgagaccatggtggctacttcttgctcatacacattgtcaaaaagaccatcacttgctgttacaatgacatcaccatcctccagctcaattgtataattctgaaggaaaagggtaaacaataatgttagttttaaattacttaatacgattgcacatgatttatagtacaaaggctaatctttgcacctgtacaagtttcaggggattatcgcccttctcaatttgcagtggaaagttgaaaccataaaccattggttttgatttttggtacacctctccatttcttatcaccagaaatccagagtctccaatattcgatgcattgaggaactaaaacaatgacaaatgtagcattgaggaactaaaacaatgacaaatgtaacaataaatacagtgcaattggttcattagaaacaagaagagtcttgatcaaaagaacagacctggccatcaaagtgagcaaccaaaacagtggaagaaccaggagagtgcgcttcatctgcagccttggaaagaacttgttcgggtttaatatctgcagcgccttgattctccataatgaactttttacaaccatccattagctcccttgcataaagccctgcattgatacctgtttacaaaaattatacaacaacttagcacttcagcattcccatgaataattatgatacactaagaacttcagtatgaacatgtatcagacacatagtgttggctcaaaattaactttgcagctaataaataaatgagtgaatgttaacattggcccaagggtactaccgatatgaacacattttgccctcttacttgaagacttggtccaaaccaggttgtatgcctttcattctatatccatatatagagcctgtggtagaccagtggcctgtgtgggttgacatttcaaaagaatattcttctaaagaaggatgttcctatttcttgtactagtagtaataaacttattctacaacctccatttgaccatttccacatccattctacagtattatagttccatttcttttgtgcaagtcaacttttggtgaagagtagatccaatacggggtgtaaaacagaaaaacccatattcatctcccagcacctgctatggctattcaactcgatggttattgtgtaaccctgatggtctttgaattgccatcgtcctgctaccaggcccacaggcaggacaccattttcccattcctatggagtttagaaagagaactctgtcccttgttcctcaaccattattcttgctagtagtaactatctggcagtacttgatatcttactgagctggacgtaaagaagctaaagttggttcgtattttcccactacgatgtcaaacccataaaatacttcaggaaccagaaagaaaatgaatactaaagtattctttaaatactggaaaagttgcttttgggtaataacatcatcagtcaattaattttcactatagtaaaaatgtaaaacatgctttatatgtcttgtccaacatctatagactatagatgatatagtcactaagtcaataaaatctgccaaggtccttgtgtttattttgtttaacaagcaaacatttcttgaattttctgatggataaggattgactacatgtttggaaaacacattgtcttctaaagtgagcagtaactaaaatttaagaatagaattggaatgtggaaacctgcgcctggaatggaaagcctagttcacactgttgcactgaaatattcatgcggtttaccttcaaatgaccactggccaactccatcagccacaccaaaccagccatcacacgcaataaaatatgcatcttctccacctgttgctgcctggaaagttattcaaaccataattgaagcatcaggtgaaccattagtgtttctgacttacagtaatagtgttatcaaatggagtaccaaagaaaagtatgtagaatgtggaagcaataattaactgcttatttcagcaatagacatactttaaatgaatttgcttctgtgatagggtcaagatagactaaagtccaaaggtatacagcataaaagagaacacgtagcgcaattattagtaccttagaaggatgaggcaagatcgcagcacctgatgccaacacaagcgttgatgaggctactggaaccatcctttatatgaattacaacatgacaaaattattaaagctgtttttggaggtccaggtttaaaagcataaagacaggaaaagccataagatatgtttgcatgaaaaagttgcctaactaaatgaagacaaaatacaggtcatatccagctttgtaagcatcagatgcgcacaaccattactgcacaaacttgtatggaaatatatgagctattaataatttactgaatgcctttatgatttgaaacacttgaaatcgaagtaagaaaacaaattaatacctatcagtattcttcacctctgaagtgtccttttcccaatctaccttggtacaaacttcttcctatagggaaaaagagagaacattaggccctcacttgcacaaatcaaactaaataccaccatgcggtaaatatctgatagcacaagatctatgcccccaagtacagatcatattcacaacaatattaccattgtgcgactaaatttctagaggcatataccaaactctcaaggtgtatgtctggacccagtttttataaagtgttgatttgaaacagaggcagtgtgttttagtataaggtatgatcccttacaagatactgtcatagtataaggcaggagcagacaaaacaaaaatatcgtgccaccaccagatgatatacaacattgatcccgagtatgaacagatggggaaagcgaccacataacaactggccctcatccaaacaaaattgttacagacatcagtgagctgcggttataaaaaaaaaaaaagaggaaaccgagggtccaccaaaatgcttcaagtttctgactttgtgtgtgtccatgaacttagtaaatgatttactagtgcaggtaccaacaacatgaactcttcaatttactccttgtaaacagatactagtaaacaaattacaaatcgattgaagcattaaccgagtcacccaaccttgtcaagaaaaaattaccatcttcaatcattcacaattgacagcatccttttttcagaaattaaccatgtttcacaattcacagcatccattttcagaaaaaaaattactacaaatatatttttcttgatgaaggtacgggtgaaatcgggtgaggaatatcaatcagggcgtatcgaaatcagaggagtaaaattgagcaggtgagggaaggggagaggcataccgccggtggcggcgggacggcgaactcggcgggctggtcgtcgtcggcggcggtggaggcgctggactcggtgtcgacgtcggtgtcggaatcccgcgcggtggagccatccgaggcctcctcccccgcatcctccaaaccggaggtcgccgtcgcctccgctcctccactcgccaccacctcctccgcgtccaaacccgtcgccgtcgccgtcacctccccttctccaccgccatcccgggcctcaggttcagcagctgcggcggcgtcaccgtcgagccctgattcgacgacggccgcggcctcgggagccacggcgtccgcccgccgctgctgctgctcctcgtcgtcgtcgtcccgggggcgcgcgaagcggaagacgatgctcccgtcggcgagctctgggcgggagcaagagagagagacaagtgataccgagagcggcagatacgctagctgctaagctgctgctgctgctactgcttaccggtggaggagtggaggtcgggggcggcgcggcaggcggtggcggtggagtgggggcggcggtggtggcgaggggagggggagacggggaggggcgggggagggggaggggccagcttgcgggggcgcaggtcgagaagccccgccgccagcggcagctccgcatggctcacctcgagcaagcaaagagagatttgaaaatggagatgagctcgagagagaggaggaggaggagacgaggttttttgtgctggagtagtagtggtgggagtgaacagattagcgttggtttctaggcgaggaggaatgagattattatgagaaggggtaaggaaacaaacaaggagggaaggggacactggggggtgggcccggggtggagtaatggtgagttaatctgggtggttaacggtgcaacataaagaaatgggtttggacggtggtgctaattgtgtggtcgttatttttgcatttacccaccggtaactccgtcgcaaaggttcatcctacaaacacagcctcctactaattggctataaataaaccctaacctgtataaaggtatatactcgcacacactatcctatatattcctactacacatatcttgtacaagaaaaatagaatcacaggaaacaggaatagaaaattagaagaataaaaaaacacataggagtaagtaaaaaacagaggattataaaacacagaataaatacatgaatgatcgttcgattaaaccacacaaaaatatagaaataatcatttgattggaccactggaaaacacaggataaacacataaataatcgtttggtcggacaacacggaaaatgcaggaatgatcatttgattggaccacaggaattagatgagagatagaatcaggaaaattttcaagaggttggaactctggctaaatttatttgaaaatctctataggattgtccattacataggaactagcatggtggcccgcgcagattgcgcggctagtatcattatattttctctcatataatagcatatatgttttttattatattattcaaatatattaaaatgacaacataattttaaattttacaataactttacaaaactactaatgtgtaatattcatattgtattttatatacgtgttagttattaattatttttaatatcaaattttagttatttgtaaattatatatattcctatatggactctagactcgtcttttaatatattttttaatttcgaattttctgtaaaagtgtatttctatatagactctatactcttcttccaacattatttatttttatttctaaatttttattatttctaattgtatttatatgtggactctaaactcatatttcaatattctttaatttttaatttcgaatttcagttacttcttgtattcctatattgactttaaattcttcttcccatgtttttcttaatttcaaattttagttatttgtaaattgtatttttatacgggctctaaactctacttttaattttattatatttatttcaaattttagttagttttaaattcctatatggactctatactctacttctaatattccttatttttaattctgtatttcagttatttcctaattatatttctatatggactctatactctatttctaatattccttatttttaattccgaatttcagttattttctaattgtatttctatatggactttatactctacttctaatattccttatttgtaattctaaatttcaactatttcctaattgtattctatatggactttatactctacttctaatattccttatttttaattccgaatttcagctatttcctaattatatttctatatggactctatactctacttcttatattccttatttttaattctgaatttcagttatttcctaattgtatttatatatggactctatactctacttctaatattccttatttgtaattccgaatttcagctatttcctaattgtatttctatatggactctatcctctacttataatattccttatttttaattccgaatttcagctatttcctaattgtatttctatatggactctatcctctacttataatattccttatttttaattccgaatttcagctatttcctaattgtatttctatatggactctagtctcctcttctaatattccttattttttaattccgagtttcagttatttctaaattgtatttctatatggactctagtctcctcttataatatttcttattttttaattccgaatttcagctatttctaaattgtatttctatatggactctgtcttttctttttctccgattaatgtgagaatttctaggccatgagagcgaacgtgaaggctcctttttctattcctttaataatataatagattccaaaacatatgatatgatttaatcatttctttaaaaggtctttatagtaaattttcctatataattaaaattctctaaaatttctatgtttttccttcaaatcaaagggacccttcaaattaataaagtcatcatgaacgctgcattatcgaatggtacatcacctacttataaaaaatagtcataaatatgagcatccatattaaatataggacataaacctgaatggactgatttcatcacaaacaacctaactaattgagctacgatcaatttgtatttggagataatatttgacgttgagcatatgatttgatgaaaaatgttcaaactttgatgttacttttatatcgaaataagtttataaaacctacatgtttttctaggactaagacctatatattatggtgtttttcatggtaaatctagacagatcattttgtatttttataatctacggggctaaaagtttatctcaaaatcgtcctaaacattaaatatatatgcttggagccttagaggtagtataattttcataaaattcctgattccaaactagtagtagtgctactactcaaattgtttctccaagtgtcatgtcaatgggtggtgttgatactagctagactcgccaaacctacgcatggtctctacttaggttgagagaaaaaaacatttttcccgacgtaagggtctttttttcgcagatgaacatgactagccaaaatgaccgcctaaaaaatataaatcggcttgtatcttctcacggctttctttacggttactcttgatgcaccccaataactactgtatagctagattttgtcgaatttcatgtcagctggtttggcttgttttccaactatggctagcctaacatcacccctgtcacacacaagatgttacccccaccctacggccagttgtctattttgtcatatgcaatttttagccccgtctctcctctccatgacaaacggcattagcagagtgataataacttactctgtcggtttcatattataggtcgctttgagttttttcctatttttaagtttaagtaagtttatagaaaaaacattttaaacaccaaatcattttcattaaatctagcacggaatatattttggtaatatgtttgttttgtgttaaaaaatacttctatatttttctataaacttaatcaaatgtaaaaaaaattgactaagaaaaaaatcaaaacaacttataatatgaaacggggaagtagacaaaatcagatcttctgacgcattgtcaccatgatgtcgtagctgacatgtggactctagacgattggtctcatatgtcaatgaccatatcacctataggatgaatatcatgttcatcgaaggacttatgaatactgtattaggattatgggcaaggaaaatgctctggtactatgtagcatatatgactataagaattttatagctaattataaatctagttcataagaaaaaacaatatatgtaccgatagatattggtaatttggtacatagccatattataatacatatatgcattatgatttatccatttaatacccagataaataaaaagcacaataaatataggcatttactttttttatcatacataaataaaaaaaccgtgttcatttctttatgtaacactttcttccaatttgtttcatattttaggttacctttttcattttaaaaattctcctataatctaaataaaacttttagtaaatttcacaaaactacatgtacttttagaggtgaaaacggagtggattcagacgtatagtggtcataccatatcctaaaccatattttttaagcggattcagagcgggtgcagatagtgtacggatgcggagcggattgtttcggatgtcggaaatgatacggattcggttcggaaacggattaaatttatcggatgttgcgtgtgtaatacaacatcgagttagcaatgcaaagaacaataatacaataatcaataaacgatccatcgtaataattatgtgcttaagtgttaaacagcatgaatatatgatgttcataatataaaattacagctacgcaagtgtgacatgaaacggtgaaagtctcagactaagaaatctaggttaattgatgggttaggctattagatggaccaacttatgttatatgctatagataaagtggtcgcttgcgttgataattttggattatccggcaaacggtctattggataatccgatgaaaatatcggataattagtatccgccggattttagagataccatatcctcatccgcatccacatccatatccgctggatatctaaaagaccataccatatcctcgtttcaaacggattcggagcggatcggatcggatattatccgatccgttttcacccctaggtactttggtcaaattaccacaaaactataaatttaacatgatatattacaaatttacatatttaacgctaaatttgtcatagaactgtagacttaagatagaatatcgtaaaactacagatttaataacaaaattatcacaaaactatatgctgaatatcaatttaatcacaaaaattggacatttataactcaaaaataaaattaatgctacggatttaaaccccaaaatctgtagttttatgataattttattgttaaatatatagttttgtaatacttagacttaaacctgtagttttgtgataaatttattattaaatctgtagtatgataatttgaacaaagtgcctgtagctttgtggaatttactctacggatttaggttacctagttcttttacaacacatgtttcttcctccatgcaccctggtgttggccggcatgcatctttgatgttgatgggtggtggatacctttaatctcctttcattttaggtcctgtttggttcgcgggacaaaaagtttttggcgtgtcacatcggatatacgggcacacatttaaagtattaaacataaactaataataaaaaaaattacaggttccgcctgtaaagtgcgagatgaatttattaagcctaattaatttgtcattatcaaatgtttactgtatcaccacattgtcaaattatggagcaattaaacttaaaaattcctctcgcaatttacacgtaatcggtgtaattagtttttttttctatatgtaatactctatgtatgtgtccaaatattctatatgatagggtgaaaagtttttgtttactccctctgtcccataatgttgcaacctaggatgggtacgaatctggacatgcctcatgtccagattcgtagtcctaggatgaggcatgtccaaattcgtagttttaggatgggtctcatcctatcctaggttacaatattatgggacggatggagtagaaactaaacaaggccctagtggccagccactcaggtgccggtgcctagcaagcattgactacatacatagggttgggaaggaggtcgccatgtatgtcattaacacccaaaatcctaataataaagggtcactatttgctaattaatctgagaaaaggtgtggatgtcatcatgcgttgttttatgtatgtagttaatgaccgactttaaagtaccctttagaccgggttatgtttggttccgatatatttattagattgcaaaatgacaaaacaaagtcaaatcaaagagcggagctatagtgcaagaggggatgcctacaactcggtaaaattttttaactataatttacctgtttttcattatatacgtatccttctaatacaaacttagtcattcatatcagcttaaacttatccaaagcagagtaaagtttgcgggtgacaccccctcaatattttttttaaactacccctcaatttcatatacaacaaaaaagattacaaccctaccattacaagaaaaaaaccaaataaacatatgttaaaatagaataatgatgctgaacccataa

SEQ ID NO: 21701 - DNA, 4583 bp, Oryza sativa
  unsure (1)..(4583): unsure at all n locations
ctgtttgataacaactcatctgcccgccgccgctctagaggatcccctgagtgatgacattgtgaacgggataaccttaaaaagaacgaggaagaccctgtttctttcagcttgggattattataatccagattattgggagtaagctgaaagaaacagacaacttattgaagtagcttattataatctgataagctcatttaggtgagctttttccagattattgggtgaaaaattacccagcatgccaccccactccctctttagactggcaaacccaataatttaggctctaataatctatgaaagaaacaactaaccacttattctactacagattataacaatctagattagagtaatctgactcaataatctagattataataatcccaagctgaaagaagaaacagggcctaaaagactctaaacataactctataaacttcataaaagataaatcctagactactaatactcaatagatttttttcctacaaaaactttattggaaaatctacaaacttagtagaacttaggctgagttctttcttcactttcccaactcacgcctctcgttttctgcatgcacgttttttaaactactaaatgatacgattttttgcaaatttttctagacggaagttgtttttaaaaattatattaatttatttttaaaattattttagctaatacttaattaatttacattaataaaccatcagtttttccttgtgagactaaactctaccttctgaacagagcccaagatggattgagagatggcatgcttccctcttgcctctagcaagaacgcccaaggcagaggatgggataaacggatcgaaatggtgacaaaaagtttcgagacgagttgcgaccttggtaatttcgtaagaatcgtatatagacgagaattttttttaaaaaaaaaatctcattttccattgctctaatcgaaattcgataatcacgtctatagtggtcctactgtgcgaaaattaatcatagagatgcaaccagtcattaaccaagataaattgcaaatgatacggattcatcaatatgtgatgtgcaacacacaccacccacctccaggtaggcccggcccccacgagcctgatgctactgattattaagaatagagttgacaagatccttatctgtttggatatatgccctaaccttcgaagcaagaacataatctattccacgtagcaaatcatttttattccagggacaatgatgatatctctttcttttcactatttctgatctacactagaagattaaatacgaacagttttgatttgatttggacggcccctatttaatttggctctggaactgtgttaaatagtaccgtagtatgaaaaatatacgggatcttttaatgtggtcgatctgtgaggttctttgaaaaggtttttattagaaagagaacacaaccaggacagaattttttttagaaacatagtacaaccacatacgctctccggaagactaggtcggtatatcttgaaattgatggagtcactgcggatgcctctcgctagatatcgactagtatgtcacctagcattgaaagaataattagtagtaaatataagcaccagtcaaatctataatttgaatctgggtgggctggttctaccgcgagcaagctaaccagttgagctacgcgcatttcgcagctgaaacggaaaattatggagcaaattttattatcggtgctaattaatgacaagactgatcgtatgtgctgatgtaagactaaaaacacattaattaaaataatcaagatgggaaagcctgtatgtatggatgctcttaatttggtttgatgtcttggtagctggttgctggtagatttgagttgatagagtgccaggaaaattcgatcgatctggaggttgtcatctcaagatcaatgataagttggtttgaatatcctttgcacagtgacactctaaaagtgacctttttgccaataattgctgggcaaagacaagataactagtattccctccatactcataaaggtttaggataatatttaagtcaaaccttaagaatataaattatgaataactctcaaattattaagtttgaaaatataaaaattatatgaatagatttatcttgaaaaatactttcataaaaatatacatatatcacttttcaataaatatttttatagaaacaagaagtcaaatttgtgttttggagatcgtgtcgctgtcttaaacgacttcctttatgagtacggaaagagtactcataacagggctcatattgaggttttgtactgatacctcctgttgataacctagagagatcgtgtatgcatgtttctgatattgtaatttaggcaatcttcactctttttaaaaaataacagccttgctaagaagagtgacaaccataatttagataatcttcaaccaaaagatataatttttacaattttttactagcttgatcatgaatatgaccaattaagttttctttagttacactactgcctacatttttttgtcgaccataactcttaggctctgttcgtttcctggagttcccaactcccccatctcattttccgcgcgcacgcttttcaaactgctaaacggtgtgttttttgcaaaaagtttatatacgaaaattgcttaaaaaaattatattgatccatttttgaaaaaaaaattagcaaataattaattaatcacgtgctaatggactgcttcgttttccgtaccggagggatgggttcccaactcaaccaaaagaacagaaccttaggctgcatttgttcctttttgttggcaactaatctctcgcgcaagtaaaacagaatgactcattagcacatgattaattaagtattagctaatattttaaattaatagattaatatgattttttaaaacaacttttatattatttttttcaaatacaggagtataatttagcggtttgaaaaacatacgcgcgaaaaacgagggatgtgaattgggattcaacttaagaacacaacctagtacctatcagtgccttccttcaaagactttagtacttcttttcgagtttcaatacaaccttttgtgatatccaggaattttagataatggaaatgtatattacgataccgagacatgtatatatatacctctcgatacctcctagccaataggacaatagagtatttctctattgcatcctctcaataaggaccgtaattactctcttgcaagtttagtatcactatcttttgttttgattcatctagatctgaattataaataggtccttggaaagttacaactcaccttagtgaagttacagctcaccttcaccagtctcccggagcaagaagttattaattattattgcaattgacatggtccatgtgtaagagagtacctaaccattaatctctcaaagcctatgcattaacaaattcctcgatctacatattactaacaaattaatcgcacatcacatcatccactctgcatataattgaccccttttacggaacactgcatactggtgatattttttgccacttttgaaagttttttgttgttgataattaattattgagttaatccaaaagctcaaattgattgatggccaggcaatccaagtgtactggagtacatcagtaatgactttcccctagagtcaataatctcagccgtccaaatgaacaatcgaattgcttgaaaatgtgcagtacacaaggcaagctgtaatcactttttttttccttaaaaagtttttgtgatgtaatggagtacctccccatgtgctaatcgccatggtttaagcaccgggttttacgctaattgaggtggtgcgccccaattagttgtcataatcattatcataatcactaaattaacctctgcgagttgtgtgaaacgcaaagacaagaggaggaatacactacatatctgagtcggaataaactatatgtgatcagtgggggtgtacactctggaagcactactagtgtatagtatacatatatagttttatgtaatgtttggatatgtagctagctaacaaatcaacaagttatcatcaatccacttacatctgacaccccccccccctaaccaacatgccacttctattcttttcttctcttgtctcactatgattctgaatgttttcttcttcttttgtctcattgtgtttctgaatgtgttctcaatttctcacagtgtgttctgaatgatctctctgtactccgatccacccatttttcagtgcttggtggatttatgatttttatgatcctcggaaaataatgcactataatgttaaattatggtatcgctcagtatctcaacaccaaaaaaaatcaagagaagaggatgggtttaaagaaaaatatggtaacatctacatgtctcggtatttggaacgggtggtaagaggatgttttaacatgggagcagtctaatctacggattgatgattcttagtatttcttggacattttttttattataaaaactagcgtgtgttaggaaacgataggnggggtgttaacgatgtagttcaacaaagtactc

SEQ ID NO: 21702 - DNA, 6953 bp, Oryza sativa
  unsure (1)..(6953): unsure at all n locations
ngtctaaagaagattgtctatccacggagttattaaaagcaaaaaaacagggaaggcctgggaagacgaccccgaaacgacaaaggtgggttttgtcgaaaaggaaaaatttgtcgttcggcgaagggtgggttgctcctcatgctgccgcgcttgagcaaaaaaaagcaattatactatggcaccgacgacgagtggctccggtggtggccgcaggaaaatacaaaaggccggctagggaggaatccgaatatctccgcggagatggcgagccttctagcaaagatggtaaggatgataggcgctcagagcatccaccagagtagtggaactcaggccgacatgtcattcgacgggaacggagcatcacagcgccatttcagctagacagagatccagacagcatagggtggtagcgggtaactatctcagtaacctaagtaccatagaacaagtcgttattagttataatcaaagaggagcttgaatacatttgaccgagttacatataaaagtaaatagtactacaatatcagaccagggcaatgagcaccccgcacccccggacgtccccaggtgcacggcagaagctggcctttattaaatacaaatgaatttggatcacaactcaacagcatgcagggtgtgcatctggttgtatgcatctaagttatgtccttagtatttctcaacattgttttataattttgatgtaaatgattgacaaaaaacttccatgtttttttttaaaaaaaaatctgtaaatcgcctcgtatctgaatggaaggtatgcaaccaagagttcggtgctgaaacaaagctgaagggatgcaaatttcacaatttcacgcgaattaagatttatcaattaatctcattcttgtctggtacgaaaagtcgaaaagtgcgaaaagaaaaaagagcaaaaaatttgccgtacagacaaattaatccatgagcacaatgcagagcatgcatatgcatgtgagtgggcatttacaagtgcactttttgttcgttgtggaggagtgaaggaccggagagaggacctgatcttgcttggaaagttggataaagatgttggatctcagatcttggatattgctgtctcatatggcttcaaattcatgcgtcctgctcctccctacacatggcaattctcaaggaaaaaagtttccaactcctacacatggcggtcacatggagatatataaatttgcaaaattttgagaaattctgcatggtatataacttacaaggtcaaactaatggcaaattgcagacatggttttctgaaattttgccccattgtgcattccgaaatgttttttacagggtgcactgttcagtaacttttgtaacaaatccaactcgattttttttagagacgaatcaaactcgaatttgaatttgttcatggaaccaattatttctgcagctttgctttccagaaacaagtacacacagatagagtaagattaacttctgcagattgttaatttggtttgtctgtttctaataatcagtgttttgtttgattgtttccttcgacgcgagtggacgcatatgatgcaggcctaactatgttcaatgttccaataaattaagcactttttaatcaaagctggtcggccggggacggcagacaaaaatttgatgtttgaataggatccgaagtacaatcataattgctcatatgttcacaagattttgtaaccaaaaggttaacatcaaccaaattcaactccataaagtagcactaaggataacaccaagggtatataaattattagcacatatatagtatggatggcacatcaatttgtgcgttgaatatgctttgatgttgacaaaaggatgagttagaagaaaacctttttgtatcattgtatgcatgagtgggcatcttaattcatattggttggaatttttggctctagtggcacaaagcatgcttcatagtgacttcaattgttccattgggggcgtaagaaaagcccaatggataaaaaggtcctctccccactcgcaataggtagtagaatatttgttttattagaagagaacccccaattttcatatggtgtaaaatataataataatatggccatgtggttgctaattctgcacttggaaaagcaatttcaaagatggtgaaatgcgaaaagaaatgttgactattgaaggcagcctatggctatgctatcatcttacctctcttatatatgatgaaatcagataacctcatatatatgctttcttgagaaaaaaaagaactccttcttttgtaaaaaaaaaaagtattgatctgtatgttcagacatctaagtgcacaaacattaacagcgaatgactattaatcattcaatctttgcttttctgaatatttgtttcataggataactcaaaattatatgcaagttttgatgcaaagcttcatctgagagagagtaaaacaacaagaacagatatatcaagctcttcagtgaaaatggaaacagaagaactacaataatcaaccctaatcatgacaattccattgataaaaagtaaaacatcgttcttttgcagaaacatccattctcaagttccctcttttatgatcttccccttgtgctatgtcggcaaacaagagaaacaaactaaattaaagtcttttgtttcctgtaacttttgggtagtttcagaataagatacatagctattcttctcttgagcttgaagatgaaagattccatgccagaactttcttgaccaactaattaatctggactttggtttcattccattccttattccatatgagtacagtagtacactagtactggtctcctttcctgaaaaaaaaagaggagattcagaagttcagaacaataggcaaacaaatctccaatctgtggttgacacgtcactccttcctcatgaagtcaatgggggtgagcatcagcaagtcatgtgtgctgcatgttgtaggtagccttgaaggaaagcagttggattggatctcattttagtttagggcaggaatgcataagcccatttgttgtgtcatttattaagtttatactacatttcaacatatagttaatgcaaggttggagttgaaacaaactgtctccttgatcctaattcctgaaacatgtatgagattttgctcatggcatatgcccatcaggagtagtgcaccacatttacatacatagtacatgtggatgcaactcaatggaattttttttttttgatatttggattcatttgtgacccgaaaaattttacgcatattttcaatcatgttcaaattcttcagtaccatctgagtgtagattttacctgtaataattaatcagaaaaaaacctacaaaattttgcagtccttacatgtcttgattaaaaaaaacataaaacatttttgcgttggcatggatcgtatgtattgcccatttgagggttgagaccaagaaagtttcagcatcgatacactttaaattccatgttggattcttgaagcagtccattagcacaaacaggcttgtcattagtggaaacttatgtcacatgaactagtaaaactatagatccaatcatacttccatgcaaacaatgacccaatagaactcagcaaagtacagattatacaatcccaacatgaagcaactgcaactttcattcctcgaatcacagatggctgacacgactcagttatagtgcagagcacagtacaacttataatggtataacagtagagtaagatgtttcaagcaatttgtccatgcaaatcgtttattcatagtactcagttcatatagctctggtgacacccaattcagactgattgtcttagttctgtggcaccgaaattatatgtttttcgatcatatccttcatgctccagttagtgtaattattattattattataataatattattcttgtagctccagaaagcccaaccaaatgaggcctgaccatagacgtccatctgcacatcagcaaaattcgtgcggtcatcgtcgtttgcaccttgcaccccccattccgtagtccattcccctgcacatttggaaagacttcttcccactgtgtcgtcacaaaacagcctgtccagcttcaccaaggttggtcgctgttgctcattgctccaaatatatcttcttccaaataaatacatctcctttcttgctgcgaagtattcattaatcagcgattgtttctagcattgttcttgtctacagctgaggcaattaaattgaaatcccctgtaatcatccatttcccaggtcaagcttcccggattgttgtcatttcttccgggaaaagcagcttctcatcatctccttgcggcccatacactgaagataagtaccagttggactgtcacagaccaaatcccagcgtgcaccaagtccccatggaaaatatcacctttccaagcgattattaacaccccccccccccccccggcaaccccacccccaacgtgcatgcatcacggcgaaagagtctaaactagggccacaatgcttatagatcagcgaagcatctaacttaattagactcttaaaaacaaacaacagacgcaaactgaaattttgaaatacatctacttctgcagcatcttgttttatgtttctttcatttctggagaagttgtaacaagtgatgatgacatcctgtgtttcaggtgcgccactctgccctcttcagcatctactctaggtataatttgatgaggttctggatcgagtatcaatgaataaggcatttcttctttcaaaaaaaaaaaggcatttttgggcgatgaatgcttctctcggcaggatgaataggcttctcccacatgagtagatgcagctggaaggagcacaatgggtatcggctcaaggaaagcttttggctgatcgagagagtgtcaaagcagcggattgcccctgaactagagatcatccagggcaggaccttctcattggacacccttgagatgaccagcaatttcgatgcctttcttgccccggttgaacagattgtgcatccctgaccgtgttgacggtgtctcgctgtcattgtcatcttgcaacactgaagatatgtagataaaaccctgaaagaaacattgtgtcatggaatgtttgatgtataactcttttgttcttaattgatgaagcataatattgtcgatattctggaagtggcgacagaaagcttacctcctcagtacggctgattgcaaatcctagttttgtgtcacctactttaggagtgatctccagtggcatttctcctcctatggagctgtaccaaagtcgggctgccttcaccacctcagtgttatagccttggtaatcctccaaggttgcatttgacagatcaggcaacaaccctgaattgacagttgcagatgtggcgtctccaactctcgatatctgtacattatggagagtgaagattaaaaccatgtagaatcaaaccaagtcgaatcttgtgtgagattatgtgtccatgtgtaatgcatgaaattgaaatcttgtatctgcaccttggtgagaagatcatcactctgcacactcatcaacttgatggggacaccagaggcctgcgaggcatagagccatgtgttggcacgagccaaggtgacctcgaaggactcgtatagatgtgacttcatgtccaacgccatgggtaggacaagcattgagaggtagcagctagaatcaggcatgtgcaccgagtcttgcatattccccttcatggcatatgagatgtatgcatcttctgcctttcttggtgctgttgcaagtcttgtgcctccatggattgataaggcacctattttgcataggaaggtcataaaaatttctcaataaagtggattaaaatgttccaaattcatagtacatgaaatttcagtcaagaattgttcagaagagttgaatttgttaggaaaacatgcatgtgttcattttaagatgacagtaattgcaacatgacacatatcaccacatttgctcgcgaaacagccaacacattgtttaaataaccagaagcactgctaaagtaacaaccacacgagctaggtcaatcttttccagtggcatcattgacatcttggcttgacccccaaccagccagagtgctcgtgattgatgttaattgtcaatcatggtggtcgtaaatgtagctagatcaaagacccacaaatgttccaaggcagaccaaatcaccaaatcagacaacagaggcataacacatgcactagtgagtgactttgcaattcttactgggcgtttttttagtattaatctgtggtacctcctggtacctcaacactatggacataccaagaggtaccttctttttttttttcaccaaaagaggtactacctccatcccataaaaattgaatttctagggaattaaggatatattagcaggatagacaaatgactacagtaaccctatttaataaacacaatacatgcacacattccatatataaacttgattaaaaggaatgttgagacaatgggttagagatgggatggaaggaaagaagattacaaggaaatgtaatcagtttaatgggtcccacatcagtagaaatataacttttatgggacaaaggttcaaaggtaaaatttcaatttttatgggacggaggtagtactaaattttatactacagaatgtgtcaatgtggtacctctcggtagcaccttgaggctaaaaaggttctactttacacgagtacttccccaccgacaatatcaaaaaaagatatatggcatacatgttcaactcaagttggagcatgggaaaagaaatgttagaataggtataaaaattacccctccctattgcagttgaaaataggtggtagggggttaaggttaaaagccgtacttttttaacccaacaattctttttaaattaggggatggcccccaaatgtatttttg

SEQ ID NO: 21703 - DNA, 1401 bp, Oryza sativa
  unsure (1)..(1401): unsure at all n locations
cgtcatctggcattcttgggcgatcaatgactaaaacgatcggaaaggtaagtcgtcgttccgctatattgactancttttatancaagtagtatcagagcagaaggtttcagtattggatcaagaagacatgtggaggaggaaacacgaggtggggatcacgcatcagcaggagattgtcagctgtgacgatgagatcgatggcgacaacgaggacgtcgcggaggcgatgaccttgctcgcgatcagaccggcgatggcggaacgtgaccggaagacggggccgggcgtggccaaaggcgaccggagagatcggaggggtagcgtcatggacggcacgcctgacgcacgcggtggtcgtggatccgcagcggcaaggaggctagcggcgaaagggcaaaaccgacgagcgtggcgcagcgcggcagacgtgcagggccgatggcgacaaggtcgtggacagtgaacacgagggctgcgactgcggtgcgtgcggaggcatggacgaatagtacgaggtattgttctttgcgtacaacttggatggagtcgagcacatcgcatggaaatgccttcatgcgacacgatgtacacaaaatcatcatggctgcatgcactaataaagagtggcctgtgcaaggtgatcatgacatgttgtcaagcacatgcatatactacattgctgagattaaagcatgggaggctagatgaggacgttgaggcacatgggtgtatttttgcatgagcatgatgcggcagggtttttgctatgaggaagaggtacgtgagcaagggaaagcagaagagacccaagcagacacgactgttgagtggtttctgtttatgcggtcattaaaaccaaaggtgtgtacttgaattgagttagactcggttgttggaacagaatccgacgggaacttgggctcggtaaagcagaacctaggaagattcgatgcagcagaactattttaaatagagaggggagcaccacaacgtaaccatggcgactacaatgcagcgtaaacacgcagggagatgatggcggcgtggccatggactcgtagcggttaggagctacttcctccgtttcacaatgtaagtcattctagcattttccacattgatatctatgtgaacgaatcttgatagagatatgtctagatccacataacataatgttaatgtgggagatgctaaatagacttacattgcgaaacagatggtggataacagttggggaggagtgttcataataaagccccggngatgtaagttttgtgtgaccctgtttacaaatattggtgttcctatgacgcatttgggatgtgttgggcgaacaatgacttgaacgatcgggaaggataggtccccttccctatatcaactacttttttaaaaagg

SEQ ID NO: 21704 - DNA, 12182 bp, Oryza sativa
  unsure (1)..(12182): unsure at all n locations
gcgtcgattgaattgcgcttgacacttaccccancccannacaatggggtgggaactcaaaatatgccactacgtagcattttttattttttagaacaaaattcccatgttcttcatccccttctttcatacttctctctctaggtggaggggctgctgatagccgacacaagcgagtctaccatcccgtatcgccctgtcgcctctccatcgtcgagttccaccgcccacgcgtttcctcgtcgccgagttccactgtctccgcacctccaatgagttgaacgtagcagttagcactctcgggctcctcaagtagggccgatgtagctgccttcgtcgaatgtgaaggtgtgggggcgatgctctgggatttagcgttgctctcgccagtggcaaatcgggccgtgaccggcgagggtgtttgagcgcaacagatccaaccatgtccgggtaaggaggaaggtggtgtggatccgacgcgacgaagattgtcttctccctcgttagagtaggagcagctctctctctctctcccagtgagctgcctcttgctggtgtcgggcgttgctccgggattcaatgtccatgctagggcaggcgatgcatatccgatgacgacggaggcaagggggcttggatccgcgtgctcgtcgctcctccccacccgcctcctttttcatctggcgacaaaccggtgcatgagaccactcccagcgtgacatgctcgtcgcagcgtcagcgagatcttggagacggcgtgtccagcaacagctcagtacggcggtggcaacgagctcgtcgcagcggcatggatccatacgatttgattttttttatggtgcttgattgtacgagatgtaggagacgtgatattttagtctaaaaatacggtagaaaaaaatgtacaacatgtcatgtatccaattttagaaatactgcagcggcatcttttcaattagtcgaattataatcttataaatttcaaaactagaaaatccaaataacctttgtttttttcccaccaccaaactctggtaatttatatttaatatttttcttattactactaccaaactcgaaaaatatttattttggcaagaaaataaaaccaaacatatccaatattccaaaatattactccctccatctcattttatattgtaagactttttttagttatctagatttatctactgattatgttttctatatatgcctagaatcattagtatctaattatatgaatttacgtaatactagaaaatcttatatcgtgtaacggatgaattacggatatacgtacagacagtaatagaaagaaagaacttgtcggtaaataaacaccacctccctctgtccaataaactgtacggtaataaccagcttattctccattcctccgggaagaagaagaagaagccggcgactcgccattgattccgggcgccgccgccccgctcccccctcgatcggtcgatccggtgatggggctgctgttcgtggagctgctcccgcggcacggcgacgggggaggccccgcgtcggcggtgctcaagtgccgccggtgccgcgtcgacgccgccttcgccgacgccatcctctcacgggacttccgcggccgattcggccgcgcctacctcttcgaccacgtgtacgcgtcctccctctctctcccgcttccgcattgcgtgtgccttgtgttagctaggcggttcttgggatgatgatgatgatgatctttggcccaagggggtttcgttggtggtgggggtgtgttcgaatcggatcttgcggtggtcgattcggccttcgttttgggatggaaatcgatgtgggattggattgctggaaatgggggagaaaagaagctttggttgtgccacaatgtggatggattctgctggaattagcttgcatcgctgttgtcgtcgtggtcttctcttagattattattattattattgcaatgtcacaactgaagatttgtggtcggatcgatcgattagcatgttcgggtgaatcgatttgcggtatcaaatggatgttgttcaagccttcaatgtatcaagtttattagctttggcccctctggattgcctgcaggaacggacaccgatttgatgaatgatgggctcagccattgccattgcctccttgggggtggttttcttaagaacttggtagtagcattttgtcttgttcggatcattgcccttgatttatcgcctaatatcactgcgatccccatgctgttttctcaacctcctactgtatttctctacaagattgaccaccttaataccagctcaaccatttcttcagtgtattctagagctaattttgtgatactgatgtagttttggcttcaacaactagttttcacttcgaatcatggcaatgtattcagcttatttgtagaatgtttcacttcgaatcatgggaatgtattcagcttatttgtagaacgtttcacttcgaaacatggcaatgtattcagcttatttgtagaatgtattcaatatctttatgcttttgttctattcttttcagggtgaatatatccttagggcctaatgaggatcggtatctgatgaccggactgcatacggtgaaagatatctactgtagctgttgccagcaaattctcggctggagatatgtaagttaacttggaaatttgcttccatgatcatataatagttgcctcttatgcagattagatatgtgcattccgtggagaaacttgtagaatgttgcattctgaaaacaaaaaagttggatacaaacatgagttgaacaaacagtggataggaaaataggagtctctatgcttcttttcaccctcttctacagttctacttgtagtatttcttccttctactccaacttaaagaattctcagatttccataggctcattgtcctatcacataattagttgctaccttagcccagactttgcattagccacatcattttgtctcagtttgttatgtaattttattctcattgcgatcaattgataggatatgcatgtatctcaaattcataatatgcttggttcagtacttcagttggatatgtaaaattttcagattgatgtctatttttcagatgtgaatggcaatgctaccagtcaattatagtcaacaaacttaacatataaatgtgcatcaaattcagctttcaaaaatattatgctttgttttaggctttctattgtaggttaggcctacacttaatccataaccattcaatataataacaaagtcttatgtttaatactcccttcatcccaaaatataagcatttccggctatgaatttggaaaagtatctgtccagagtcatagcgagaagtggacggagggagtagctagttttgcatttgatagatgaggactaacattttaacaaaatacaacttgatgctgaaacatagtatccacaaaacactagtgtaggcctgtggggcctcctatgttaccagcacgataatgtggccttctatggtactaaagatttagttgctgtttgctgtggaactggaatatgttgggttagattctgtataaaccatttgtttgccttcatatctagctcatcattgcaactacatatgaactgtagttttctagtaatcctgtgtaataactgcattatacagctattttctcatctgaagttctgtgttttgtgacttccagtcaattttgtatgctactattctaagccctatgtcccatgaagattcaaggcacagatcctgcaagtcgtttagaaattttgcattgttcttgtacccattggttccatcctggcatttaagggagtacatcaactgtatttttttttattgcagttacagtggcatctttcccttaattaaagttgcttgaaccgacctctactgaaattcactttgtttaataaaccctgaatgtggcttatcttcacctatatgctaagttgcgcatctaaggttctctttcagttgcgtgtgggtaactgctaacttctgttttttttttcatagcttctctttcaatttttcataactgggagaatttatgtgtttgtgacatgtactcacccattcatcgtacgtattagcaatgcaataactttgttctggcatcaatacagctcatttaccatattatctcgatgtgacagtcttcagctcttaacactgcttcatttgtcacctcattgttttattttctctttttggattgttaatttgcacctataatgctctacaggagaaagcatacgaagagagcgagaagtacaaggaaggcaagttcatcctggagaaggccaggatgtggaaagaagcccggtgaaaaagactggcgccatggaactcatcaacctgtatgtatgtattttgtgtagatccaaaacaattcaaagattgtaacaacaactttggcggcgatcaaagtttgtatgcatgctgtagttgctcatgcagtactagaccccctcaaaagaagagatgaaaacagctgcgtctgatttgggggggacgaagattgacaacagaagtagagcatcactgtctttttgatgcaaattctggcacttcggtggtaacggttttaaccgaaaaatgatgaagtgccagagattaacatttgattagtgcttttggccactcatggcgcagttcatttcacactttgttgtggattagtagtactccctccggtttcattttaattgacgttttggacaatggcacagtctacaaaatgtacctttgaccttatttttctattataatatacacaataaataaatgcatgtttacttttataatagtgttttgaaagacaaatctatatatgtttatctagttttttttaaactaagtagttttgaagttattgatggtcaaagttattaaagtttgacctcaaccttgttcaaaacgtcaattattatagaaccggagggagtaattaatttcactttcttgctcacctggctttaccattcttctgtcggagtttggattgcaacctgaagattggccgagctgtatacgacatacctacatgcaaatatgcacaaaacacatacttgagagctatagatctaattgttgactatatccattgctaaataactcccaaacaacatactccaagcacattggagaatccgataatttcctcaacagagccccgtgtggccatattggaaattccgaagtgtatatcagaattccgattttttctttttgtccaactaaaccacttgtgtgaccatatcacaaattccgatattttcttcaacagagctacagaacgtcattttagatattccgacataacattggaaattctgatctattgaaaattccagcaacttgaaagttttgaaaggaactctgcaacatatttgagcaccaaattttcaacgctagatttcgaagtgatatcactctttatagtagagcttttcctatgacacaaataagagaaaaaatttaccataggagtttttcccatacacttttcatttccaattggatttgctgaaaccaatctttccataccatcaaagggctaaattcactgtgcacattctcaacaaacttgttagtcctccctattcgattgccattaactaccaaaataattaggggtctagacgcactttcaatctccctttttttttgtcgatcacaattcgattagaatgtaataaaaagatatatgtaaaaagggttttgggtccaatgatagaagtttagctcccctagaattgtgcataataggcatgtagagagctcccctaaatcttcacataagattgcttgaaagtatatatacatgacatagcagcattcacacatatgggctagaaacgataaataacattacatcacatagtttgatacaccacatatgcattaagttgaacaaatcttaaggaaataaaaacacacattgtctcatacaagcaagcccaaatttgtccgaccaacaacaatgatagatggaaaagagatgtggctctcccccctttggcatcgaggaccaaaaagagataaattaaaattggagagagaacctaatgccatatggagtcaatcatcatgcccatcatcaccactatcaccatgtcccacaccttccttctcctgaacgacaccactactagcttcgtcggcaaagggatcatcgaacacttcttcatcactttcattgacctcggagccatcgggggagcaaggaaatttgtagtctgcttcttcaattccgctcgccccttcctggcttcgatggcgttggacttgcacacattatagatagacttgagaattttccacaacagtgaagaagagagagtcggagtggagggagcttgagtacgtgcagctttagtggtagaccttggcctcctaggagtggtcatgggtttctctagcctcactttgagtccagtgtggtgcacctccttgtagaatcgaagtttggtgacttgctcaatcattttcatcaatatgggagcatagccaagactccactcaggagtgaaagatgtgaggcgaatctcctcccaaatgaactcaaacacatcaaatttcttcggagaagccctcatccttgcaagaatgttgtgagtgtaagattggacattgttgtcatcgtcatccttgggagtgagtgttttgcgaatcatcttgttgagataggcaaagaaaggaagcataccctttgttgtcccagggtcgtactccaccttatgattgtacatgaagtcaacctcatgaggctccaagaccttgtcatcatgcaaccaatccctgtcttcatcatcatcaaaggtgagatccaaaagagcagcgaattgactgtagttgatgcaatgccattccccctgtgtcatccagtgcatggtctttttcttatttcctttggtaccaaactgtggcatagaattgacagatgatttcctcactccaatcatatctcatgctcatgaaatccttgatccccatggcctcacaagcctcaatcacctcattcatcacggggtcgccataagaggcagcagctctccaattaatccactgcatgttggacttattcatgataaccgcctcatagaagtcttgctggaaaagagtccaaaaacaaggatcggtggctgagcggcatccattctttgggatctccactctactcatccgcactttcttagtcttggcactccaatctatggggttgcgaacatgttcagcacttcgagcggggaggtgcacgaacaaaggactgatgagagcacccttctccctacattccccacccattgtcggtatctcctcttgtacctcaggttgggtactagaactagcacctgcaagacttgttccaacggtggtagctttcggcttcctaggtgccctccttttcagcaaatcaccacccctttccacatttgcgacttgagtttcctccttccctttacaatcaaaatcatcaccatttgactccgagaagaaagatcgaacccgtcgccgcttgccattctaagtcttgtgcttggtgtgggccatgaagctctccttggaacgagtggaatagcagaaattttgatccttgaaggcccccttgagcatgaaagaacactgagtgagagtgatgactgagtagatgattgacaagagaattgaaataaaaaaataaaggctgcttgaactggtctataaacattggacattccaataagtgatcagaatttctgatcgcttcggattttccaaaaagcatcggaatttcatatcgacccgatcggaatatacattattttcagacatagcccaaacaatctcgacatctagatttatagccaacgaaatcaaatgatactctaggcaaggtttctatacgactatagcaacatcttcaccaaaaggatttgaaagataatccctagaatcatagatcaagatttggacaagaaccagggcaaagaaggggcaagaatacctcaaaaaagagagaaacacgccttggtgaagatgctggaaagtggatgccgaggatgccaacgaactccggcaaaggcttgccggctcagctgagagtttcccaatgaggatgcaccaccgaggttgcctgcctgagaggagttagaggagagtgagaggtggcggtgaaaactgaaagagtgcaagaatagaagtgaaagggtatgtatgttcagttcaggaaaagggctgagagagagacattgcactttcggaaatttctgatatgaactttcggaatttccgatcaatgtaaaggatttctgatctgtgccgcgtggacgccatcctctccagggacatccatggctgcttcggctgcgcctacctcttcaaccacgaatgtgagcctcccctcctctctctcctccaccccttgctcgcgcattgcgtgcctagcgaagcgattcttggatgatcctgggttcttggccggctggccgcaggttctgttgattggccgtggtggtttggaatggaaatcgccgtgggtgcgagaaattttgggggattggattgtctggaattcggggaaagaaggtttggttgtgccaatctgcatggattctgttggagtcgtggtcttctcttagattattgcaatgtcacagctgcagatttgtgttcagggtcgattagcatgttggactgaattgctttgcaatatcaaatcgattaggccatgatgtaaatctgttgcagtaacagatatcgacttgattttgttgttgacatgcacatcggtttagatgaatgattgcctcagccattgcctccttggggtggtttgcttaggaacttggtagcattttgtcttgttcagatcattcccttgatttatcgcttaagatctcaccacgatccccatgctattgtctcagcctcctcctgtatttctctaaaagatcgaccaccttaataccagctcatctccatttcttcaatgtactgtataatagagctaattgcttaatactgatgtagttttggcttcaagagctaatttccagaaaccacctaacatatggaccagtttgtttaattactagattgactttggatcatcgcaatgtattcagtttatttgtagaatgtattcaatattgttcatgcttttgttctgtacttttcagggtgaatatatccttagggcctaatgagggctggtatcttatgaccggactgcgcgtataccgtgagagacatctattgtagctattgtcagcaaattcttggctggagatatgtaggttatcttgaaaatttgcttccatcatataatagttgcctcttattttttataacatataattactaggcaaagtcctggtagtgctttaaatcaaaaaatagttgccccttatgcagattacgtatgtgccttcctgtggagaaattcgtagtgcgttctgcagaaatttgttggatagaagcatgagttgaattgacaatagtggataggaaaactagtactccaatctatacttcatttcaccttcttcttcttgtagagtagtagtgtttcttcatttcagtaattctcgtatatttccataggctcattgtcctgtcacaattatttgctaccttcacaccgatctttgaattagccatatcattttgcctcagtttgatttgtaattttgttctcattatgattttattcatgggatgtggaccatgctatctccattcattatcagattgctaccagtcaattatagtcaacgaacgtcacatataaattagacctacacttaatcaataaccattcaaaataataaaaaggtgtaatgactaatgtctagctagttttgcagttcatagatgaggctaacattttaagaaaatatggtttgatgctgaaactttaggagtattcgcaaatactagtgtggggtctcctgtgctgaaaaataatgtggccttgtatgttactcaagattttagttgctcattgctgtggaatatgtggctctagattctgtgtaaaccctttgtttgccttgatatctagctcatcactgcaagtctgcaactacatatgaactatacaactatgtaatagttgccttgattctgtgtaaaataatgttttgtgacgtccgatcaattttgtattttactattctaagccctatgtcccatgaaggttcaaggcacagattctgcaagtcgtttagcattttgcgttgttcttgtacctattggttccatcctagcagttaggagagtacaataactgtttattattattatttggcagtcacagtggcatatttgcgcttaattaacaaagttgcttgaattgatctctaatgaaattcactttgtttaaaccctgaatttggctaccttcacctatatgctaagttgcgcatctaaggttcttttcagctccttgtgactgctacttttggtcctagcttctccttcaatttcttgtaactggaagaacttatgtgttcgtggcatgtactcacctgttcatcatacttactagtaacacgataactttgtattctggtacacatctcatttatcatattgtctcgatacagtagtatttccttgagggctgtgtacatccattgtggatgtagaggccagattttaatccattttctaaaaaaaaaaagtagtatttccttgagctcttaacactgattcatttgtcacctcattgcttttttttttctggattattaatttgcacctataatactctacaggagaaagcatacaaagagaacgagaagtacaaggaaggcaagtccatcctggaaaagaccaggatgtggaaagaagcccggtgaaaaagatctggcgccattggaacacctcaacttgtatgtatatattttgtgtagatccaaaacaattgtaagaacaaacccagatgaaaactgtgattttaattctggtactttggtggtgacggttttaacctaaatttgatgaagtgccagggatttagtaacatttgattagtgctttggccatttatggcgccgttcattacacactttattgtggattagttaatttcactttcttgcttaccgtccttctgtcggaacttggattgcaacctgcagattggctaatctctacaaaaaaatggtaatttcgtagtcttccattcgcagtactacacaaaatttaattttgatgcattcactattttaaccaaaccaaatttcggtaacaagaattttaagtcactcaactataggccgagtttaatttacgtcccttgaccataaaatcggctatacaacatctctcaattatcaaaaccagtccattttgtgtctgggtttcataatggattttgttctacgtggttgagtgaggcccacatgtcggtcacatgagaagaaaaagaagagaggggtgctgaattgccagtgaacactgcagagggactcgattgacactagtttttgataattgaaggattctctatatctaattttatggtcgagggacgcaaatgaaattcaaaatataactctgagggacctaaagcagaacaattccaggatagattttttgttttacctgcactgtggtaaagaacaaatttgtgttaaattatgaaattttaataatattaccaaactattgataaacttgagtatattataccacggatttgagtatttttccttcatgtgtgtggtagtgaataacctcctctatttcttaatttctctcaaagttctcttagcgtgtgtttggttttgggactaggtttggttctgggactaggtgggatgggatgaaaccatccctgatttgaggattggaatgattccattcgggtgtttggtttgtagaataggacgatcccagttttttgtttggttcaaggaacgagggagggatgggatgagcgccgtttgcaaccaccgacaacgccgtttgcaacaaccatggccgacgccgcctctgccctcacctccgaacgtggtggccgccggcctccttgatggcgtcgatgagcggctgcagggggctcggcgacggcggcggtagacggctcgggcgacagcggcggcggcgggctcggccgacgtcggcggcggtgggcttggnnaatgggcaggtcgaagtgcaattcaaaccgcg

SEQ ID NO: 21705 - DNA, 12513 bp, Oryza sativa
  unsure (1)..(12513): unsure at all n locations
gtttatgccccaccctgccgccgttgccgagcccaccgccgccgtctcctgagaaagagcgcgcgagcaaagcggcggtttcatgccgtcgctcgtcacaggtgggaggagttcgtccgccagttttggctggaccgattgatcccggatctgagaggaatattcctctgtagggaccaacccatcccactcacccctgaaccaaacacccctaaaaatgggttcatcccatcccatcaaccaaacactaccttaggatggcacattgagctgacaagtgtattggtttgaatcaaatggagaaacaatttgattggattatttttattggtagtctggcaagtaatattaatcatgactaactatattttttggtgccacatttttcaataaaagaatcaaaatgtgtaccgtgaattccatatattgcaacttcgattccatatatttatactataaattttaaatcttagaacatgttttttcaatgctcgtcgtacaggaattatgaaaagaaaagaatcaataaaaagtattagaaaagttgtcgatgtttcatattcccaggtggctaagtatccgtgcataattgtgcctaacaaggaagagaaaatcgttgtgcggggtgccttgaggatatttcctcatatgctcgaagttgattccgactcctcgtggggtgtggatcccctaaagttgatgctaaaaccacccgacatagttgcaaaaatgtcaaccatccctctatttctaccgggtgagattaatttctcctaattaactctctctcaattagtattgatttagtgagaatgtatcttccttttcaacaatgagataagtaacataaatgtgtatatccccgtgagatcggtttatcctcattctgcatattgaaatttttttttgtctcggacaacactacttgaaattgatctaatgaaaacaaaaggaatatgcatatgttttctagattatgttgttcttgcatgttattttggtaaagagtgcattattattttttagtgttggatggagtgtaatcgttgttgtggaagggaacatcttaaaacagtagttttcctttaattccacactaatcaagttaattaagtgcgatgaggtgtcttaattgatctcatccgtataaacaaaataatggctataagtttgttaaatcgtcctataggttgtaaatgggccaggtctttccgtatcggcctgggcatgtatttatagttcacgacccaagaatggcatggcccgtttggctacgagtcatgttggcatgacccgtctagccatgttgtgcttgggccgccaccttagccccacgtgccaacacgacaattgcatgtagcaaactagcatgacatggtccaggaatggcacagcacggccagggctgtgcggcatggtggcgaccgacgaccggcgccggccaacaaccaccagttgagcagctactatcgtgcaggagctaggaggaaagaagggaagaatcaaggaagccaggggctcgaggcagaggaagcgatgatgggcgctcatcgatgtaggcctgcacggtgacgtggtggagcggcctgccccattctgaatgtgtcggtcgttgaggcctcactagctcggggtggaggaagtaggaagcgaagggccatgatagtgtttgatgaggaggaagaggaatgtgatatcgttgagcggaggacctctctagagctttactgaagtttgtgcggtgggatgcaacggactctattcacctttttttcttggtatatatcgaatttgggttacgggcctccacacaacctacatacccatttgtaccaggctgacacgacacaactaaacatctcactggatcgtgtctaggctccggccttagcatgtgggttgacacgacatggcccattggtgagccgtgcctaatcgggtcatggccaaatgtacttatttatccaccgtcttaaccctataaaaaataaaataaaaattcatcgtcttaatggcctagccctaggggatcctgacttcctgaccctttgtgagttatcttgatatctgacgggaatttaattatttggcactttacggactaccactcgtgagatgtcattttttctggatgaacttacagaaatgccattggagggagagagagagagagagagaatctttacaaattgccaatttgcatatgtggaaggatatgtcaccttgccaacatggacatgaaaatgacccatttacccctggtttgacctcagtgtatattgaatgtgccaataacatacaaatacaatatttgatcaattgtatactatatatactagcatatgaatagattttcatgtttcaattttttttatggatttatcctgtgcaaaaattttagtaatgtgaacaagatatgagaggataaatttgtaacaaatatttgaagtacaatgaacctattggatctgctagtaaatatgtttgtatatagttgctcaaatattgcacgtgcattttatcggcatactcaatgtacaataagatcgaacgagggcaaatgggtcattttcatgccccctccatgttggcaacgtgattagcaatttgtaaagatttactctctttctctagtggcatttttgtaatttcatctgaaaatagtggcatccaatagcctagttgtaacaatcgaactgaaatgggggtttgacaaaaaaaaaaaaacagaaccagtgcctagtctagagatgtaattgacttgagaaaaatcatttaaaccggattatctgcagaaccaaaggaactagggtggcctagggatcaaacccccaacggtcaatgcatatgggttctttcacaactttacctaacctttaaatattttcatgccaaaactgtataaaaaagtgagtacatcgtattttagatccaacccttaaattttataaggaaaatagttgggcccgttactatctctacctatatacatgcgtgcgcacctgactatttgggttagttgctaccatgattttagaaatatatcttatgttgattaaaccaaaattctcaatataaataaaatatataattttactattttattgaaccgatggaagaaccggccaatcgatggattcattcaccggttcgaacaccggtcgggtttagggtttagagaggcaatccgtaggtggtaggaggggccccatccgtcatcctgctgcttccgccgcgtccatcctccctgcttaggttagcccttcgcacatcctccgccgccgccgccgacgatccccatcaatcccgcgagcgagcggggccccgtcgttcgtcctcctgccgcttccgccgcatccatcctggttagcacctcctctttcccatctctctctctctctcgacccacgcacttcacttcttgtcgaatttgcgttaaccctagttagctcgctctgtgttctagaaatttgccttgatgtttggcatgttagatccgcccatggtagttgggggggggggtggagcgagtgcagactgatttgtttacaggatgatttgatagatggtgcgtaattttgatgtggctttctgatttccgctaatctcgtgttcgtatctgtgctactgcagtaggatcgatggaggcgaagttatcgttttctcaggacagcccgccaattgccataatttctgctgctaaggttgccggtgtctccctgtccatagatcctagtcttgctgcgggctcagcacccgttctatgcttcagttctgggtaagtggctgctcttctctgtatgtgtttttttttcttcttgtaggattgcataaggttctaggcatttgtttagctatctggagttgattagctataagtggagatgctactaatggcaaaaataaagatgttgttttctttttagcaaaatatgatgtttgaaacgttgtgcatcattactgaatgcaatttattgctgacttgtgttttccaagtggctattattatgatcattgttttgattatatttttcacttggctgtgctgtacttgttttttcacatagaagtacatgaccaattttagtttccaaattatcactttacttttacttgtcctttattttatcttttgggtttactcaccatctggaactgatagtttctcatgggaatctttgtttctacacagagaatcactccgtggtatcaaccctattctcgagtacattgcccaatcctctccaagcctccatggccgagatgctattgagtctggacatgtatgctgtgaccaagttcttgctaaaacatatttcataatctttgttttgttagtgttctaaattgctgttgttaatgaactggcaggttgttgaatggcttgaatacgcccccaccttccttttaggatcagaatttgaggttgcctgctcatttgttgatggatacttgatgtctcggacctttctggttggtcatgttttaacgattgctgatatcactgtatggtcaaatctggctggtgagccatgggcttctttcacgttctactctcaagcttctcctatgcttcataatgtgcgctaacaattgatgtatatcttctctttcagggattggtcaacgatgggagagtctacggaaatcaaagaaataccaaaatcttgtccgttggttcaatggcatagattcagactacaaagacacattgaatgaggttatagctgcttatgttgggaaacgaggaattgggaaatcccctgcaccaaaccttaaggaaaaggttaatgactcaaaggatccttcagctccagaagttgatctccctggtgcaaaatttggagaggtgtgtgttcgctttgccccagagcccagtggttacctccatataggtcatgcaaaggctgcactcttgaacaagtactttgcagaaagatatcaaggtcgattaattgttcgatttgatgacactaacccttcaaaagaaagcaatgagtttgttgaaaacctcctaaaagatattgagaccctgggaatcaaatatgatgctgtcacatacacatctgattattttccaaagctaatggaaatggctgaaaaactgattaagcagggaaaagcatatgttgatgacacaccaaaggagcaaatgagaagtgagagaatggatggtgtggagtcaaagtgcagaaataatactggggaggaaaatctgtctctatggaaagagatgataaatggttctgaaaggggtatgcaatgctgtgtgaggggtaaacttgacatgcaggatcctaacaagtcccttggggatccagtttactaccggtgcaacactgatcctcaccatcgtattggttcaaagtacaaggtctatccaacttatgactttgctttgccattccttgatgccgctggagggagtgacccatgctcttcgttccagtgaatatcatgacaggaatgcacaatactatcgaattcttcaagatatggggatgaggagagtagaaatatatgagttcagcagattgaatatggtttatactcttcttagcaagcggaagctgctttggtttgtgcagaacaagaaggttgaagattggacagaccctcgtttccccactgttcaaggcatagtacgccgtggcttgaaagttgaggctttgatacaatttatactccaacaggtattactatctgctagttagctcttgctttgtgttatttacatatgaaaatgatgaatcctgattgcatgcccatttctttgctgaagggtgcttcgaaaaatttgaatcttatggagtgggataaactctggacaatcaacaagaaaataattgacccagtttgtgcaaggcatactgctgtgttgaaagatcagcgtgtgatcttcaggcttactaatggtccagagaaatcatttgttcaaattttgccaaggcacaagaaatttgatggtgcaggaaagaaggcaacaaccttcacaaacagaatttggctagattatgctgatgcatctgcaattagcaagggtgaggaagttactctgatggactggggaaatgccatcattaaagaaatcaagatggagaatggagtaattactgaactgattggagaactacatcttgagggatctgtgaagacaacaaaattgaaggttacatggcttccggacatagatgatctggttcctctctcattggtggaatttgattacctgattagcaagaagaaggtgagttagcaattccagctagatgtagttagcatgaaagcttcttgcttgccttaactcaaatagtctgtcttttttacttgatattacatgctatcttttctctagtttctctatgtggatatcatattttcctgtacagtaatgttttttaaaaaaattgtggaactaaaccttctctcttttgtcatgcaaaatgtgaaccatttcttggttggagttagctcctatattactcgttcatttatcaatgagttaacactgaatgtcttctatgtttgtggccatgtgtacagcttgaggaggatgagaacttccttgacaacctgaacccatgcactcggaaagaaaccctggccctaggagacgcaaatatgaggaacctcctgcgtggggaggtcatacagcttgagaggaaaggctattacaggtgcgatgccccttttgtcagatcctcgaagccggtggttttgttcgctatccctgatggtcgacagcaggccagtttgaactaggcggcatgattctgatgagcttctcaagtcgttgagttgtcagagattcctgaatgctctactgaaacactcccatctcatactgtaatgtcgcttatgtgtcatgggtgatttgcgctaagttttggtgcacagtttaatgtttctcatgctccatgctccagttattaagaagacacaacatttcttagatggcaacgtgttagcttggcgatatcatactgccagatacaagcatctgaattttttgaagactaatatctgatattgcttggcatctgaattttttgaagactaataccgctctgggaaactgagttgaggacatttctggtccatattgcttgacatgcccttttatgtttccagttgttgattataactggtgaatctaatatcagtgttcgttggttttgtgtcagaaatcttttctacttttgcaaatttcatttgataaaattcctactttttttcctttagaaaataaaatgttcattgctatatcatcccctacactaacatttgggtctcacatttcatattattacactatcctttaataaagttctctcccattttatgttggctcttcaaaatcattgtaacgatgaaaatgatgtaagtactatttggactaaatatgtgcttaattgatttatgttgtgttcttttccccttctttctcaactcaactttctctttttttcatgcgcatgcttttcaatctgcttaacggtgtgtggttttttttaaaaaaaagttttctatacgaaagttgttttagaaaatcatattaaccctttattttttaaaaaaaactaatacttgattaatcatgtgctaatgagtctgtgtgggattagttaacaccaaatgccgatcgcagccttaataaggtcaatttgtttttcgttgaaatgccgattcttatgccagtgagaaactgagaattcattagaaatgcctatgcctctaaaatgaggcttatgcagtcagtcattgtaggctaacgaaaacatgttggttagttgattacaccttgcgattacatgtaatactggttgccacttgctacatatactgatatatacagatgcagtacataatcacaatccatcaggtttgccacaccagtttgaagttagtcaatactggttgctacatatacataggcataatccatcaggtgccaaataagtttgaagttacagccacaaacgaggttctgaggtcttacaggaaataggctgcgaatggattgcatgcagttttggtactacacgcctgattttgcaacggcgtattgtcctcaaaacagatctctatgaacaataatccttggcgacatatatttccctgctttggattgatttcaccttcaagattacaatgaatataataacttggatgttgaaggatattaacacaaacttatgatttgtatgcctcgttcatcatctacgtccattgggttttcacagatccacaagccctgttcattggagcggcgcaaactaatcagcagttcattctttccaatttggaattgcattatctagtcagtaataattagatgaaatatgaagtacgaaaagtcgaaaacagtgagacctcatgatcttggaagtgacaacatggctgctgaaagccaaatcagtcccgaaagatggtatttttggttccagatttcatcacaggtccccgacaaatccatagaaaaacaaatcaaataaaaataaaaaacaacaataactataatggcagtaccaacatcatctccagattgggttggcctcagaattgcagaatggcagcatggccgccgagcggcggccgatcagccccgaaagatggtgtttttaatcgaggttttcttcaccggccaacgcagacaacagtgggactcgttcttaactcttactagtatgcagcaacaaaagaaaagtttaaaagaagaaaaaaaaccaagaacttgaggaagaaacgaaagaacagtcttggtagcaacggatcagcaatggacatcagaattgcagaattagcatcattgcacgcgcggcggcgccaaatcagccccgaaagatggtgtgtttttcttgcggtttttcatcaccgtcgtccaatccgccagccagacaccaaggcataataataacaagtgaaaaggcagaagaaacgaactcagctttctttctcgatggcaaactcatcgcaacggagaacaaaaaggaaaaagagagaaaaaaaaaaccaaacgagacccaatcaataactcagatctgctcgtcaatggcggaagatggagcggcggcggcggtaacctttgggtgcggagctaagtgagggagggacgagtagtttatatggaggctttgaaaccctagctagtcatggcgatagaccggccgggccctgtggtggagaattcggatgacgtgtacctgaaggcccagaggccggcccatgagccattcacagttcggtctcacctctcaagcgcagagattctgagccacggggggcgtggccatccgaacttcgtcggaacctgtcatcaggaggaagctccgtgacgtgcgaggagagaggcgaaaccgcattggagagaccgtgtcctcaaatgcgaagcagcagtcccctcgccaccgtcgtcgtcgaggccgccccgccgtgccggccccgccgccgttgtcgagtcgccgccgtcgtcatcggactactccccccgccatggagagggcacgggatgccatcatcatgccgcccccgtcgtcgtgctgccaccgctgtcaaaccgccgccgccgtcatcgaagaaaattatttctaatttttttctggattttagggtgtttcctgtacactttagatcttcacataaactgaagataatattataagaactgaaaagaaaagtattagggactgaaatataaaattaaaaccacttgcactatgaataattcaaattttataaaaactaaagcttcatagtgtgtgggactgcctttgccttcaagctgtcgtcaccgtctcccgaggtcagatccggcgagaagggggtgcgaactggccaccagtggtgctcggtcgagctgcgccaccgctgcccgtcaccgcctcccaaggctagatctgacgagcctcagaccagatcttgcgaggagtaggaaggcagcggcaccccgacaaggaggaaggggatcgacggtgatgggagggagagcgctagtggggggagggtgagctgcggaggggaagcgacgtttccgatgagaagaggggaggggaggggagaggaacctcttgtagggagagattacccacggtggagagggagcgatcacgcttgtgggggaagggggaggagcggatagggaactgatgatgaggaaaggcaccactggtagggacaagtggcccgtggtagaggaaggggaggggaaaatttcgatctggggttagggttttttgcaccagcggttttgaacgagttggaaccgattcagccgtccatcaaattgaacagctcagattgatcgcgtgttgagtcagcccccatactcaggccacagcactgctgggctaccgcgcttcatgggtcgcgcgcgcgaatgccctagcaggttggtgagtcagaggtctttttttttcttttttttactttctttatttctggaggaatatatatttttaaaggctcatacataaaaactaaaccctaatcatctaatatttttatatttgttataactttagtttacctgttgcaacgtatgagcatttttctagtaaaaactttataaaagaattctaaatagagttaattgcactttgtctaccttttatttccaaagtttcactttgggccaccctctagctaatatttgcagtttggaccacccaagtcactttttctagctgcatataccctctaatctcgtaaagaatagtctacatgtaaattgggaagattatcggtttatgagtgccgatgtgattaaagttatttatgtgctcgagaaaagtttttgggggtggttcaaagtgaaacaaaggcaaactaatctagtccaaagtaaaagagatggtttaaagggttgtcgaaagtgaaactttggtgataaaagatggccctaaacgtaatttactcttttattctataccatactagattagaagtttacatgttaaattatagtggtttaaaattttatatttcatttaaaatagaaaaataagattcaactaaatattatcatggatttgtgaagctaggaatatcccgtttcgaagaaatcttggaccgggagttataccaaatagggacttaacattgtttgtagctcgaacagtgatcaaaaaattatttactacttcttttccaaaatatagactcataacgttagattatttctaattcagttctaggttattttattttgagtaaaatacatggctaatccttaaacttgagagcaggtgtttcttagatccctaaacttgaaaattacacatataagtccaccatcctggtttaatgaaccatagtcggtccaaacctcatttgacccgagctaatcgtcaacatgacattctatgtaggcaacatatttacagctagctccctccacggcgaagagtggtggaagaattacaatttgccccttcatattaaaataccctggaggccgtgagggaagggggagcacgtgtagtgaggccgggtcgaactattttttttgggatcgtgagagagatggaggctgccgggaggaagggattagggggagggaggagaagccgaaggcccacggggagagaggagttacgtgtctgagccttacatattttttaattaggtatatagattggtagtatttggtggtggctgacttaatgatgaataaataaggtaatagcacaattattagcgaccaaacactagtaaacaatatcagacggctcctatcgttagggtttacgtcattgattagatagggggttatcgctaattcgatagatttcgaagaaacttcaccgaaattcatagaatttcattgaattccgtcgaattttcgcctgagttttgtactaccttgaggcatcgagcatgtgcgccacaactgaacttgcactaccccaaaagagtgatacaaatggcggagcaccacccgcctcgcctcccgccgtccgccgccggcgccgcggcgacgtcgtggccggagctcctcacgccgttcgacctctcccgccttcgagccacgctcgccttcccgccgctcaccccgcgccgtctcggccgccttcttgcgctcccgctctccccgggcacctnccttcttcttctcacctggtacgcctcctcccacccggcacttttctcccttccgatccggcctattctcgccggcggagaccccgaccgcgccctctctctactcgacttcctaccgcccggctttcttccactccgcgagtcccttcttctcccggtgcttcgaattttgccttccggtcgcgcccttcacctgttcgaccaattgccccggcggttcggagttcaaccgtcgttccgctcttacaacgtcgttcctgtaaatgcttgccaggagcgactggcacgccgacgcgtttgtgttttaccggcggatgtgtccacaaggacctggttccgcccacctactttattttctggattgtcctggcggccgctcttgcgactttggccggccaaaaaggggctttggct

SEQ ID NO: 21706 - DNA, 2614 bp, Oryza sativa
  unsure (1)..(2614): unsure at all n locations
caacgtcgtcctgtcagtgctcgccaggccggactgccacgccgacgcgctcgcgctctaccgcggatggttccccagggaccgcgtcccgcccaccaccttcacgttcggggtcgccgcgcgggcgctctgccgcctcggccgcgccgacgaggcgctcgcgctgctccgcgggatggcgcggcacgggtgcgtccccgacgccgtgctctaccagacggtgatccacgcgctgtgcgatcagggaggggtcaccgaggccgccacgctgctcaacgagatgctcctcatgggttgcgccgcggacgtgaacacgttcgacgatgtcgtgcgtgggatgtgcggcctcgggcgggtacgcgaggcggcgaggctggttgacaggatgatgacgaaaggctgcatgcccggcgtgatgacgtatggtttcctcctgcagggactgtgcagggtgaggcaggctgatgaggcacgggcaatgctcgggagggtgccggagctgaatgtcgtgttgtttaacacggtgattggcggctgtctcgcagaggggaagctagcagaggctacagagctgtatgagacaatgggtttgaagggctgccaaccagacgcgcacacctacagtatattgatgcatggtctttgcaagcttggaaggatcggttccgctgtgcgattgcttagagaaatggagaagaagggatttgctccgaacgtagtcacctacacgatcgtgctacattccttttgcaagaatggcatgtgggatgacacaagagcattgctggaggagatgtcagcaaagggcttgactttgaattcacaagggtacaatggaatgatatatgcactatgcaaggatggcaggatggacgaggcgatggggctcattcaagagatgagaagtcaagggtgtaaccctgatatttgctcatataatacaataatttatcacttgtgcaacaatgaacagatggaggaagcagaacatatgtttgaaaacttacttgaggagggtgttgttgcaaatggtataacttacaatacaatcattcatgcactgctgcgtgatggaaggtggcaagatgctgttgagacttgcgaaggaaatgatacttcatggttgctcacttgatgttgttagctacaacgggctgataaaagccatgtgcaaagatgggaatgttgatcggagccttgtgcttcttgaagaaatggcagaaaagggtattaagccaaataatgtttcatacaacattctgatcagtgagctttgtaaggagagaagggtacgtgatgctctagagctctcaaagcagatgttgaatcaagggcttgctcctgacattgtcacttacaatacactcataaatggattatgcaaaatgggatggatgcacgccgctctcaatctcctagagaagctacacaatgaaaatgtgcatcctgatattattacatacaatattctcattagttggcactgcaaagtcagattgcttgatgatgctgctatgcttctaaacagggcagtaagtggtggaatagtacctaatgagcgcacatggggaattatggtacaaaactttgtcaggaagccacttaccattttggctgaccaggttgaagtgtattagaaacatgtgcttctctatgttatatttgatggttgttgcggcttttgaagttaccgtagcatccgttgttcaatcaaaatgaaatggtcatatcatggtgttcatcgctgatttcatcatgctcggtgacctggtatgtatttcccctcttgttgaaagtgtgtactttccatctgttaacccttttgttgacattgttctacagatggcagctgtatgtccagtgggtgatcgtagaataatgcagattcttcctgacaagaatttcaagttgtacttacatacaaaaggtaataacccttaaatttcaactcgtgtaaaattagaacaatagtgctgactgttgagatcttggcccaccatccatacctttgatttttgtaaagaagaaagagaaaataggtccagatcaatttgttcctaagatggcagatgcttacttttcatgtatctttcagctcatctcagattcctatctgtattgcggtagggccaatgaatgcaaagctaacattttattagaacagtctaccagtttcattgattctgctcctaaggttggaggtgtttccttatccattgatcctggtcctgccgtgggttcaacatccattctatgcttcagttctgggtaagtgggtgttgtgtaccgcaggcgcaagcgcgcgccagcctcatcgggagctgttgggctgccagcagatgtgcaggaacagatgccagaaaggacgcacagcgagtgaaggcgtaatcgggtgcttggatcacagtgctttgcttcgttagaatgcatttcttatccctttgaaatagcatctggtttccttttgtttagcattcggtttaaccatgtaagccatataaatggcaccattttaaatgaatagagcaagcaagatcaatctcaattcttcattcccttgttctcagttttctcaatctctgctgctgtgcttttgccgtgatcaccatgggcn

SEQ ID NO: 21707 - DNA, 1279 bp, Oryza sativa
  unsure (1)..(1279): unsure at all n locations
ctgtgtagtanatctcattgtgcatgcccgcangncgactctagaggatccccccgccttcgaggctccgcggcagtggtggggcggtccaagtcgtcatccggactttcggaggcacctttggaacgtgaacacgtacggcggcgcagtagcggatgacggtggcgtcattggcgcgagcagcgacacggtccacggaaggatctcctcctccgccatgctgcagggcacctggccgatgaacagccgcaccctctcgccgtcgccatcctccgcatctccggccatcaccgcgatctctctctctcccgtctcttttccttttctgatggctacgcaacctcctgtccgtcctctcctcgttcttgcctgcgccttttgcctttctatatcagacgagcactaaccactgattgattgattgattgatcagtatcagtgtcttgagtacaagttaattaatcgatgagtagtaccaagtcttgatctcgagtagcagtgaatgtgattgaatcatctgattgagcgaaaagcagcagcagcattgatgcctccgccttgccgtccaccagcacccgcacccgacgaggaggcactggccttccgcgtccgtccctaactcctctggcggcagcgcgggacgaggcggttctgcgccaccggcgaccgccgcgtcgacctggcgtgggacctcacccgcgcgcgcttcccgggctcaggttcgcccgagccttcctttgtgtgcagccgacgagccgccgccgcgccgtggtgccgccccgcagccgcaacagctatgcggcttgaacggcggcgccggcctcttctcctccggtgagtatagatggacggactacgtcaacgtcgtgcgtgcatgcatgctgcaatcttggcgtctcagtttcgtgcatggatcttatgaaggtcgggggatgacggcgatgatggagtgccacgacgtcgagatgccgttcttgcgggggatcgacgtgaaccggccagcgccagcggcggagacgacgacgacgaggggggcatctttagcgaggaggacacgaggagtccgacgcgacctccccaacagcacgctctccagccggcagcaacgacgaggactccggcggcggctgcggatctagtgtaccgcggtcagggcagggacgggagcagcaacagcagggagaagaaaagagaagaaaataagatatgcagctcccatgtggggatcctctaaagtcggccgcgggcaaacagaaagagggaagtacatcaaacacgt

SEQ ID NO: 21708 - DNA, 2626 bp, Oryza sativa
  unsure (1)..(2626): unsure at all n locations
tgtgcttatgaancnttgaagnnnnnnnnnnnnnnnnnnnnnnnnnnnnnnnnnnnnnnnnnnnntatatactgtctagggaccttaagtgaacggttttgtatagtttaagggtggggatttctggttttgtggttaagagatctcaaaaaatctcgttgttaagttgagggacctccggtgaacttattccggggaagaaagagggggcagctgggctgagttggccgtccaggaatggaaaaggaaggtgggctggcctaggtgagggaaagggactggcctaagcgaagaaaaaagaaaggggcagcccaacggaccaatgatatttctcaatttctaggaatatatcagagtttgaattttggagagtattgttggaattgtaaatagattgtaattggaccgtggactccaataattctaggattgtgtatggccacatttggatgaatgatttgagatcttcaatggcacaaaccaaaattcaaataagaaccaacttttgaaaatagattttgtatttaaattgggtttttaaaatgtagcaaaaatcgggatgttacatgttcactggatccatgaaggatggggaggttggtggcagcgaattggcacctcacctgccgctgctgccggatccgctcgaggttggtggcctcctactacacctctcctcgttgttgtcatcgcccggcgacatctcccatgtcgccggtcatcgggtgtgagtggaatgtgtgaggaggggcaacaaaaggggaggaaaagggaccgagagacttaaggggaagagaaaaaggtaggatggagatagaggagaaggaaaaaaaatatagttgggtgatgcgggcctattaagaggtccgccttcaaaaatttagtttcacatgcatgtctttaccgaatctctatcaactccttttacatgcgagcctcttgagaactctttttagtccggctgaagacaaaggagggtttgtcctcaaaaatcatttttagtagtgttatttgcccacagcggtgtctcggccttctccagattgtagctgctgctagcagggtcggagctacatgttagagagggggtgcccaggaaccagtcaagaaaatttttcaactatagtttatctattttcaccatatatgtactctctcaatataaactaaggcaccaaaatgaacttaaatttggtccatttcactctccgctcctggctgcccggtaatcgactagataccactgccgtcctttcttgctctcccctcctccagatctggttgctgctagctcccttgctcaaggaggccacagtgacgacgggagaaaaagttgtggtggcgatgattgaggaggtcgcaacgtcagagaggaaaccacggcggcggctatctcttcttcattcgcggcctcaatgcctcatcgcatcgaggatcacgtggtggctatggcttgatttgctttccctgctgatggatctactcgcctgagtcctctcccggccaaatcagctgcacggtgatcgtgatcctccacagggtgaaaacaggtgggtacggtcttattatgcatgacattttcatatcctaacccatattttcctttaaaattggaattaggtacgggcagttccagataatatatcacttatccggtcatcccatatttcattgaatcggattcggaaacagatatctatttgtatttctaattcataaatattaaatataaatagacaattaaagtgttaaaagagatgcatcaaggaaaaaaatatattacatgtgagctcgtaaataccaatctttaactatgtttgtgggtatatttataatagattttcatatatgttttataattagaaaaaatacccgtgcgttgcaacgggtgaagtctattttaatcttattattgttatatggtttagttaagatgaaattcactgtgggagttcacttcgatatatatatatttttagaaaatcatgagctacaattaggggtccgattgtctcaagttagcatgcgagttttttttgaacagatttcttctatgattccttctgtgttaccaaaagtgaacgatcttaataactgactcaaatatagatatgtactttcaaaagcaaacggacttaaaaactgactcatacacggatgacgtaccaaaataccgttaaaaacatcttcaatttttataattgtagagaagagatatagattaaaacaaaaacataaaattaaaaccgacttaaatacggataacgaactgtggaaacatctttaatttttataatcgactcaaagacggatgacggaccgcggaaacatatttaatttttataatagtagagatatggaacatatggatgtgtataaatatttccgtatcctaacccatattattttttacggattcaaattcaaactcggattcggatagtatcaagttaactcggacaggcgagaccactccccgaatcaccgcgttgggcatactccctctggttctatattaattgacattttggacaaggttgagatcaaacttttataactttaaccatcaataactttaaaaatattagtttagtttaaaggtacaaagtcgcatntccaccacgcg

SEQ ID NO: 21709 - DNA, 770 bp, Oryza sativa
  unsure (1)..(770): unsure at all n locations
cgcgatgatcgctctcntacnnnnnnnnnnnnnnnnnnnnnnnnnnnnnnnnatcggagcaaatggttgagtatcttgcccgaatcgaactcgttttcgagtttatctccaaaaccgagtttttgattttcccgagtcgatttcttgcgggaggagtccgatctcttcaatccaaggctataaataggaccccctagtcctcctctttcgtttgccccaactcccgtcctttcccgtgctccgtagctccgtcgccactgccgcctagcaagccacccgccgccggccggactccggttgcgccgccgcgccgcctccgccgtcgccgtcgcttgccgtcgccgccgctggtttcgccaagaggtggggaagctcggccgcctcctccccttcgccgccggccgccgtagcctcgtcgccgccagtcaacccgagccgccgccgccgccttctcgacgccggctatcgtcggtggtcgttcggtgtgttggtaagtaccgtcgcgttcgtctcgtcgttctctacgtgtagatgccctccaaagttccggccgaccgccctagctccggcgaggtcgtcaattcgggccggccaccattgatgacgtcatcgtgacatcatcatcttttctttttcccgtttttctaatagattaaaacttcagaaaatcataactaaataaccgtagatcccgttcaggtagttcaagttgctaaatttttcttaaatcaagatctacatgttaaaaatattccacatgtactgtgtat

SEQ ID NO: 21710 - DNA, 694 bp, Oryza sativa
  unsure (1)..(694): unsure at all n locations
ccgctttgatgactgtcgncnnnnnnnnnnnnnnnnnnnnnnnnnnnnnnnnnnnnnnnnnnnnnnnnnnnnnnnnnnnnnnntttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagttctatggcccggaaattggattatcaccctgagacaacatattctatgcgtttaagggtcacatatgatcacaaaaaaggcggggggcacgtgtttacacccaaattttgcaactatggacgaaataagggaaaaatggt

SEQ ID NO: 21711 - DNA, 14051 bp, Oryza sativa
  unsure (1)..(14051): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtaacatgaatgacgtcccagtgtcatttaacatgaatgagttgacagcattgctttactagcatttttttatttggtggaataagatatatttcaatattgaaatgcaaatgctaacacattagatattccaatgaaaaaaaaaaaactataaccatagaaatcgtctcacctgagccaacctctcgtcacgcctggcaatcttcctctcacgactggccttgctcttggcacgcttagcctcaaactggtcagagagtgtcttctctcttgccttctcagccttagacttgtggatactttccatgagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaagaagcacaaatgcacatgcatatctaaatgcgccaggcatccccttgtctctttgtatattaatcactatagaggacagttagtcacattcccagaacagcgccttggattagaacccctaacgacaaccttgatcaatcggtaacaacactgcatggtccaatctagatagcatacactccaaggtcaatatactggccatttctctaatgttctcttccaaacaaatacacccagcacaacaacctaacaactcctatagaactgggagcacgcgattcccacgaagcaataaaatattcctaccagaatcgccgggggcaaaaattttcgcgcggattagcagcatggcttcagatctaagcaaatcacgcatcaacaccacacaagtagcaggcacagaacatcatacggtaggggcaaggggagggttatgggggggagggacgaggaggggagttctcacgggagttggccatggagatctcgttgacctcattggggtcgagccagaccttgcccttgccgcatttgagcacgctggaggcgagccgcttctgcagcttgagggaaaccatcgccgccgccgccgccggcttcttacctgtgtggagtgtgtggtgaggggggtgcaagggttggccgcgtgcggcgccgggggtttatatagtgagaggggctagggtttcagcccgagcggggagactcatgggccttgggcccatcagtgtgttggggtttgcagcgggaataagttcactttatgaccctcaaatgtccacgaccttaaattacaaaatcggatatctcgacccccaaactcctaaaaccggtgcatttgactccctggaccgttttgggaggcggttttgctgatgtggcgccgtgcggtgcctacgtggcaatattgaccgagttttcggtccacgtagcgttgacgtagcacctacgtggcggtagaattaaaaaatatgcatgggacccattagtcattcacacaaaaagaaacatgggcccactaacatatgggacctatatcctcaagaactcatgtcgacgatactgtggggacgagggctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcgatggatctcggcaagtcggcttccaccagcgcgaccctgaagaagctccaggaggatggcgcccttcctggccgtgaaaacgcggagagggaagcaggaggtacaaatcctcagcccatcttaggtcgcatggttgtgatcgaagattatgttgtctgcgggtttctctcttcaccctccgaattccttctgctggttttgaatttctatgggctttctcttctgcacttgaaccccaattccattgctttccttagtgtctttgtgcatctttgcgaggcctacattggggtagagccctttcttgatctgttccgcttttattacgagttgcgctggatggaacccaatagggtgtctggttgcgtcgggttccgacttcgtgacgggatgaagtcgcgctatgtccccttccagtgtccctcttctcgtagtaaatggcggaacaggtggttttaccttgaaatcaaggattcaaatccgatcctcgttgttcccgaggaacaacaagattctggtctggaccgccaagccccccttgaccccctctctccaatcgtttatcgacatcatcgatgatctccgagaacggggcttatcgggatatgaagtcgttgcagacttcgtcgataggcgaatccagccgctccaggctcgggcccacccggcctataactattccgggccagatgacgcgacccgggtttctcctcggggtatctttctcgcattcattttgatatgcttgtactcgcgttccttttcgacttatcaaaaattgattccttcttgacaggtctgagcagcgaagccgtggagcggcgtgttggtcaggtgatgatcagcggcccgactacggcgagcgacatccccgcacccttttgtgaaaggggagtgacggagcacgacgaagcaatcaatgtgagttcattcgataagcgtccgccttctttgctcaaaatcagcttatgacatgatttagtgtaggcccttcctttgactgatgtcgtcggtccgctcgcggatcatcaggtggcggcatctctgaaagagaaggtcgtcaaggtggcgtctgacgctgccaccactagtggtggcaaagctccgactaaggcgaggaaattctcgtctgtgctcggacaccgccgcaaggcggcgactccctcagtaattttcaccttgtcgtcaggttatgtagcaaggaaggtttgttctcactctatgttggttgttttgtaggcttccgacgtgtctcctccgcctgcgcgacgtaagcgcattgtgacgatcggcgagaagtaagtaaagaaacttttagattctcgtgtcttctgtttgagtggaattttgattcatggcggtttatagggaggcgcgggcgaacgttgctcgggccaagtccgggggaacgtctagcgcgtcccctgtcacggcgtcaacagatgtcgtgcccgtggtcgggagtcgggaggcgacgccaagcggccccgtcagcgatcccgctgggggtcgtggtctgccagaggccgtcctcacctgggaggagctccaagtcgaaatggggcgccttctcgaagccggtgctcgcggcatcggccgcgagatctcagaggcgagggcggagacggcggcggccaacgcgcgtgccgagcgcttggtgcgggaactggctgaggcccgcgaggacctcacgaagatgagggagctggtggccggcaacgagcgccagcgcaaggggctcgaggaccgcatgtcggaactcggggataacctctccgagatccgtggttcgctgcgggtcacctacaccggtctccaccagcttgccgaggagtgcggcatcaagtccacgatcccggcgaaccccgacgagttctcgttgacctcttctcttgcggagctggcgacggcgatggggaaatcccctccaagcatacggccaggatcgcggaggagacgtccaacggcatctataccggggcgtgtcatgtcctcgcgtgtgtgaggttgtcgcgtcctgaactcgatatgcgcgagatcttggatcagggggcggcaagcgacacgcgtaagaaggtgatggaagaagtcgatgacctgggggagtctgtcctccccctttttgaagagtaggacttcttgtattttttgtgacttgtaaatcttgaactctggttgccttcgtgcgtgtgattatcatccttgttcaccgttgatctcggaagttttttcttgtcgactgtagagatgctgatgacgaggatgtccagcagcgcgggcagcccgagtcactggcgataattccggtattcgagtttgaaccacacgtcccacatgacgtcgaggaccaaactcttgatgcggaggtcgaagtgactacaactgcctcaagtgagtagccattctaccttcgagttctacctttgtgttgttttggggatttccagcttgtcttagtggtcgttatgtttagcagatctcaaggatgcccttgcgacccaagatcgtcgtatccaatactggaagacgaaatttgaagtggtggaactcgagagaatcatgctatccgtgaagaaagagcaagccgtggaaacgctccgaggccgcgaggtgtggtttgggtcatacttgaagaattgttgcacctcgatggctagggtatgcagggagcttcgagtagtccgcggcgatcctgaagaatcggcggccgggtacatctcgtggctcaacggggcctgtgcccaactcgatggcatcggcaagcgaatcgacgaagccttgaagcaagagtgtcatcttgcgagccgatatttcggaggacatgtgttagcttgcctgcgagatcaccgcccacgcctggatctcgaattcctccgtgaaggtttttcttgttctcggaggaatccggcggagatagaccaccttgcgaggtcgatgtcgccgttggccgagaagattttccagtcaatggactggcattggctttcttggtagtatttgtaccctgcgaccagatatcttaggggaagatgtaatgcagcgaaatatttatgtacaaactgtaagaaatattttgtgaataaagaaatctatctttaacaaatgtttcttactctggatgtcgtgtgtatgagtgtgttctcagttaatgactttagttagccgtttgagtcgtacactctccctagcccccagctttgtcgtcggaggaattttctcggaggacaaggctcttggacccttgacctgtcttggttgaataagctctgatcctagcacccagccgtgaagttggaaagctcggtttccgattacacgacttggttaatacgcacggcgagaactcttacacgaccagatcttacatggtctttcgtctctaaaggatctgacaaggccttatcggctctaggcgtccccagtcgaagatcccttaggttcctcggaggccttgtcaagacggcgtaaagggacataaggacaggtttcaacgctaggtgtcgtcagagtaagggatcattgggtgaaaacactttggtcgtgacatgtgacttagaaataggctttattgatactgtaagggtgcttacaggtacagtggtattgactcatacatagaatttacgtagttggtcaatgttccacgaatttgctagttcgcgatcgtcgccgtctgcgattttgaatgcgcctggccgcaagacttgtgtgatcgtgtagggtccttcccattttggtgagagtttgttttgccctgcttgggtttgaactcgtctgaggacatagtcgccgatcgaaagtatgcatgctcggatgcgcttctcgtgataacggcggagggcttgttgatagctagctgctcgaacggcaactcgctcacgatgctcctcgagaaggtttacatcgatgtctcgctgtttctcctggttctcgtcggaatgcttctgtactcgtgtactttgatgtcgtaactcgccggggaacatggcttcagagccgtacacgaggaagaagggtgtttccttattggatgttgtcagtgtggtgtgcatggcccatagtactgatgggagttcttcaacccattttttgtcgtgtgacatgagtctgtcgtagacgcgggtttttatcccttgtagtactatgccgtttgccctttcgacttgtccattgctttgagggtgagagaccgaggcgaaacatattttgactcccaagccgatgcagtaatcctggaaatcggcgctgatgaattgagggccgttgttagttatgatgcggtgcggtagtccgtatctgcataatatacctctgatgaacttgatggcgttatcggccttgatttccccagtgggtactgcttcgatccatttggtgaatttgtcgattgctacaaataggaatctgtagccgccctgtcctcgtgggaatggcccaagtatgtctagcccccagcacgagaacggccaagtcagagggattgtctggagtgcttgtgcaggtagctttgtgtgcttgctgtggaattgacaggcttcacatcgctggactatgtcgcatgcatctttaaggtcggttggccagaaaaacccttgtcgaaaggctttgccgaccaatgtccgaccggcggcgtgtgacccgcatatgccttcatgtatgtcgaggaggagttgtctgccgtcgtcggtggagacgcatttgagaagtatcccgtttggcgcttttttgtataaatcgttgccgaccatacagtagatctttgctttacgggttattttctcggcctctgtatcgtcctcgggcaactcctcgctgctgatgaatttgattaatgggatgcgccagtcatctgtggtttcaatgtcagcaacggcgcgttctgcctcggtgacctccaagctgatgtcgggggtactcgggccaacttcaccgctaacttcttttaccgatggctttgtcaggacgtcgagaaaggtgccgggttcgagcggttctcgtctggatgcacgtcgtgctaggtcgtctggctcgatgttgtccttgcgatagacgtgtcggacctcgatcccgtcgaacctcttctcgagcttcctgacttctgcgaggtacttggataactcggggttggtgcatttgtagtctttgtgcacctggtttgcgattagctcagagtcccctttgacgattagtcgcttggccccaagtgcggctgcagctcgtatcccggcaagtagtccttcgtattctgcagtgttattggttgccctgaagttaaggtggattgcgtgcttgaattgatctccggagagagatgtcaagataaatcctgcccttgctccttggctgttgagtgcgccatcgaacgccattgtccatgtctcattgtcaccttggttgtctgacttattatctggcatggtccaatcggccacgaagtcggcgagtatctgagatttgatggctgttcgcggcacaaagtggatatcaaattggcttagctcgactacccatttcgcgatgcggccgacaacgtctttgtttctcacaacttcgccaagggggaaggaggagacaactgtgactctgtgggcttgaaagtagtggcgtagcttccttgatgtcatgatgactgcgtagagcagtttttgaatatgtggatatcttgtctttgcgtcatggagagcttcgctgacgtaataaactggtcgctgtattttctctgtctcgacaacaatgacggtgctaacggaatatggcgtggcggtaatataaaggaataattcttcattaggttggggagcaacgagtacaggggggtttgataggtagcgcttgagtgcaataaatgcctcttcggcttcctgtgtccatacaaatttgtcttgtttcttcaataaggcgaagaaaggctgtcctcgttctcccatcctagcgacgaatctgcttaatgctgcgatgcatccggttagcttctgcacctccttgagtcatgtgggcggcttcatgttctcgattgctttgatcttctcgggattcgcctatattcctctgccagaaacaaggaatccgagtagcttgcccgacggtacttcgaacgtgcacttctctagattgagcatgaggcgatatcgtccgaggttgtcgaacgtttcccgcaggtcgtcaatcaatgagtcacttgtcttggttttgacaacgatgtcgtcgacgtaagcctcgacattgttgccaagctggttgctaagtgcgccctggaccgtacgctggaaagtattcccggtggttatcagtccgaaaggcatcttaacgtagcaaaataccccgaacggcgtgatgaacactgtcttctcttcgttctcttttgccatgctgatttggtggtagccagagtaagcgtcgaggaagcttagaagctcgcaaccggctgttgaatccaccaactgatctattcgagggagaggaaagtgatccttggggcatgccttgttgaggtctgtgaagtcgacacacattctccattttccgttggccttccgcaccataactgggttggctagccactctgggtgaagtacttctctaatgaagccagctttcaaaagtttgtcgagctcttcttgtatggcttgttttcggtctggtgcaaatctccgcagtctttgctttactagcttggcatcgggtcgcaccataagtttgtgctcaatcacctccctggggacccccggcatgtcgcacggctgccaagcgaacacgtcggcattatcgcggaggaatgtgatgaacgcgagttcctatttctcatctagtgtagtcccgattttgatagtcttgtcggggttagcactagagagcggaacgatcttgatggtgccgtctggctttggcgtcttatttggcttgctcactttcttaggtggctcagacgtggcgggtggggtgggcgtttgctcgaccatgtcgaggctccgcttgtcgcactgcaccgccagctttgcgttcccctaaatagtgattgttcccttcggtcccagcatcttgagcacttgatatgcgtagtgggatgtggccatgaacttcacaagtgcagttctcccgatgatggcgttataagctgtatcgaattcagcgacatcgaaggtgatcagggtgcagccccctgccacgtcgaacagacttcacgttccactttcttgtattctcgcttggaggagtacgttgtggaaccaccgaatatgtgtgagacgtggaggtcggagtctgggtacgcagaatccgattcgtgaggaggtgtctccttgttcttctcaacaacgcgtactcgcttgcctttttcaaacgccatgtgcttctcgagcgactttttgaaaacaaggcaatcctccagagaatgtctgtccgttttgtgtatggggcaccatgatttctttgtatcgctgccctgtcggtctgggcgcttgggagggttcgcgtattctgctgcgaggacttccgcttgagctttccttttcccgtttttgcgatttttcttcttgcttgactcagatgcgtctgcggatagtttcttctctcccccagtcttcggcttgtcgttcttgcgtcttagcgcgtcatccacatgggctcaccgctcaacgatctcgaataatcttcgagtagttgtgatgcgtcttgtcgccaactcctgggtagtgtagcgatctctgacaccagacttgaaggcgagaattacagaagcgtcggtaatctcgggaattgtgtttctgcactcgttgaagtgccgaacgtattccctcaatgattcccccgagttctgtgttaacgcatgtaagtcgtcttagatcgcgtggcgcttgtatgttccttggaaattggcgacgaactgttgccacaggtctgcccacgaggagattgagtagggaggaagatgcatcagccatgaacgcgcagaaccctttaacgcggatggtaaatagttcgccaacgcgttgtcatctgctccggcagcataaagcactgtcgagtagacttgaaggaattcttctgggtcggtgctcccatcataattttcaatggctctgggtcggaatctctcaggccatcggacatcacatagggaacgaccgaaagccctacacccagcactgggggcggtggtttgtcggcggtcgcgtgaccttcgtggatgtctgtccaacgatgaagaggacgcggatgatgacgatgacgatgggtcgcttggttctggcgtacgattacgaggatgacgacctggatcccgggcatcctgtcgttgtctctcgctgttgtctcggcgccgatcgccttcgtcgtcgtcgttgcggcgacggccatgaccagtattgtctggcccccgccgttcgcgatcgttgtagtctcggtcctcgtttgggcgatttcctcgatcatggcgtcgtgaagagacatgacgccgggagcgatttgcgtcgtcccatgtgcgtcgtgcttctcggcgatcattgatttgatctcgaagatctccaatgccacgaggtggaggggtagcctgtcgaggtaattccctccgctccggatctttaccattggtgtcgccgatcggtggctgatcttggtgtgctgcggtagcggcttcttcgaacgcattgctgaggttggtcaccgactcccgtaatcgttccgtccaacgctcgaggtcgtcgttcagaacgggatcgtaaggagtttccctctgtatggcttgaacaaccctgatgtgctgggctggagtagtcgattgatttgccgcctctgcattggcttgtgctgacgtgccaacgtcatcgatagccaatacctcccgcgacgcacttgttgtcgatgacccacagtcttcgaggagatgtaagaccgatggttcgtgggggtcgagatcgattaccccaacgaatcgatctgaggctggagtcgctccttgttccttgccgttatccctaacggggacgtatgacttaggagacggagttttcacggcgccgaggagaactttgcagctcgagaggtcgtgattctttgtcttgtggataggacaatagacatcccgagttagagaagtacgctgaattccgcgttctttgcaggcgcgaatttcagcacggacattgatgaatacctagcaatcttgaagggtatgtttcttggttttgtggataggacacaaagaccagataacttcggaagtcatctttgttggcccgtggtttatgtcggagggacaagacttggccgcatcagaatccttcacgagtttggatgtagtcgataatccgttctctgtttcaacgggtggatttttcgacatggagccgtcctggttcatagccactgcgttctcgtttccagtcattggaggaccggttgagatcggcatcgtggtgtaaaccgggaagacgatttcgccgacttgagtccataccagcattattgaagctgagagtgcttgactggagctggtgttgacgttgttgtcgacgaagcttgatggcatagtagtagaaccttgagtaccaagtgcccctacctggcgcgccactgtacgtagactggatatagagggtattggggtacgctggtacaaggatctacgtagtacgacatcaagtaatcaaaagacaagaattatactggttcaggccccttgacaggtaatagccctaatccatttgatatgggattatatggtggaaaacacaggttacaaaggaaagatggaacttgtcgaatccggcgagattaaagtcgagttgattcgactagctcttgacgacgtggcccctcgcaggctccggcttcgtaggctgtgtgggttgtgttggctctgagattcgatcctctatgccctccccggggggtcccttttatatcgcaggtctggtggtctccgagtaggactcgaacacaccagacccagctcaatacgtaggtaacccagttcttatccgagaaggactcttcccgtctattgatttcgtgaaaggtttccttagatcataaaggaaatatccgcgtacgcgtgggtatgccatgttgatacgtaacgtatatcgaagggtagagggtatgcttgacccgtaaccccgacaacgattgagatttagtcatcgacgagtgagaggcggattggcacaccctgaaantctcctcccaacctaaattggatttataaatgggtcccaagaaaaaatcggtgttaan

SEQ ID NO: 21712 - DNA, 2777 bp, Oryza sativa
  unsure (1)..(2777): unsure at all n locations
aagatagttcactcacttggtggtaatcaaacagtacgtagcaatctctggcacagctaactgccattggtgtcgtagagataattctactcgttcataggctcttgacacagcatgtagctatctctcgcacagcgatttccattggtgttcgagagataattctacgcgttcgctagttctctatacagtcagtagcaatctctcgcacagaaacttccattggtgttctagagataattccactcgctctctaggtctcgaaccagtacgtagcaatctctagcaccgaaacttccattggtgttcgagagataattctactcgctcactggctctcgaaccagtatgtagcaatctctcgcaccggaaacttccattggtgttcgagagataattctactcgctcgctggctctcgaaccagtacgtagcaatctctcacaccgcaacttccattggtgttcgagagataattctactcgctcgctggttctcgaaccagtacgtagcaatctctcacaccgcaacttccattggtgttcaagagataattctactcgctcgctatttctcgaactagtaaaacgtagcaatctctcgcatcttaacttcagatggttgaggaacagctacgactgatcttcgaccgacagcgtagcggtcctcgtaccacgactccaaatgatcgagagacacctactcactggttctcaaccagttaatcgtagcgatatctcgtacatttacttctagtggtcaatttacgactactacctggtcctcgaccagcggtgtagcgtttctcccactacttccactttaagtggtcaagatacgactactacctggtcctcgaccagtggtgtagtgattctcccactacctttacttcaagtggtcgagttggggctactacctggtcctcgaccagaggtgtaacgattctcctattacctctacctcaacaaaagttgatatcaggtacacaataatgctaagtgttttacccagagatcccttaccacgacgacacctagtgttgaaacctatcctactgtccctttacgccgtcttgacaaggcctccgaggaacctaagggaacttcggctggggacgcccagagccgataaggccttgtcggatcctgtagagacaaaagaccaagtaagatctggtcgtataagagttctcgccgtgcgtattaaccaagccgtgtaatcggaaattgagttttccaacttcacagctgggggctaggatcagtgcttgttcaaccaaggcaggtcaagggtccaagagccttgtcctccgagaacgattctccgacgacaaggctgggggctagggagagtgtatgactctacaaactgactgatcaaagtcggtaagagagaagacgctcatatataaaacattggtcggtaaatttaattcatttttagttttccatacaaattataacatgtcaccatttgagcgtttgctcgggggctatttctatttgatattcttttctgagtattgatttctggaaaattctattcgacattgtggaaaactccatgtctctatggttctacaccaagatcgactaaggcgagtacgacaaatgttgacaaggctccgtcgcagactctacgccttctcgatcgctcgagaacggttgctggatctcgacaaggaatacggaataaagagatggtgtacccgccgagataaaactttttgacttcaatccaaattctcgattacagcaagacgggagacttagtcgtatgttatgtactttcttggttgacgtcggagattgactcaagacaaaccctttaggtgcccgcacgaggctgataaaggaagtctaacgttatctctgaactcaccgagaacggtcacttgagctcgataacagttactccatggtcagcggtcgagaatatgaattcgttcatttgcattgaagtcgggggctactgtcatggttatggataccacatacctaatagtagtcgactaaatctcggcaggacccaccacataccatgtcttatacggaaactgacttcggatataaagggagttccggataaggaaagacaaccagtgttctacatggaaacgacaaggactgctcggattatatacatattgcttttcctagttctacttggacaagggaacacctatgggaataaatacaaggccccctaggaggagaggggacacggacaatcgacgaccacctcaatcaacacccaccacaatctacggaataatagatcaagacacaagatcaacatacaagccaacatacgccaagacaagacgccggatatcgacttcagggataagcacgactagtcccctacggtgtctctggatactgtcaggagagacggaagcgctatctctgatctcgccgggcacggattcgagaaggaagactaccctgttgtcgactacgagtcagaacttcagaccgccatgtcgacaacagttagataggctaccccaaatattgtactggtgtgattatggtgaataaagagcaacgaccggtttcggccaacaggatgttgggttattacctgataattcagggacccgaacctatataaaaatctctatctccgtctcgtttacctcagtctcgcatatatcctactaacaacgatcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21713 - DNA, 24486 bp, Oryza sativa
  unsure (1)..(24486): unsure at all n locations
cgccccctttgtcgcccnnnnnnnnnnnnnnnnnnnnnnnnnnnnnnnnnnnnnnnnnnnnnnnnnnnnnnnnnnnnnnnnnntataattagcaaacagctagctaacagcccacatttcaaaaagtcaatgtatgaaccttaacaacgctgctatacgtccgaccagcgtacgactcaacggcgaaatacacgggcaagcccaattgaattagcgatcgttgcagaagttacggacggcggacggccaatgacgtagtcgtgcgctggtcgtacgcgtcggttggacgtatagcattttcggaaccttaattactccctccgtttcacaatgtaagtcattctaacattttccatatttatattgatgttgatgaatctagacatatatatctatctagattcattagcaccaatataaatatggaaaaaactaaaatgacttacattgtgaaacggacaaatagtttttttgttccaaaatcgtgagagcaaaaggatcacggatggattcgcgacatgtgctgggaacagggcatttccggattagtcgtgcagataagctgatccgagcactttccatttgtattaaatttgctcgctcatagtactgctgatgtgatgcaaagattatcttagtctaattttgttgcaccttcttctttaggtacaacgtataataatgatcagaacgcgtgacatgcatgtacgtgctggttattactcccttcgtttcaaaatatttgacaccgttgactttttttaagtacgtgtttgaccattcgtcttattaaaaaaatttaagtaattatttattcttttcatatcatttgctttattgttaaatatactttcatgtacacatataggtttacatatttcacaaaaatttttgaataagacgaacggtcaaacatgtgctaaaaagttaacagtgtcaaatattttgaaacggagggagtacgtgacagtacgccaatgtctgcagttaatcaggactcaggagcatccatgcatgcatgtttccaggatatcaatacgagcccactacacctccaattataattaagttggcataggtaatttggacagctagctagcgcgtcttcgtgcgtaccaattagaacaggctataaatgtaagccctcagtttcattcacatttcaccactcctccggtgacagtgagtgagccgagggttttcgatatctggataggagcagactcatcgctaaatgtcttacccgactattcaaaacaccggagtacgtgggtccgtgacgctgacgctgtgaactagctagccatggccatggctgcttcttcttcttcctcctggtgcgcactgaaacagtcatgcgtggccctcctgatggctttggcttgctgcctaactacgtgcgcgcgcggcgcagtcgaggcgctgtacgtgctgggcgactcgcaggcggacgtagggaacaacaactacctgccggcgtcgctgctcaaggccaactaccctcacaatggcgtcgactacccggggggcaagcccaccggcaggttcagcaatggctacaacttcgtcgacttactcggtgagtgtatatctcaaggccattcattagctagttaattatagtacgtttattagtaatatatatattgagtcaaaaatatattttgatagctgatatttttgggataatcgatctaacattcaacgcaaaaatccctctaaaaatatatcaaatataactacgataaatatatatatatataattatggtgtaattataatataattcgcatgtacttacgtccctaaaaaattcaaaagttgtgctggcttagtgggggctgcctgcggttgtcagtttgaccctcacctcgcgcaatgtcctctgatttttacccaatacaacatgcatagatcgtatagcccattcggtggctgaaaatttgatacgatttttaccaattttttttgtcgaatgtgaaataactaggctgtaaactttttggtgtattcggatgcaccaacactctagctcacccatagacatccaggcggttgctataaaaatagcaaggcactattattccccgggtgagggcgttcacactgcatcaccgtgacgttcagccctcgagacgccaacagagatttggactgccacgttctcgccactgctgcgctcctgcgaggaacgtgctaccaaactatgacgcgcgaacctcgtgttaggtgaggccgcgtgatgggcggagcgacgggatagagtctgcattggacctgcgatgctgtccggcccccacacggcacacccccactcccacaagccaccgcgggtacctcacccaactccggtaagagaacaaaaggggcagcaacagcgagatgggggaagaggggcctacctttccagccgccgctaaccggagaaagaagagaagacaaaagatggaggagaggcacatagccttgcaggcctcgtcggcacgagccgccgccggattccgaggggcgaagctcagcagcggcgtaggcccaagccaccgtggggacctcgtagcccgtgcactacgccactaccccgatctggtcggcggtcaccccgatctactcatcgccacaggtgtcggcgatggggaggggagggagaggtgtcgtcaacagggagggaggggagaagaaccggtgatggagagggaagggagaggtgccatcttgttaatagagaaatagaaagggctaaaatagaaaatatgaggggctaaaacaaaaaaacgaagccacacatagagacccatgcattgtgggagacaattttttttaaggtgtggttttagcccatggcacgtgaggcaggccaaattcttctggcacactgtgaacgccctgagcatacggtatgatcattataaatgatctcttgtgtcagtgcctgcatgtatgtactactttcgcaagatctataattcttagagcatgatcaataataaggtaatttagctccaattatgtccaactcatctataacttactttgcagcttgtacacgcaacatctagttgtattgttgggtcctatatgcttcacatcactattaaaaaattgcagcatcgatcctatgttgcaatttttgcatagcagcatttctctcactctctcacgtccaacgtttttatctagagatgcgtgttgcagcccgatgataaaattgtcgtccgctcgcgccagctcatgcatgttctctctctttagctcttttccctatatcaccattgctatctacgtggacttagtgtcgcctgactaatgtacctgctcttaagaaaactacgaagacccttgctcttaagcaaaccatgcatggttaggcaccgtaaaacttcgccaccgctaatcgattaacttcgccaccgcgcagagcgcttgcttggctagagccaaacaaaatagggaagttctaaattaaataacatgccgaaagtaaaggggaatcagaggaaaaattaactatgtgtagtatagcttcaatagggcaggctagctagtagcttagcttcagcatacacatgcatgcacacccgctgtgaacgaaggagcgagcgagcgacgatgggttcttgcacattgtcctccggcggcgtctgcgtcgtcgtcgtcctcctgtgtttggctgcttgctgcctaacgtgcgcgcgcggcgctgtcccggcgatctacgtgctcggagactcgcaggcagacgtagggaacaacaactacctgctgcactcgctgctcaaggccaacttccctcacaatggcatcgactacccggggggaaagcccaccggcaggttcagcaatggctacaacttcgtcgatttaatcggtgagtatatatccatcatcatcgatcgatcgctgcgtacacgtacgtacggccattgtccacagcgtatttttatgtcaaactgttttcatgtgctatggacgctcgcaccctacgtggaggatatgtgtcgtcctagaatgtttaagcatgattgcaaatctaagtgcctcatcttttcgtttatacttatacttatcagctaaaatttaaattttcaatcttaaatttgaagttgattttgaggtttttcatcaaagtttatttgctagactttgcttttaaatcgataagaatacgtatataaaagttttattcataaattacttttcgtttttaaatatgccgtttggcttattccatgaataagcaatggtcacctaacacaataggtgttttcggtagtgcttgctattacagcagcgtgcaggcgacagcaactaaaaacggccacagcctagcactgcagtagctagcgtttcaatcagcccctatgttgacgagagtatggtttttttttttttagtttttcagttatcaccaaatgtattcatgtgcatatgcatatgtgttttaccgatatttatgtattgtattaaaagtgttactccctctgtattttaatgtatgacaccgttaactttttaacaaacgtttgacctttcgtctaattcaaaaaaattatgtaattatcatttattttattgtgacttgatttatcatcaaatgttctttaagcctaacataagtatttttgtatttgcataacaaatttgaataagacgaatggtcaaacgttagttaaaaagtcaatggcgtcatacattaaaattaaaatacggagggagtatataatattgaaatatacaaacagtaaaatgggattttcgcaggcaccctcctaagctgcagaggcaacccaaaagggaaagcgcttgtgcaacgcttagatcagaaaatccagcttagtaggaattatttaatgacagagagttcgagtttatgaaattaaaatgaaacttccggacatggggttgcatatatactggaacttaagtctaaaattaatggaatcttccggacgaattgtttgaatcaaatagtagagagctcgaggtttgggaaaaccagatctgagccccctccgtttaatttgtacgccaatatgaacatgttggcaggtccgatccagcactgactgattgttattctcacaactaggatggtagctcgcgcattcgcgcgggcattcatgaatcattgcttaaatgtttcttttaagatatttgttagtttacaatatgtaaatttgattcatctatataagcacctatctataaagttaatcatctttatcatttaagaagacgtaggtcttaatccaaattaaagtaaggtgttgtttttatttttaattaaatgttttgggctcttatttaaaaaaaattctcaaaaaggttatttataataaatgtgttttattccttcttttaattggttcacaattgatgcaattttttatacgtacttatgtatgaatcaataaaaatatagagtagatatattctagacctcgcttcctataatatgtgtgatctatatatttgtttaaatacatttagtcaacccgagtgttaaaacccaaatttaatagtaagaaatataatattcaaagccaactatcttctgctatggcatagaacagagagaagtctattgatatgtagtcacttaaaaatgatgaagtggttatgcatggttatctcaatttaagggaaagttatgaaccacaatggttctaagaaattataaggttttctagaattggttcattttacacttttgttttattttatacaaatattattttaagttcaaatgtatgatatgacaaatagtgacatcattacaccctatgtgtcaactttttttaaaaaaaaattatcaataagcaagtaagattggtatagattttcattatttattaataaatggattatatgggacataaggctatggtaaattgatgggtttgtatactccaatatatttgcattatgtgatagataattcatttgggaacgttttatatataatgtgtgaggctctacacaaccattgtgaatacgatttgatggctaataatacatcatagagagagggaaccgaatgggtagagggaccgatatatacatgtatgtactaagtacgcatgtacatgatggaagggaggacgtggcacacgtgggcctttcaattgtttaataacaaaaatctaattagtccaccatgttttatggaaaatcaatggttgtgaatggacttgaattatttattttcgtttttcatctaatctaaataaaaaagaaaaaaatagaaaaagaagtagggtgggatgatacgtacgtacaaacgtacatgctgtacaggtacacggaccgagggataatttaagagagataaattgatttggtaattttgtactcgcaagatagatctaacggtggttgatttggtaattttgtaaaatagatctaatggttgaaaataatgggtctacccgattaaaagaaaatcaacggttagatgttttgttttttacttagaatttttaggatttatcaatacgccacgtggcgactttggagcgtttttagaagcaccacgtggcagcttgagagcgtttgtaggaagtttcatggacttttagtatataaaataaaatagaagatagatagatcttttgaaacttgacattatttttgctttatctctactcaaaaaaaaatttcgttggtgtgtgtgtgtttatatatatatatatatatctctttttgttgtctttttttttaaccttttttccacattgcagctatcagtctcggggtgcccagccctcctccatacctctctataagcagcaaaccaatgaacagctccgtatatctgaagggtgtcaattttgcttcaggaggagcaggggtgtctaatctcacaaacctggtagtactacaacttaatactagggtcgaaataaagaaaattgagtgatgtttcggtgctctctacctataatattatactaccagtatattattataggtaaaatagtaatttactaatacaataattatgatttactttgtcatttatatatgttttttcccggctaaatatatttcatcgaaaaagccaaaaaagagggaaaaagtttagttactgctaatgatgattatacccttttatacattttttgttacaatatacccctccacatttctattactgctaatagtggtagtagtacaaataaattttaacacttcgattaaatgagatcaacggttcatactgtcttccaataataatagagagcaccacactgaggctcaagaaaattttgaatatatttttagtgtaacacgaacagaatatgtatgaatcagaaatttaattacaggttacatacttattaatccatcaattaattattacatgagtatttaattctatattaattattacatgagtatttaattctagtacggcgcatgcaggcccagtgcatcagcttcgacgagcagatagagggggactaccacagagtccacgaggcgctggggaagcagctgggcattcctggggccaaggcccaccttgccaaatcgctcttcgtcgtcgccatcggcggcaacgacatcatcaacgacctcctgctgagtcccgtcagcgagctcctacgctcccgagatgagatcgtcagcaatctggaaaataccctcaaacgccagctgcaggtacgtatacttatgcttgcaaaacgatcttgcaattaaggtcaacgtaacatcaggccgggtttttgcagtttcggtttcgaaacagtaatttcagacacccccaccggccggctggaccaaaattttcgaattttctcaaatgtttatggatttagtaacatcacatcaccttcgttgctctccatacaattctccatgtgcttactactatctccatttcattttataaatcattttgatatttttttttcatttcaaactttcttaagtttgaccaagccttctacctattatatactaaaattttattaaacttcttatgaacgcttctaagccaccatgcgtcattgcttccgagtcgtcacatggcactttaataaaatagagtaatataatcatcgatttttatttaatttggtgtaccattattttagatcaataaatctatttaaaaacaaaactaccttgatctatatatattaaaaaaaacaaaaactcccactgtcccagctgcctaaatgcggcgtacacatgtatgtatgctccctccgttactatatcgctctcctctttctgtcctcgtaataattgaaattaaaattactttcacggggaaaaaaacccacatgtagacctcgacctagctaataagtccagccagctttccctctatccctttatccattaatatttatagtctattaaacaacatacaaatatttctaaaccactacgtggaactacggaattaaaaaaaaaatttgaccatcggtttctaattgatttgataggcacattattttaggtcgttagatctatcatttttcttaaaaaaagcatcccaaacctccatccccagtaaacatcctataagcatttctaaatagatacgtgtactctaaaattagataaaatcttaatattcaaacattttaccaggacaaataaaattgaaatatctaaagttttatatagaatctatcaaaaaattggactttttggtaaatttttttggtacgatatccttctggggagacgaaatacccaaaattttctcattagaatcacatatattattttaacacagtattttctcataaattgaaaattgcacggtttcaaataattttagtatagaatttatatgctgcaatggtaataattagaaaaaaaaatcataaccaacgttcaaaacacatcaaataagtttaattttagtttaggatatagtaaaagaatatttaaattaacagtcactctaacatgaacattcataataaaacttcacgcacattaaataagatgcccacgtatatatgcgggctaccttcgtactttatagaaaaaatttacaatacctaaaatgccaaattagtttatgtaatatagaattcaatatattttgttaatttgtttgttttctattggaaatgctactatattttttttataaaattagtttagacttaaataagtttgataaaagaaatcaaaacgacatgtaatatgaataaggagtgcaaatctatcatgattttagaccttgtacgaccttgggatgcgacggttgttcttcgtggggatagcaccgctgggatgttgcccgttgatacgggagctgaaccccaccaaggaatgtgatgctcaggccaactacatggcaactcggttaaacgatgcggcggtcgtgctcctccgcgacatgagcgagacgcatccggacttcacctactccttcttcgacacatacaccgcggtgctccagtccattcgttacccagaggcacatggtacgtatgtactccttccattttaaaagtatagcaaacctactatactccctcttccactttttaatatataacatcattgttttttaacgtgatatttgatcattcgtcttatttaaaaaatataaatattatttattttgttttgacttattttatcataaaagaaattataattcgaacttatcctttcacatatttatactaaaattttaaataggttgaatgatcaaatgttacgtgaaaaagtgaattgtgtcatatattaaagaaaaaggaggtagtacatatattagacggcaccggggtagtactataaatctatacaggaattagattactatatatattaaggtgaagagaatatggtttattaggattaagattctccacatttgtcactttattcagtgattttgtttttttaataggctataaggaggttaaagcagcgtgctgtggcctaggagataacaacgccatgttcctatgctcgccggcgagcgtgtactgcgacaaccggacgagctacatgttctgggacgtcgtccatcccacgcaggccgcggttgagaagcttatgaagattgcgtttgatggatctgcgccgttggtttccccgaaaaatatcaagcagctcactgagagttaggcattatataaagccaagagtacgtgtctactggtactactatactatactactattatcaccactggagaaattttgaatcattaatttaggagttatatttagtgccagtaactaacgtggtaaagtaaacaagggatttgctagatttgaggtgactgatattaatttgtaaatttacagtctcctaaaattacacattttgcaaagtttaaaattgcatagctatacaatgtgaaactttacttattttaactatgatttttgttgttatatatatccatggtttcactttatttttctccatgtttgatttttttcatttaattatgtattgtgtataagctataagtttatttcattcaattttgtaggttagaataatttattgtacaaccttttgcctaaagaaagaacgtcattgtaataaaaaaacaataggatgatcacaatcattagattatcgtacgatggaggagaaaagtcaccaaaccttttaaaaatttgaggtaccggaaatccagaaactttcaaatatgtggtctagatcagagtactgataaagaccattggaaaagagtagagtacatcactagtttctaaggcttcgttcgtatgtgcgagtcctgatccggttcatgttccgtgcactggaagcgtggtcccgcacacagtaccaaaacgacggcttgtgaggcgacgttaacggcgttaacggatgtgagaagttgcctttgcgcctcggcttttccgtcggagttagggcatccaatgctctcgatccctctttcttcctcctctcgctgttgctctcttgcttccgcggtcgtcgatgcgacgcaggcctggaggagaatcgattcccctccgctgtaggctcccgtcctccccgattctcgccagccaccctcctcccctttcgactgtggcttgcaggcccgtgcccccccccaatcgattctcgtccgcgcgtcgtcttgcggcagcggtcggttcaaggtgctcaaaatcggggggaagtggaagagccccacgcctgtcgagctgtctgcgtcgtcctcgaggggagaaaaagctggccggcgtgctcgctgtgaagcagcaagcatcggcgcccatcaggccgcccatctttggcagtctggctgcctgtgtgctcgtcctctcggcctctcaggtcagacagtgctggcttgaagagtctcatcaaggcatccaagctggcggagttgaggagccagctctatttcaggacgagcgtgtgcgtggtccgatggagacgagagtgaagaagcggaagcaagagcgggatctattgtcgatccaagaggaggggacgattgttcaatcccctcaaacaggggagatctctgtccgcggcgccgatctagagtccggcgaggactcctccgactctgtcacctccgacgctggcagcgccaaggctgctcccgacgacgtgcttcatatcgcgcatgccctctacaaggtttgcgccaagtctcctagagccgtcatcgactttgttcgaagagtgagccctgccaccgtcggccgttcgattgattgggacgtcgtccgtgaggaagagtcatcgaaggtattggtttgtattaatttgttcatttccgattcaattttgtttgacttgcacgtagtagatgggcgatggccgtagccggtggaccgatatggaggttcgtgtgtttcttgagagctgcttggaggagatggcagcgttcaccatcacctccaactcccccaagccgcaggcatggcagaacctaatacacaagatgtacaccaagtgtaagaagaaggtgaacaaggctcaattggagtacatttgggggcagtgtaagaagcggtacaacaggtgggtgtggctagaatcacatgcaagcgggctgggtcgtgatccccatacatcagccattgttgccgatgatgagtggtaggaaagcaaaaatgcggtacgtacacttgacaataaatattttgaaccaacaatttttcctacaagaggtattatctgaaatttagtacatgcatgcagttataaatacagttttgtgaggtgtaataatttttttgttcaagttgtgtgtgccaacaaatgactagctgcagtaaaatggaaggattgtgctcacatatgtttcatagttgttactgtcatgtcgtttttagtaatgtgtgccattcccttgtatttaagttaacaaaatgatgtttacactatttaccatgaactgattggcaatgattgcgagaagtaaatgatcttgtacatgtgacattcaaaagcattttaacagattcacatgtgtttaattgtgaaggatatagcttacacaatgtagcattctattagcttatgcaatgtagcagtcaatgtaacatggtaatgctcataggttttgttctctgcataaacaaaatctatatgcagtgtatcagtaaattaggaaagatcttgtacaagtcatttaggaacatgttaatacatattcaactagctgtacacaccttctttctgatgtatatagagagaatgaacaaaaatgtgctcatctacaaagaatataacatatgcagtttatcttatgtttacaatgttcaaactatctttctttcattctgtcagatgtgtggcccattgtaacatgtactcctgattatatttgataacttggtaccaatgtgcacatttactgccagcattttagtagtaatgcacattggactgcacatattcattacgttcaatgtttgcacaagcctaatgcacttgccttgtactaacttgtttttactgtctacttatgttgcagcaaaataaaggtgtcttaagcttcaggaatgatcctctgaagcacattgaccttcaccacgcggtattcagtgggcgcacagttgtcggaaaccactccgccgtcgcaggggcagccccagccgcaccgcaaggagcagttcagtggcagaccatcgacatggcgcagctcgctgctgcttatagaccaccacctccaactccacccccaacggcagcagaccggggcaagggaaagaggccagcagcaaacactcctgcctcagggagttcttccaagaagtcccgnnnnnnnnnnnnnnnnnnnnnnnnnnngaggattgcggacatccgagagcagagctaccagagtcatgctgcttagatggaagcagagaagtctatgggccttgatgcgtgcatggagttggtggaaaatgatggccatgaaattggaggaagtgtgtggtatgctgcttgtgcgctattccgtgacccattgacctgcaaatgctttgttcaactcaaggacgcctctaggcgcttggaatttatacgcactggtggtactggacagtcatctggtggcaccaaactgtactttactttgagttgtgatgtgcgatgttttccaaataaactagtatttatgtttagaactctgtgtgctaacaatttttacattctgtgagtccctaaacatttgcggctttatatccaattcgagcaactacgtattccattgcattgcttttatatccaaataattcttcgattgcatagatcactgccattattaatttctatccttttgattatgacaaacattgcgtattctccggttctcatatgttaaaggaaatcggcgatgagttacggcgcgggtggatcgagttggaatggaggcggtcacacaagcagcaaagaagaagatgccatcattgagtacgtggctgctacccttgatttcaatgagagggcaccaaggagaataccggtgcaaaccggtatcagttggatgatggacacgatggcaaatcgaagccaatgcagggcaatgttcaggcttactgcggaggagatacacaatttgcatgatctattggtcacttcttttggtcttgtaggaacagcaggggtctgttccatggaaaagcttggtattttcttgtacacgatgggtggaaatcgtccaatcagagacgggaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtggatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcagtcaatacacttttttttattgccaaatgtcttgattttatttaattctacacatgtgcactaatatttaattctgcgccgttaaccaggcaggtacctacttgtcgactccggatttcctaccaggatgggattccttgcaccgtacccacatgtacggtaccacagggatcaacttgcggtcgagggagccccaccacccgtaggacgggaagagactttcaaccatcgacactccacgttgcgagggatcgtggaaagacaatttgtcatcgcaaaaaagatgtggaaaatattgaaagaaatcccttattaccgagatgaggacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgagcatgttgcgtgactgtattgctgatgatgcgtacaataactaccattaggtaggtgatgttacccataatgcttgtcgtatgttcagtacttcaattttcaagattgtatggtttaccatttatttttataacgttaacaacaaatttgatgcaccgaatcttgtgttatttgtttcacaattcatttttttcttaattcttgcgttattatttcagacaaaaaattaatcaatgttattgcaaaatttatgtccgaatcttcacatattatgaaaattattatggtaagaaatactgcgtcattacgaaatggttttctgctactgcatagcacaattgcgaaattcaatctacatacaatctattatttcaaacgaaactacatgaaattgaatccatatgaaattactactgtaatgcaattcccatttcttctcaattttttcaaatcggggtgtgttttcttgtgtgcatctaccaattcctcccacgcatttacaccccctgcagcgcatccggcggcaacggcagccattgtcacgcccagaaattcccgaatagaattccaagcagaatgtgcattaaaacccccgtcgaggactggccggggtacacaaacgacaatgttgacatacagatccatgtcttacaaacattataaaagtcttacataaatgcagcggaaaaacaaaagataactggagctaatccttgacttgaactacagcgggaacaccactccacaggtatcctcgacggcacggacgaagcctactcctcagagaacccgccatcggatacatactcgagctctgggattgggggaaaatagagcaaggctgagtactatccactgtactcagcaagtcataccggaatgggggggtatgatgcagggattcaacaagggatagctaaacaggttcatttgcataaatactggcatttataaacaggaattgaatgcgaaaacagttgtaataattaagcagaattaatcgtccactatccaacgttacaccacgttgcaacaggcccaatcatccacctataccatccaatttcattagactaaactaaggtgagtctaatcacggtgagtctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggatccttcgcataaccccctctagccaagcacaccacacctcaggtttcacccccgtccccagcgggcaacgggcagtcccctctcgtgcctaggtgaatccgaaagcgacagaggccgtcgcagggcccgccccgctccatcacgcccacccttgcctggatgcgtcgactagaggaaagctacactacaagcccagccgttgcccacgctggcttgtggtaagtacgataaattcttccagggtttcccgcgaaccggtccttaattgctatgggcgcgactagcaaaaccttgcacccacagcccaccatgtgattcattttatttaaccaacaccagagcggtggtactaatccaacattatcatataaacctatagtctaggttttaaatgagttttccccattgtgtgctagttgaactaagcatggctaagcaattcctagtccaaagtctaatcatgttataacccaagctaacaaaggagcatggtatccaaaaagcatagctgtaacaataggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacaatgcaaacaggctataagactactgaaacagagaacaaaaccatttttaatggattctacacatttttcttgatttactgagacttgaatgggcttaaacggagctcggatgaattagttatgaattttagaagattcaatgtgtttattactataacaaaaatccttaaataatttattgcgcaatattttccagggctgacgtcagcacgggggaggcgcggcgccgacaggcgggccccactggtcagcgactcaaggggggcggttcaccgtggaccgggaccacgcgggtggtccaccgccggtccacgggaccgacggcccagatcgccctcggggccgatcggacgggcggcgatagaggcggccgccgggctcggctcggcatcaaagccgaccggccagccagggctagcggcgacggcacgcggccgacggcggcggcgaccggcggcacgggaggcggcggcggcggccgaaggcgacggcgcgcgacttgaagcggcggcgcgacactaggggggaggaaggggaaaagaggggagggatgcctcaccgagggtggccggcgcggaggaagacgacggcgaacggcgacgacgagccacgggaggacgacggcaaccgacggacgggattcggggtgccctaaggaaggagaagagagagattagagggagggagatgaaccacggcgaccggcattcatggccgaaggcggcggtagaggttgaactcaccggagcgcgaggggatgcgaattccggtgatgaatcccgacgtggaaggggcggccggggtgaagcttagcctcgcgaacccgacggcggcgacggcgcggtgcggcggcgaccctagtggcggctagcggcggccggagtggcggaaacgacgtcgacgggtggttgcacggcgcgggatcgatgggtagcacaagggagttcggcgagatggggaaaaagcgagagggggcgacaggcaagcttaaataggggagggtagtcccgtacgtggccggtagggcgagattttgccggccaacgtggggagtggggtaggagagataggcgggattcgaaaatcgaatcccggccatctcgggcgcgggtgcgagcgcgagagaggggaaagtgggtgcgggagatgcggcgcactcgcgggtgtggccaacgcggcccggaaaagacgaaggcgtgaacgcggcggcggttgcgggcgcggcgacgccggctggaggaaggagacgggcccgacaggtggggcccacctgtcggcgtcccttggagagagggaggggcggtttgggccggcccacaagtagaagggcgcgcgcgcggcggggtggaatgtgccgacggcccaagaagaggaaaaggagggaaaaggaacaaagaaaaggaggaaaagaatttccctgggatttaaaatattgcatgctcgattttaattggttaaaattatttcgagagctctgaaaattccactaaaaatcttgttagtgaatttcgacatgtagaactcaagaaaaattctacatgccaattccgattattatttgcattgatttaatagggttaactcttgctttgcaccggtattttcttagggtctcttattaattcgattttaggcttaggaggagaacttccgggtgtgacagccatccttctctcgacgacggaaagtgtcggcgctccaacggcgcggtggacgccatctcgtccgtcaactgctacagtaatatactacagtagcagctacagtactcaggttcgtaaatccctggaaagcttccaaacttgctcatacgaacagagcctaaacttgttcgtttatgttatctgttttcatacaatcaaaaatagatgtagttattaactggttaacgtgtcatttcagtctgaaattgcacggatccctctaggattctacatggtgttaatgtgccacacggacgctgatatagcatcactactaactctacactgactgaaatgggtcccacttaggaatttccttttccttcttttcttcttttgtatttttccttgtccatcttatctcctttttttcccctttttttctcattttccactacaattgttgtcgtcaaggtcatcgccataaacttgtccatgttgtcattgggatgaagggaacaataacgagtggctcctctgctttgttgtcacctccacgagagggggatcatgcacggtgtcgtctacatccttgggagctgttgtttggtgtaggggcaaaggtccgggccgagatccagacccaaaacaccatgcatggcacgaacaatggataccgaagttggaggttgtccctagtcgccatcaccgagttagcccttgctgcgggccctcgagctcgcccccccccccccccccaaactcttcaccctatcgcctctattgagctcgtattcagtcaccacagatgggctctgccatggtcatgggccctcaagcggtcacccgggttgccaccatccttgagccccttcatgtatatgagccgtgcatgggaagaggagaagattaaaaaaaaagaacaaaaaacagaggaaaagaaaaaaataagaggggaaaattgaaaggaatttccgtgaggtggcaaccaacaccagttaggataccggaggcgtcgtagcaatttgggactaaaatgatatactttaacaacttctaagacctagatatgtattttcagagcatggggcctagatatataggtgaacaaatttagcaactagtcatgcactttatatatataagctaggggcaagaccatataggtgtaaatggccgttgtgaaattcatttacataagggtattaacaagcactattgcaaaaagtcacatcgtcacatggtttaaaactggccgaagcttacacgtgcttgaaccgacaaaagtacaatcttaagtggtactgactagcatgaatatcacaacccactgtgatgagtatcactccaacaattgtactattttcatccgtaagaatacaatacaatttgcattattttagaaaatttactttagtaaagattcctatagtgtcatttttatctcagttgacatttgatcatgaacatcatgagcaacataagtcaaccaacgcatatactccctccattccataatataaagcacaaacactttgtaacgtcccgcctctcccaggccgggcccgcttacatctgatagcttttataggttatagactgccctcacagaccaatacaagtcttttctgcatactttgtcctcactcgtgcgcactcgggaagaatttcccgatcagtcacccatccctaaattgctcaaggccaaacacgcttaaccctggagttctttggaaatcggcttccggaaaagaagttgcaacttgttccaggaacgtcccctcctggccacgtccgtgcgtccagtgccagcacatgtgccatgctgtgtgaccactcccggtccacaccagccatgcgcaccatgcctgcgcaactgcgacacacgcactcgtgaaaccgcgagagtcggctctgataccactttgtaacgtcccgcctctcccaggccaggcccgcttacatctgatagccgtttacatctgatagctttcataggttatagtcttatagactgccctcacagaccaacacaagtcttttctgcatactttgtcctcactcgatcagtcacccatccctaaattgctccaggccaagcacgcttaaccctggagttctttggaaatcggcttccggaaaagaagttgcaactagttgatatgagtattctattaatcctattaagccctgggctgggatgttacacactttttttagatgttccataatataaggcatacatgcatgcatgtcattaactatgacatattctccattaaactactattttttaaaatccttcactctcacattctctaactctattggatgcatgcattacatttattaggataatccaaactacaagataataataactatttcttggtctttggattaaggtggttgtgccttatattttggaatggagggaatatctaactaaaataccaagagcaccacaagagaaacacttacgaggtgttgggcatgacaaagttaggttgtaggagctaaacctggtctctggttcctccatgagaccactttatatggatcataccgatatgtagaaatgaggctgctgccatggcattgagtggcagggtagcaattaccaaggctcaaagcacccaatgccaggtggcctaattaactatcaaaaccttagctataattattaaaaaatggagcaaaaatgttcagaaatgaagatttacaagaaggcattttggtactggtctcccggacttgtacttgaagggaatcaaatggcttgatgagaaggagatgggccacaggagatacgatgacctacaaccagtttcataattcctattaatgaaagattgttatcatttctgattagtgcgtgaaatcagaatctaaactcctttagatattaagtgttgtaacctgagttgaaccaatttagatacttgcatatcagcgaatgggaaagtacaaaattgaactctaaatttcatttgttgttaccggtaacttgtaatatggtgcagtcttgtggcgaacaccaaatccccaatccatttcttctactccaattttcataacaattttgaggcttcatactacactagactcgagtgaatggtggaaattggtggagtctgtgtttgaaagggacaaaaaaccaaggaagaaggaaggttgtttctgttgcaagaaggggatgatgttgaggaaggagcaacaatctacaactacaggagggttcaggaaaagccacaatgggatgggcaatcaggagacagatgggtcgagatgggacaggtggaagagctaattgtgattggtatattggtagagaagaaatagaaaccctgtaaagaaagctatctttatataaactttgattgagagcaagccccgtatatggagttaagtgcatttccaggctccagcaattaatatcccatattttggactccctaaaagccaaatggctccatgtcaagcacaaacatgtattgctcagcctccatttctttttctcttctatataaacatacgctttatgtataagcatagtttaacaccacacaatagttcaaacatgaatatttatggtgcaaagaatttactatattcaaattaaaaatttcaagcaccataatttaaattcaaaattttcaactatggatgtgtcaaataatcctattaacatggatgtctccctcgttgtgtgatgagtatccaacatcagtagttcagaactatgcatgacaataaatcactgaccaaaaaacaagcatcaagcatcacgtattcctgaatgttaggaatgtctcaaatgaatggccatatgtgtagcaaaactagcaaccattgtactatccatgagattcctgaatctcttcgaaaaccttgtagctagccgtcgacaggctatagccgacaacggtatccataaagcataggggtcattggtactaggatatatgcgagattgtatcaagaagacatgggacaaggatttatactggttcaagccctcgagatgaataaaaccctacttcagtttatatgtattgctggaaaaagtaccacacaggttacaatgtgggaatctgtaaactactctaatctaccgactagaacccaccgagtacatctcaacgagtggaatacaatgactagggctttggctttctccggattatttttcagtgtggctctagctatggcttgtgatttgatgccctaccttcgtatggggccttgtatttatagcagtaatcgctttcttcttcaagtagatctcgaagatcacgggcatggtacgaacattggaaaacttatcttctttggatcggactgacacctgctatcccacaaatatagtttccttccgagttcgtcttatctcctcatctaagtataccttctcgtataataacattaggtgtgcggtatctcaatacaccacgaactcaagtataggaggtatgccttattcgtagcactgacgctatccttcacattatcacttctatagtacatggtggggagtgggttacgaacaaaaatactatgaatgaacccatccttaatgatcgatgcatgaagttgtctgtctaactcaattgaatttatagagctgaaaacggaaggttggcatttgtcatttggccctaggccatcatgaatcatccaccttaacaactaaacttttggttactaaccccccaatatgaaggctgaccaaatacttctattgcttaatgtgccaccttcctaacttgctctaacaactcaatagacccaaagtttttatatgttgaaatcaaagtatccttgacaacgtagaccaagaacaactatatctttgttatcataccatgcatctggcaagccttataccatagacttccgagagcaagcaagcaagatatacacgaacccacaccatatcacgaaacatattgatgaacaaacattccatgccattctacactgccatggagataaccacacctgaaaccatgtgttgcactagtccctatctacaaatgccttgaacatgtcagaaaagatgccaggcatagttgcataacagatcaggaagggagcacggtggggcagggaggggagggttgcggactgcccaacttggggatcctagggcatcaggcaaagtaggcttggagtagggtagagtctccagtgacgctgatgacagcaatgaacaatgtagccgggcttcttttctaagatggtgtagcaagatgctagtgtagggcaggcctcatgcggagcgggagcaggtgtcgcagtcacgcgggatcaattcagcacaggcacgagaccagaatattcctctttcacgtagaagctatcgatgggggttatagtttagagctccgggattaagggatatgagttgagatttgggtggccttcctattttttaaagggttctctagcaggggcattgttagacctttttttacatcagtcaaaaatatttatgggttatgtttagaggccttgtgtcacaccccgaagttttcctcccaagccaaaattttaatttttaaaacgaccctaagaaaatgcaggtgaaatcaagagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttccttttctttttctttttcctctctttttcctcctttttttcgaatggcccgaggggccattccc

SEQ ID NO: 21714 - DNA, 11369 bp, Oryza sativa
cgcgcgatgaatgaccgatgactatacgcctaattcgagctcggtacccgaatgggccgtcggcccattccctccttcctccccctcctccttgctgggccggccgcaggccgaggcccagccaggccgcccgccgccctcctctcccggggtcgccgacaggtggggcccacctgtcgggtccttcccccacctcccgccgctcccggcgcgccgccgcgcccacgtctccgcctcctccgggccatgtcgaccacgcccgcgcgtgcgccgcgtctcccacgcccattcccctctctctcccgcccacgcccgcgcccgcgcccgagatggccgggattcgattttcgaatcccgcctctctctcctcccccactcccccacgtcgcccggcgattcccgcctctcccggccacgtacggtcccctctccccctatttaagcatcgccgtcgtcccctctcactttttccccatttcgccgcactctctcgagcctaccatcgctcccgcgccgtgcaaccccttgccgccgtcttttccgctactccggccgccgctagccgccgttagggtcgccgccaggccgcgccgtcgccgccgtcgggttcgcgtggccgagatccaccccgtccacccttcctccgtcgatgttcgtcggcggagccctcgttccctcgcactcgggtgagcaccacctccaccgccggcttcggccatggtttccgatcgccgtggtccatctccctctctctaatccctctcttctccttccttagggcaccccgaagctcgtccgcccgccgacgtcgtcctcccgtggcttgccgtcgccgttcgccatcgtcttcctccgcgccggccgccctcggtgaggcaccccctcccctcttttcccctccctctccctcctagccgccgctttagcgccgccgcccgttagtcgtcgctttagcatcaccgcccttcggcgccgccgtctccgccggcggttgccgtcgtcggcaacgcgcgtgcgcgtgcgcgcgccgtcgccgtgaccggtcggccggctttgtgccgagccgagcctagcctggccgccgccgcaccgtccgatcggccccgggccgatccgggccgtcgatccccgtggaccggcggtggatcacccgcgtggtcccggtccacggtagaccggccacccgtgcgccgctgacatgcgggtcccgcttgccggcgccgcgccccccttgatgacgtcagccctggaaaatattgcgcaataaatcatttaaggatttcttttataggaataaacacagtgaatcttctaaaattcatatctaattcatccgagctccgtttaagcccattcaagtctcagtaaatcaagaaaaatgtgtagaatccattaaaaatggttttgttccctgtttcagtagccttatagcctgtttgcaatgtttgctttgtatgtcgctagattccgattcctccgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatagtatactatgggatggttacatgttgttacagccatgcttttggataccatgctcctttgttagcttgggttataacatgattagactttggactaggaattgcttagccatgcttagttcaactagcacacaatggggaaatctcatttaaaacctagactataggtttataagataatgttggattagtaccaccgctctggtgttggttaaataaaatgaatcacatggtgggctgtgggtgcaaggttttgctagtcgcgcccatagcagttaaggaccggttcgcgggaaaccctggaagaatttatcgtgcttaccacaagccagcgtgggcaacggctgggcttgtagtgtagcttttctctagctgacgcatccaggcaagggtgggcgtgatggagcagggcgggccctgcgacggcctctgtcgctttcggattcacctaggcacgagaggggactgccagttgcccgctgggaacgggggtgaaacctgaggtgtggtgtgcttggctagagggggttatgcgaagggtcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagactcaccgtgattagactcaccttagtttagtctaatgaaattggatggtataggtggatgattgggcctgttgcaacgtggtgtaacgttggatagtggacgattaatactgcttaattattacaactgttttcgcattcaattcctgtttataaatgccagtatttatgcaaatgaacctgtttagctatcccttgttgaatccctgcatcatacccccattccggtatgacttgctgagtacagtgggtagtactcagccttgctctatttcccccccccccaatcccagagctcgagtatgtgtccgatggcgggttctccgaggagtaggcttcgtccgtgccgtcgagaatgcctgtggagtggtgttcccgctgcagttcaagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacaccttgctagagtcgctcttagatggataaatgggcaagacaggtataggcatgaatacacatgcctaccctcttgcatggagcgctagataattggacttagtagcatagggtatggtatcaagattcaacaagtcatgtcacgtgcacatgcacataattagtgaagcccattagcatagaaggccaagataaaactaacagttagtgggatttggattgcaagtgtactatagtgatactatatgttcacgagagtcctgtttggtccatgttaatcagtctagtgcgtggcttgcaggaaagtacgaaaggagtgacaagttttccagtggcgcgtgtctgagacagtgcttattatcgaaaaaaaagaacaagcctggacttagtgcatcatcaattaaggctgagttctttccccagttttcccaactcatcttccttgtttttcatccgcatacttttcaaattgctaaacggtacttttttaaaaaagtttctatacgaaaattgcttaaaaaatcatattgattcatttttgaagaaaataattagctaatacttaattaatcatatgctaatgggtcgttccgttttctgtgcgcaggagatgggtttccaacccaaatcaaccaacacagcctaaatatgagcaataggatataactaggatgtttgttggatgtacaatgacattaagtaaacactagtacagacccctctattggcaccggttggaaaccgaccatagatgttggttttatagtcggaaccaatttaacggcaccacaccaatacccaagggcaaaggtgacggttcacgacacttatagagattatagtggccagttcttgcctaacaaccagaacctatagttttcaatgaaacaaaaaaaaaaaagacagccggtggaggtagacatacacggagcaccagcgctcgcggccggcggcaaaagtgtcgagcgatggaggctgttgcacaatcacgaaaacacctgacaaccacccgagatcccatccaataacatcatccccatatatatatataaaacacgatcttgaaacacacaaaaacacatggcatgaaggcgcagacaaggccagtgatgatggggccggtgccgcggctcctccggcgctagtacccccttcggaccagcggcttggtggcagcggggtcacctccaccaaccaccgctgccggaagggaagaaggaaaagggaagaacaggaaagggagagggaggcagcaagggagtagggaagggagaggggaggcggcaagagaaggggagggagaggggaggggtgccgaacgaaaagggaaggggaggatgcgcagcgagggagtggggaaggagcgcgaagaggggagagaaggttggggagaaacaagagaagggggagaggggatcgactgggtgtggctctgtgtagtggataaggacatgcatagtggtatggataagcacgttggctagctctggctcggctcgtatgggtacccattttttaaccggtatttataatatgttataggtaccggttcttttaaaaaataacacctataatattggtgcatgtttttgctccggaagcggcacctattgttgcctaaaagtgctggttctatattttcctgtgtgaaaaggactataggtgccagttttaaattaactaacaccaatgaacctatacctatgaggtgttttgtaatagtgaaaagaggctaattaagttataactcttattttaagagctaaaaggtgaaatttataagaacaaaataaaaggatactaaaataattttgattgtgggaaacaatgtaactagattataaatatgtgaaacaaaattataccaaatcatggagtaaaacatatctccatcaaaaattagttcaaccaataaacggtatgcaaataaattaatttaaaacggtgatataaaagctaaatttttgtatgaacatgactttgacttattatcatattaacggtgaatatatattgggttttaagatggatatcaaagtggcgcaaagcatgactatatggctagtatacagagtgagcgaaaagagggtcagacttatttctgagtatttaactatcctggtcattttggccattttactttcattaaacatttttcgtatctgcctcatgcctcttaattttttaataaaaaatagaagaaaaaaaagaaacttttcaaccgaaacacgcatagatactgtgtgggatcacaaagaatgaaaaccgcttgcagataaagctgcacaaaaccggagggagggctgatctacgcacgcattcgcgtgtttctactgttgcgaacattctcagccacgccgataattggctgtgcgacgctgacggcgttctattttaacatttactagggcagttgaccagttaatccggggaaaaaactcctgcatacatgcgcgtaaatagttggacgatccaaaagaacttttgcacgcatgttggagattagtttgaggactttgtaattaattgggtttcgcgtgattactgttaactttgctatattaaatattaagaaatacattctattatactgaaaaaattcaatggaaaaaccttcttatcaacaccttctagtatttgaattttctaatagttgacatcaaaactttgtactttgataaaatttatattcataaactttctagataaaatattttcattcataaactttatacataaaagaaaacatatctgttgaaaaactttatacgtaaataaaaaaaattagattcagaaattttctacgtagataaaacattttcatttatatactttataaataaaagaaaaaatctattgatgaactttatacctaaataaaaaaattacattcataaactttatacataaataaaaaaaatcatatttatcagttctgacatattcgctggatcggaagttagcgaacgttcgctaactaccagtttggcaaaaggagagagaacagatccaccaagcatatactgtacaatcttgaaagtgatatcactgtgtggtgtgtactggtccatcgtccacatgtagacagcgtgcaactcgagtcttgaatatcgccaaattaacctgcgcttgtgttgatggaggccatgtcgtccacacgaccaaactctccaccgatttcattgtagcctccacatatatagcagtactccgctgcgaatagtgggggagcttttcgcagacttctttcaaaaaaagatattcttttacagaagcttctgggtcaacgcagactggccacagcacagcctatatgagctggaatcttcctgccagttcgtctgagaattacacgcgcacatacagaacaacgcggccaagattacatggaaaaaggttgcacatagggccggtttagttgtcaaaataaattttgcctttacatgtcacattgaatatacgaacacatatttaaaatattaaacgttatttaataacaaaataaattacagattctactagaaaattacgagacaaatttattaagcctaattaatctatcattagcaaatatttactgtagcaccacattatcaaatcatggcgcaattagacttaaaaaattcgtctcgcaatttacacgcaaactgtgtaattggtttttatttttgtctatatttaatactccatgtatgtgtaaatattcgatgtgatggacgaaaattttttgttttgaaaactaaacagtccaatagtacaagctttgctcattagctgtgactacccatgcacaagcttagtaatccctctgtcccacaattactcaaaccctatatttccaaggtggatttaaagagagatatgaatgatcaagatatctctaattaattgtgaagttatatcgatgaataggtaggtaaagggtatgaaagaaataaaatttttagatttgcaaactaatggtaggtaaaagagtaaaagttgatttattttgattttaaattttagaagctgatttattttgggacggagtgagtatatagcatataggaccaccgaaccgcgagacaggcacgtcacgtctccatcgatcgatcgcgcgtcggcgatttgatttagctgcgccttttacatggaaaaggttgcgcatagtgcaagcttagcaatagagatcataacagtgtggctcctgatttagctgcgccttttatatgttctccgtctcgcgcgggcgcatatcgttttcctttgctcgatcggcaacacagtacagcggtgcattattctagctgtttcccccttcctcctgttcggaatgcagctagcagtttggtgcttcacatgctagtatctttgattcctttcgcgtggtcgcgcgtagacataatcattcttaattgatctgatgtacttctctataattttgattaaatttaaagaagcttaatctagaaaaaatcaaagcgcattataatttgaaagggatggatggagtagaatgttaaagtagttttgttccaccaccgttataatatctttatttgttataaccaaattaatagaaaaatattcagtcacaactatgaaatggacctagagacatattgatcgagatggatgaaattgcaagataagagtttttcaggctcaataataatgcaatgtttctttactatatgcatataatctatgcaaaggtcagatgcttaataaaaataatattttctacaaaataaaaataatccaaaagtatttttctgtgacaattaattctataggtcagataatgccacattaaattgtaggactaaaactcttaaatctataataaccagagcagggtgaatagttgcagaaacacctaaatctacatttttcataactaatatttttagaaatttccttgggaagcatatgtaaacgtaagtttagaaatattacttttatatattcataaacaaactgattcatatttaaaattagtgatttgtaatctgcatgcatggaaattaataaatatgtacaaataccattaattttttctactctaaggtcatcttgatataagaaactaattcaactactacaagtccaaaaagtaaataacattccgttcattcagttttcttgacttagtaataattgtgaaggggttgttttttgtaatactccatcaaaatttttcttttaaattttttttttggaatttcaagaaaatgtttaaattcattcaatatctcgtcaaataaaaattttattgagtttttttaaatttggaaatattccattctgttggtccgcaaaaatacctttttttcgcaatttgggaagaaaagtttcgaaatttgcaaatctgttaaaatttagattaatatcattcaatttttcatgttcaattttttgaaattcataaattttccaaaatattttttatttttgaattttgggacaaaaatttactcaaatggagcatgcatgcaacttgtcgtaggggtaaaaacgtcatttgtaaaaattttagatgccaaattgaaatagaaatgttaaattaaattaataatggtcatattgcgttctagcaaattactatatactacaatagaatatgcggcatcagtgtccgtgcgtagtggtgtttggaaaaaactacagcgatttaatttgtttcacacaagctcgtatacatatcgccgtccaggattggcagtatatatgtgaacacgtatcccaagagataaagagaggcggaggtatacgtacgcgccaagccaaataaaatcccgtcaagtcccactccatatacgctcggtcgtttggacgtcgaactatcatatatctccatcgcttttgctattgccagttgacatgccgtcttctccgaacacaccaaacagtcaaacaccgcatacacacgcaagacaacaacatacgttaacgttgtgcctccaatctcccaatcgatcgatcatacattcatactccctatctagctagctagcctagttagctacgtgtgtaccggggagattaatggggatgcatgtaacactcaagaagcaaattagctagggaagatgtgtatctcaaagagtaatagagtggtattatttgcagcacataggctactcgaagctctcagcaattcttagtttcataactactctatatggctgtgttcggcagcctatgttaggaacacattttctgcacacgaaaaacggagtggtccattagcgtgcacgtaattaattaagtattagctattttttttaaaaaaatagatcaatatgattttttaagcagctttcgtataggaactttttttaaaaaaaaacgcaccgtctttagcactgtgaaaagtctgcgagcaaaatacgtgggaggtgagttgggaaaattggaggaaagaacacagcttgtatatgtagttctctgcacgtgtttgtgtctattttacgaaatatcctatagatgcaagtcttcacatgttacatacacataacatgtacattaattaactaacaaatattcacaaaattctaaaaaatatgtatgtatactttcaataaaagaatttgtaatagtattatatccacatatgaaattccatcttcaaattcatcatacatggaaaaaaagacaacattttgacaaatttatagtcttaaaactatcagaattttttttgttgttacagccaaaatataatgaattaatttgtggttagatttatacataggtgtaatactatccatagtatatgcatatatttttttttataattttagataatatttattagttggtatgcacggagtgtgctgtgcacaggatatgttcccaccttactataacaatttacatctgacatagctccatacatattatagtatggtaatttttttggccttttcagtacgatgagtgtagctcaactgattatgttccttgtgatggaacctacccacccaaattcaagttccagacttgatatagatgagtttaagtcctatacttgacacgactgctcgcatctatggctaattagctttttaaggataggcaacttaccatcggtgattttatttgggtgctcgcatttacggctaattaggttttcagtgatagatgacttacccgtgggttcaagttttagacttagacacatgtgtttgtatgtatggctaattatattttcaatgatagacgacttacccattaattgatagtgaggccctattgatgacttcgtcgattttaaaatatgcgacatgatgactttatcaattttaagatataccggttcagtctttagatatgtttataaaaatatccgcgtatttataagcccttggatttgtagtatgttttaaaaaagaaatattttatcaccaacatataggaactggataaatctacgtgcatggtgcatctatgattggtgtagagaggaagactcgtttagcagtgtttgcagtttgcataatgtatagtaaatactcggtgcatatatatgcacgcacacgttttgatagctagtatcttgtagtttagcttctaggaaaaatatcaatatttatgggtggacgactgaaaaatgcttgagttgttctcgctatggtataaagtctgcaggtagcgcgcgtcgtctccagtccagtgaagaaagctcacgcacgcaacacgcacgcacccctagctcatgtgcaagacgagccggcgagctgtatacgtagcagctggactctggagaagcatcagctaagctgtacgtactactgtagttcgatcgatggatgctggtaataacgcaatcgctgcggcgtccttcgccatcgtcgtccttgtcgccgccgccgcctcgtctttagcggcggcggtgccggcggtgtacgtgctcggcgactcgctggcggacgtggggaacaacaaccacctgctgacgctgctcaaggcggacttcccgcacaacgggatcgactacccgggggggaaggccaccggccgcttcagcaacggcaagaacttccccgatttcctcggtgcgttatcgtcgcaagccccccacccctttcttttatctcaatatacctatactttccctctcccccttcctctcctcttccctatcacccaacttccattttcctcattctttccctcctctctccccccttctctcactccactatcaaattctttctcccttcccttcactccttcccgtactcccaccatcctttaaacctacttcttcatctctcgcttatccatcactaagcttttgtgcggtgatacgtgcgcacagcgtgtttatacaatcgacataatctatactatgattcctctctcccctctacgccgcgtgtattcgcttccgcctctagcctcccgtgctccgaataccgatcccgccccttcatcctgcatccgacagcttcatctttcttctacgtgtctctctccgtcctttgcttccgactcgcgcg

SEQ ID NO: 21715 - DNA, 16600 bp, Oryza sativa
  unsure (1)..(16600): unsure at all n locations
ccacccacaaatcaaaaataatttcccccttaaaatttatnnaannnannccannnnnttnntnnnnnnnttnnnnnnnnnnnnnnnnncccccccccccccccccccccgcgttttctgaatgaatgatagtacaatcctgcaatctgcatgccttcctcatgcgtcacgcgtgcgtgcatccagcctcatggctcatgcatgcatgcaaattcatggcttaattaccattatattgtgcattattgcatttcactggtgaccgatctcattcttctacgcatagtacttagctagtaactattacattcgtccacacaaagtataaggagttcgagatgagttccacacatgcattaaaaattgatggaattaaatgtgataagttgtgtgattggttaagaagaggtgggtagctagggattctagatggtaaaatgttatgattggttgagaatataataattattttagtttgagaagttattatattttatactaacaaattttgaagagttattgtgttcactaccgagctcctaagtcgaagtccataacacaaaagaattgttgcgctagcctaacgcccacgaagtttcagattagtaccaaattaaacaggacaaaagtgtttcttgtattaataataaatatgcttgaaatctaaaaaaatgatttcttataatagtaatcaaccaaattgaatcatattagagacaacgagagcgatagcgcggcgtgacccagacggcgagacgtcgagctgaccgttgcaccagccgcgcacacacaacgaccgattgccctgctgtgacggcctgccgtctcgccctaacaaacacgccgcgccggtctcgcgtagtcacgttgcatttggtcgaatcttctttcacgcctagcttgacttgttttcttgatttttcctgttttgctactcatccgatatactacctccgttttattaaagtacgacgccgttgacttttatcaacgtttgatcattcttttatttaaaacttttatgcaaacataaccaatatttaattcatgcttaaaaacatttgatgatatattaaatcataataaaataaataataattacatattttttaacaagatgaatggtccaacgtatcttactaagtatacattagtaagtatatattatgtgttgactttttattagagaagttaatagcagtgccacatatttaaaaagaaaacacactatatgaccaaccgttcagcagtgcaggctgaccttaattgattaagtttgctgattctactttctccgacacaaatttattcaggtaaccagttagaaatagctatatttttagacggaaggggcaggtagaaatacgtttctataatatctgttagtggcgtaatttgaattttgtatgttaacaattaacagcaccaggtgtgctaccgttgacgtcgtaccaacggtatatagtcaaccttttatcataggctagctgaacacgtactattggcatacgtacttaacaggacgtgcttaaaataaaggcaacaagactactgctactaattaagtcagcatgttgtctaggcaaattcaaccaagaaggtaacgcatagattttaccagttggctctagttggttcggcactaaatatcttctacagagttttattttttctgaaataaaatatcttccatgaactgtcatggtgtgacatgctacttgtattgacataaataaaaatatattttttccatgcactccttttgtttcttattataatcattttgactattttcttagtcaaaattctttatatttgattaaattagttttattaaatttaacatagaatatattttgatacaaagtttatttttattaaaaatattactatatttttctataaatttatctataaatttagtcactaagaaaaaaaattaaacgacttatatcttctattatatactaaaagtccattaaactttctacaaacgctctcaagctgccatgtggcactcctacaaacactcctagatcgctacatggcacagtctaatctcaccgtcgattttcatttaaattggtggacccattattttataccgttagattagatctatacatgccgtcgattttcagttaatatattatatccatatatatatatatataatacctttctctgtactgtttgtcggaggaatagaacgtatgtacgtacataccacaaccaaaataaagcatacatgcttagtacgactatcaaaaaagcaaatatcactctacaatataaagatatattggcccacaaatatatacatgcaattgaatgattttcgatccattattttatccatatatattatcgatttataaattattggacctgttattttttactattaaatatgtaatacctttctcatgtgcataatgtttgccggaagaaaaaaatatatgcacgtacttaccataagccaaaataaaatataaatacttagtaccatcaaaaaaaaccacggtctttaaaatagaactatcaacgatataaagatgaaatatattacttcacaaatatatagatgcaatgttaaactagatctataatataaatatcaaatcaaccatctttaaatgttcatcttttcaaattatttttaaattatatatccaatttgtgatctacaaaacagtactaagtcttcatgtggcgttcctacaaatacttctagaccgccatgtagtactgtataatctcatagtcgattttcatttaaattagcggacccgttattttagactattagattagatgtatatatatactaaccgtgaaaaaaacataagtacatatacaaacgtacgttagattgaaaaagaaataaagcttcggtactactattcgcagcaagaaaaactattatatactaaacgttcattaaactttctattaatattcctaagtcgccatatgacgctgctataagtgctcctaggccatcacatggtactgtataatctcaccatcgattttcatttaaattggtggacccgttatttaccctctaacgtggcatacaaatggccgagttgagtgggcccagtgtgtcataggactctatgaaagggttatagtaaattagacattaaaattgtgcttcgggctgatcttgaggggacacaactacccaattttcaaggtaatagagaaagaaagtctctacggctatgaccggcttcacccgttagtgatatttttagaatatttatatgtggatttggaaataagtgagacataaacacttagctaagtagtgtattaataatatattaggcttattttattatgcgcaatttcatgtattggtagttagcgagcttttaaaatagtgataatgagttgttacgataataggaaaatttatatgtaatcgggacaaagtgtttttaattctgggagacattcttataatttaactatattgaagtctacgatctatctcacgacgtagaaatggtgagatatgacttcttttagcactatttcataaaacaataaataaaaagcccgcgcaccgtgcgggcttccttcctagttataaaataaagggagtaattttattttcttttctaaattcgttgagaaccaatgacaaaatgttgattgatgcacgttggctacttgttgatgattccatacagcttgtaatcaatttctgtacgtgttcatccgacgttgcttgtacgctcaagatatgtttatttccttggttgttatacctataaaaatatatagacacatataaattttaaggttcacgcaatagttggatgtacactataatgaactatagtttgtagtttctccatatattcgtgtgcacttagatttcaacctactaggtgaagccacaccatagtattgccttctctattttgttaattttggtttttggtagctataaatttaggtggagacaaattatattttttaaagataactggagacatattacctaatgaatgataggtcaagcacatcatatgagatatcagatatctagccaaagggtttttccgatatgtccttttcagcctggccataactttttcccccaagaaagtgaaatggaaattgtccgttggcgaagccaatcaattgagaacaaatttggtgtcattctctacttcactttcgtgggtcagattaccatacgtgtacgtccttaattattctacatttgaggatcggatttaggcgatttacctatttgatgttgacaagctggttattattgttctaaaaaatgttgtggttaattaatttggaattttattttatcattctttagtttggctacaacactgttttctttaatttatctcttgcaagcttgctggattgaccttctatgtataggttatgtgccatatggtggagctccaataggctagaggcataagtttctcatgaattagtccataaaagatatgtaagtttcgattttggaaggggacctctacattattgacgagaaaaaaaagaagggtgtgagaggacaactagcaaacagcttttttaaaaaagtcagaaaaacaagaaatatatatatgtgcattagcaattacaattttcaacttgtacatacgtacgttctacacagcttagcccttacatactaaccaccagggttcaaatttttattttggctattttctatcaggtactgaaataatttgaattttaataaaatttggtcacatttaaacaaaatttgccaaattcacaaaaaatggaaaaaagggtggaatagttttggttttgggggggggggggggggaggggggcgatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagctgagaaccttgggttggcgacatctccaccgtacctcgccatatcgtcaagcagcagtgctaactacgtgaatggcgtcaactttgcttcaggtggcgccggagttttcaactctacaaacaaggtagttctaattagtttcaactcgtacacgtaattgcaataacaaacttttctcatagattaccaggacgtaggattatatgtatgcatgttagtcgtcaacgcactatatataaagttcattttttttaaaaaaataatacaaatggtttacatatttctgtcgacagtgatatagtcaatttgttttcaacttgttttagagttgaaaattggttttaattacttgtgttaaacattaatgcaggatcagtgcatcagcttcgacaagcagatcgagtactactccaaggtgcaggcgtcgctggtgcagagcctcggcgaggcccaggcggcgagccacctggcgaaatccctcttcgccatcaccatcggcagcaacgacatcatcggctacgtcaggtccagcgccgccgccaaggccaccaaccctatggagcagttcgtcgacgccctcatccagtcgctcaccggccagctacaggtgaggatcgaggtcaccgatcgacagataattaaatcgatcatcaaatgatcaatttcatggtgttacgttctaatggtgttcgatcgattgtgttcagaggctgtacgacctcggggcgcgcagggtgctgttcctggggacggggccggtgggctgctgcccgtcgctgcgggagctgagcgccgacaggggctgcagcggcgaggccaacgacgcgtcggcgcggtacaacgcggcggcggcgtcgctgctgcgcgggatggccgagcggcgcgcgggcctccgctacgcggtgttcgactccagcgcggcgctgctccggtacatcgagcggccggcggcgtacgggttcgcggaggcgcgggcggcgtgctgcggcctcggggacatgaacgccaagatcggctgcaccccggtcagcttctactgcgccaaccggacgggctacgtgttctgggacttctaccacccgaccgaggccaccgcgcggatgctcaccgccgtcgcgttcgacggctcgccgccgctcgtcttccccgtgaacattaggcagctcgctgctatgtaggcttcatctcatcttcacggtgtactgatcgatcgagctgcttgtgagattccacttttttcaagcttcaagtacagccatagaaatatactactatataccatgtaaagtatactagtgtatttacttacgattggtacatatagcggtagaatcatataatatagcaaattcataataagtgattgttgaagttcatcagaaattcacctggaattggggtcggaatcataacaagtgattattgaagattgtcagacagctatagtacttaccaagacgagaagatttgtggtgcagcaatttttctttcagggatactagcgctcaaaacgtggcaggaaaaattcactttagattccgcatagagtaaattgcactagcggtacttaaacttgtaacgatgtttcacttaggtccacgaacttgcaaagcgcacatcgagatccctaaatttgatttattgtatcatcccggtccaaagccgcgtttgaccgtggtcttgcctacttggcacgccacgtagacgatgacatggcacaaattttaattttcctttttttctccccatcttttctctccttcctcacctcgtatggtcggaggggacgcggggcaggagcggcgcgggcgtgctcgggcgccggccgacgggaggagaggagcggcgcgcgtgcgcggccagcggccggcgagaaaggagcggcgcgcgggtgtcggctggcgggaggagagaagccgctgcagcggggcggcagggcgagctcgtgctcaacggtgtaagctcgacggcgacaacggccatgtgagggctactgccggagtggtggggcgaagaggccgaggcgcgcacggggggtggtgtcgccagccgctcccgggggaggggtcgccgaccgcggccgcgcgtgcggggggaggcgtcggcgggcccgagctcgacgacggcagcggggcggtggggcgagctcgagctgggcaacgcgagctcgacggcgacaatggccatgtgggggccaccgccggagtggtgggacgaagaggagggcggcacgtcattcatgcggaagcggctgaggtgcgcgaggggggaggtgtcgccggggcagccaaagcctcgttgacgggagggagggaggacgacggtgattgggggaggacacgccgcgcggcgcctcccagccgcgtgtcccttcctcctttcctcccctcggcgtcgcctcctagctgcgcgtggccaagccactgcgccgcaccacctttctcctgagctgtgccgcctccctcccgtgcgcgcgcccggccgtgctgccgcgctcagccaccgccccgctgcctcatgccacgcccgccctgggcagactnctcttccacaccgagctcccctcccttattccaccgctgtccctctcccggcgctgtgccaagctgcgccgcgccgacacgccgctgttgnctcagacgcgtcgtcgcgtgccggctgtctcgtacgcgacagcccgcgccgacgccgctgtcccgagctcccccgtgccggcctctccctttcatcgtcgncgccngttttcgctcgagccagacgacgccgccgccgagttttcctctcctcttgatagccgacaggtcctgtcttctgcaccgccgacaggtcgccgaccccggccacaacctactcgcaccggtcgtcaaccgcctctccccgcctctctcctgcgccgccgccaggtcgccgaccccggccacggcctcctcgcaccggactcgctggctccctctctccctttgcctgccacagatgcatctagaggtggaggaaggagagaaaaaaaaggaaaattaaaatttgtgccatgtcatcgttcatgtggcgtgccacgtaggcaagaccacggtcaaacgcggctttagaccgggatgatacaataaactaagtttagggatttcgatatgcgctttgcaagttcgttgacctaagtgaaacctcgttacaagtttaaggaccgctagtgcaatttactcttccgcatataacggttgagtttggatagtgcccctcatcttctaaaaccactttaaatatatagtcccgccatatgcacactatatttcttctctatggattacatgtacgttgacccacttttttttgttgttgttgttttatcgtataagtttcacatagacgccacattagataaagaacaaatcaatatggcacgttgaaaccgtcttcgttgggactacatttcctctgttcggtaaagataaggattgcgttagtacattgtttcgcggttgagagactcgatcgaaactcaaccttagatgagagaccggcagtgaactttttccaaacgtggttcgtggcccatcaaaattccaggattccagcttatgttgggccttccagatctgcgtcgttgggccatatgggccagcgtgcttgttcgtccaagcacaccgccccacggcccaccgtccgattcacacgtctagtagttccccaggccaagctaccggtgctgccggcggcggcggcggcggcgggcgccggaagcacgaacggcgaacggctaaggcacctgcctctcgggactcggggaccagcggcagaatcttctccgggcggcccttttctcttgccccagtggcctctgctgcaaactccgcacaaatgccgcgccccgctgagcctcccagttctcgccgccggcgatatgtgtaggtaaaattatttagaatgagttaattttttttggttatgcgcaaatccacaattaatctacatttgagctaactagttgctccatagtttctttgctgagctggagattggatgcagtattgttgccattcagatctcttggtcgagtttgaacctagaactgggcctataaggctataatttgttactgcagctattatacttctatacgttatatgcatttcaggtttgtgactagcctgattcaatccaaagccttgactttaactatctttttttttaaagaatacgtagaaggtttgcatgccatttcttatagcgataagagaaaaggaaccaggctgctatgagtgtccaaatagtaccaattacaccactcaggaaccactacacataatgcagctgttttctccgcaaaaggtaaataatagttggttgtttaattcacacaatcacaccacatgacccatgagagacggtaaaatatatatgtagctaatatggtatgagctcctcacctgtaaagcatgacgttgattaggtgattattacttataggttgcagtgttctttctaatttttataccaaattaagctatctattcatcctcttcgctactgtcatcactgccgtactgaatttcctcatcttctgactgctcatggtcttgctcatcgttgtcctctccattgtcatcttcgtacaaaagcccaaactcctctctgtgctcgtcctcacttgcatcattcaattcattcagagcttgttgctcttcataccaagcatctttagactcatgtaactgagagaagggacattaattattataaataaaaaattcagaaaaaggaactaagaaaataaacagtggtcctagtactgcaaatgcactaataaaacttaaagcataaagtatttgtacgtagatggtgatagagatctatacctggcattgctggtgcgaaatttggacttccaaccagtctgctagcaatgggcactttgtgatggtaagtcgctgaagctgtgttgacagtggtttatcagatggtagctgcagataaggacatctatgtatcttcaaaaatttgagtgacccaaggctgctaagacccattatagagtgaagacgtgggcaaacactgataaccaagacttcgagcaatgggtgattctgattgtcaagtaaaaggtgctcgatgctccgtgacagtaacactttcagtgatctgagatgcggaaagtgcaaatcattcagaatttgttcatttatcttgctcttcaagaccaaagtagtgaggtttggaatagctggtagactagcaagtttgctgcaatccttgataactaactttgtgagggaggaagatagctcctgtgggaggtacctcaactcgtggctatccttgatttttagcaggcggagtgaaggaaagtcatcctgaccaacttgagaccactcaacccatttcaacatttcttgaaactccagctcctcaacagctgggaatgcctttgtggtgatgtttccacggaactcctgtcgcacatgctccacatctgtcatgcactccatagagagtatgcggaggcgtggcaattccccaagtggaggaaggaacttgcagctttgctgacataggattatctttgccaagtgcatgaaggtagaagccccaaaccagctaggatatttgtatccactataattgactacctccaattcttcgatgttcttgtgcggccgtaggctctcaaagatctcttcctcatgctctgggtctggggtagccacatcattttggctgctaggatgactgcagttgttggggcaaacaccatcagaccagtctaatctcaggatttgcaattggttcttactgactaaattagctgtctgagcatcatcaacatttataaccctccgtagtcctgtaatacataactctccatgtatgttcaccagatggtgtagctcggcaacattggaatgccaacctccgcttccaatgctaaaccttggcaatgtctgtagcctttttagcccacctatcccacatggcatgcaaagtggggaccaaagatccaaattgagatggcggaggttgaccagtttttttatgccttgtgggagctctctaaggctgtccgttcttgcatccaagaccctcagattgtagaggtcactaattgattctgggatagtggtaattcgtgtttggaaaaagctaagatatctgagtagtttcaattctcctattgaatcaggtacttgtgcaagtgcagtatgactgaaatccaatgcacgaagttgtttaagattttgccatgtttcggtaggaattttaacattgatgctactagaaaacaacttactggaacatcttcgattatcttgtgcattgacaaccttaaggattcttatacctccaggtatcgtcacagaatttagtgctacatctgtatgatcagaagaactgacaaccaatgacaagtagcggaagtttccaatggtttcatgcaaatattgagtatttattctcaagaaatctcctccagaaacaaaatgtaccagatcatggataagatcatgtgtgacaaagcattccagtttttcatcagattctgctcgttgaatcattgccctctgaattaaatcatcgaagtacatcctgccaatgttttcatggcgcccagtacaatattgcttgaggagtcccaaacacatccagagatttatcatgtcttctttccagaaatagtaccccttagggagcagtgaaaggaaaacaaagcagcgcttcaattgtactggcattcgatcatagctgagttttagtgctggcagcactcgatcctcttccgcaggtaagccccattgatcactctctgagacatctttccatgtctcttcatttgtctcaccgcgaagagaggatcctattgccttaattgccaatggtaggcctccacattttcccacaattttcctaccaaatccttcgaactgttgatccatatgttgatctataaatccaaaggccatctgcttgaacaactgccatgattcttcagaagttaggaagctaagatcataagaaggcattgttcctatcatttttgaaatagtttcatcgcgtgttgttaataagatcattcccaactgagcacccaccaacagggaaagcaaagcatcccagatttccttctgcacattccacacattgtcaagaactagaaagaacttcatgtcttgtacttgcgccgttatcatattttggagattacccatatcttctatatcacatggattcctagtgaacgacatgataatttttcttgcaattgccttaacatcaaaatgaccctcagaaacatccacccagccctttagttgaaagtacctgctgactctttcatcattgtacaccatttgagcaagagttgtcttacccaaaccccccatgccaacaatagaaacaacagacatatttgcttgagcagcttcatcggaaattaatatttcgatgatgttttccttgtcttcttctctaccaactatgtcaaaatcacctacatgcggggttgtagatatcttgatgtcataggcctcctctcttattggtgcgtcactctcattgagttggagatcatcccatgcctttgtgatctcattgaatttttctaaaattttcctcacccttgctgccaaatcatctggaacaggaactttgataggggatggttcaggttcctgtacatgcactaatattattataatccaaaggcatgtagtatactgtgtactaacaagagttaaataaaacacacatatgtacatgctcctttatggacccctttttgctcctctactatcccaatacttttatatggctatgtcaatggttgcttatgcatgatatgcagattgctcatgtattattgagagaaacaaattgcttgggagcttatctttttatacaagaaactttgagaggaggcctctgcaatttggaagctttatttcatcaaagaagaaacacagactattttttctgataaaccaaatgtagcattggttatagctaggataaggggataatattaccttcttgtcacctttgcgcttgcgcttgcgacttctgctgctctgcctttgattgctttggtcctccatcctccgtcgaagcaactcatacctgtattcatcgacagcatcctgggcatcatatgcaagctgctgcagctcccacaggcgaagtctctcggcttcatctcttatattgtgttcatccatcgcatcgagggtccgctgaatccttgccatcgtcctctgcagatctcttagatctctgaacgaagcactttgctcgtcagatgatgatgaaacgatttgaggagaaaccaaggaagaaagcttgtttgttgtccactttatgattccagatgctagtagtccagccatctcttctcaactgctctttctgatccaaagacagagttagaccaagctgagagatgaatcagattaacaaggcaagaggaacatatagaagttcagggtgttgaccttgtggacaagtgcaatgcaatttttaatgcacaagctgtggtttccaacctccttacaacaagaggcatatattggttttcaaccaattcctgttattatgtttccaacctccttacaacaagaggcatatattggttttcaaccaattcctgttattatagtgtcaaaactgcataactgcgcacacagtaccactagctgaaatgcattatctgctctttttttttttgcggggaaatgcattgtctgcgtggacacatcatttcagaatatcaatgtaatgctcagaactattcttgtatggtgacatgcattttctgtgtccctaatctagtctgtaaagggccactatagaaccattttctgtggttcatatgctctgtagaaccatgaattgctttatattgccaagccctgttgagaacagcatagttcaatctatagaatcacttaattagaacaccgcgcaaggaatcttatagttaaaccagaaaaaaaaatctctagtccaattgtagtttgttttataaagagaaattgttgtcccttcatctacctggtatatactccaaaactattttcgctgtaagtgttcagttttgcaaacgtacactagcagctgcacattttgctaaatatgagggcaggtctatcctacttttctccttccctgttactagtttaaaaataaaatttagatatgtggcatttcatgttaaacattgcttccaactcgtacaattttgcacaggagaaaaaccaatgaactgatagtaaccgaagaggcaaaatttagggaaacagcattcctctaacaaggtgagcataaaacatcaaaaccagtttcagattttgttccttctatcaaggatacgagactgttacagtgtgttcgcatggtcggactggaccacgtgcccatggacatagataggatcaaagtatacttatgcaaaaaaataatagagtaataataagtatctttagttaactcttatgatttttttttctttcactgatcaggaggactatcttccatagggcagaccgccacttcagccacacattatcccaaaaacaaatttatgtatagacaaggacaaacttctttgacatcacaacatcagaaagcggcaataaatatgcaaggctataaaaatgtttgacgttgagctaacaaacatatcaaattttacaaaattataatggcatggttctaatttttccctatttattttctaagtagcatttggttcaatcaagctaaccaggatataaaaatcaattcagatccctaagaattgcctcccaacttcaactgcggttacacgagtagttcttgttttaatcataccctaatccccagcatcttactccagacaatagcaatttgcaaccacatatggacaagtttgtacacaaacattgagtgcgtgcaaatgatgcaacatttaataaaactatcaaaatacccatgttttgtctaggtgtcagtgctttttttgaactatttcgtcccggtgaaaaacatcacacccgcatgacccgatatcgacactaaatgaaaaaagctcacccaacgagtcaccgagagattttttttgaaacaaacgctctcaatccattccaatatgtccaagtctcatgttacggtgctttttgaactaattcgtttcggtgaaaaacattgtacccactgttgatgtgaaaatacggcagcctgggagatctgcttaactctagtgtaggtccaaggctagcctcaagtgtctcaagggcgtgccaactgatttgatcctgcaatcagcaataaagaataaaagcagaatcaattgactgatagccaattggccgataggctaatagcgtattgttgatggtctcagcattgtcgtggcgtggtagctcctggaaccttcgcatgatcatgttcacgcggggtgtggtgctggcgtggcatgtaccatcgtccactcccatgtaagggtagaaggttgacaacgccagaccatttttcatgacgtactggaaagcgttcaaggcgaggccccctgcgcagcctttgctccttggatggcaatccacgagctcctgctctgacaggagcaccgggttgtcgtagtttgcccctgcatgcgatgacgcggtggctctccagcgcgcccgtcatggcgaacgcccagcaagagccgtagcacccccatgaacatgactggaccaaggcacggctggccttcgcaggtcttgttgcgccaattgatggagacagggagcggtagggtcccgttgccatcgtgccttttcacgggccaaaacgcgaggttgctctgcttcgtcatcatgtgacacatgtcgcgactgagtgcttcgtcggtggcttcggcgaagatgttgagacctggagcttggcttgcaactcaaagaagagaggcaacgcggtgcatcatctcgttgaatgctactaacggcggagcttctcgacgatcttgcgtgctacattgtggccaagtgatagggcggccggactgtgttgcttgcctcctttcatagaaggtgcagagagcgagcgagccaggtaggcaagtagccaaccagcagtgctgtcgaaacatgaattcggcaataataaaacggggtagcgcacgagacctaaaagtggatggatgcggagacaaggatttagacaggttcaggccctctcaatgagaggtaataccctactcctctttgtggatttgaatccgccgagtgtagtatagatctgacgatctaattgtctcataccccctagaaggcctcctgcccaccttatataggatggggggtaggattacaagatagaaaccttatccaatacggtatcggtttcctaaatctactttacaatcttatcaaaccaggactttaggccgttccgtaatatacaagaaaacgtaatacccaagtcatgatctgttacagatttcatatatataagttatcccttataactagttggataaccatgccgtgtgggtatggggtacccataatctncacagtagcccctgagaccttcacagtcgaaaagataatctctcttcgactagattactncaaagccgag

SEQ ID NO: 21716 - DNA, 10333 bp, Oryza sativa
  unsure (1)..(10333): unsure at all n locations
ccgcgattagacgcctgatacttccgcgtnnnnnnnnnnnnnnnnnnnnnnnnnnnnnnnnnnnnnnnnnnnnnnnnnnnnnatataagttatcccttataactagttggataaccatgccgtgtgggtatggggtacccataatctccacagtagcccctgagaccttcacagtcgaaaagataatcttctctcgaactagattactccaaagccgagtgcttcaatcatcttcgccatgacctccgagtacttttactaaatcagaagactgtggatggctgaaaaataaagtcaggtgcatcgactagatgcacctaattggtttagcccccgatcatgtggttaattgaacaaaccaagcatatagtcaaggaataaataatccaaccaaccaagtggttttgataattgtagtcaaccaagtgacttaatattaatatatagcaacatgatccaagtgatataccgactgctttgtaaaaattgatgcatgcaacctaaagctgactacatcattgaaaattcacatagcaaaacaactataaaaaagctcgaatgctgtgagtaaagaaatttccaaagtattggacatacgccatgcgcacactgctttaacagatgtgcttaagtccctaaaagacacatggtttcactacacccaaaaatatacggcatatgtggtgtaaaattcgagtaaataaactcataaaggatttaccaaccgcctggaaaatgaccaaaatatataatcagcctaagccataatattggtcaataaaagtgcacacttacgtggcaaaaagcaatgatattgtatccaatcaattgctttatgaacccaaacaacgccttgatttatataaaaaagtcagcgggcagctatataaagcattactgtttggcaccttttaaaatgcaatgtaccaactcctaaaaagttgagtaactgcgatataaaaggattttaaggtattgggcacataatcacgcgcacttttgcctaagcaaaaagatgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtgatatagaccaagtatagctcatatgaatagcttctgatctgagtgattatcccttatgggatactccgaaatagatataataattgaatcccgactgacacaagtattcggttgataacccttatagggaataataaatagtccagtctttgagcatagaaaatagacccatgtttatgaattcatgttgcatgtatccagagcaagtccaaattgaaggtatgatacttgtgtttgagctaagcccctgagcatatagcttgtccttctgtcgtaatcacagttgtccattgatcgtagctgacgcagttggcatagagacaagacgaccaatatagagataatattgcctaccagaggtggcaaaaatattggtggtagtgaagataatgataccaatcaaaagtgatgaagttgcatagccgtggaggcgaagaaaccagtcggtagcagtcaggtcagccagcaatgaatatgaaggcgcccagcgataaagttgtgtagccatggcagcgaaataatcagtcgatgacagacgaggcagctggtgaagaagatgaagatgcccattagtggcgacataataagccattcgtgaaggcgaggataccaatcgatggttacgaaagcaagccaacggtgaagatgtagacacgcatcaaaggcaatgacgaaatccaccaatcatgaagatgaaggaaatagtcggcgacgacaaacgcaaccaacatgatgaagatgacgatgtcggtgatccagtcaatagcagtgtagcaaccaatgataatgatgaagacgctcatcagcgtttgcatagtaggtcaaccgtgaaggcgaaataacaagccggcaatgacggaagcaaccggtggcgaagacgtagtcatccattagcaacggcagagatgtcagggccaatgaagtagaggtgctggtgatgaagtcagtgacaataatccatcaaattggtgttatagctgttgtagatgcttcacttggaggaaagtagatgatgttgtccatctcatcgaaactgagctgattggttgataactctgctctaaagcaaagatgaagataatgactcctggagttgactagttggctgattaattgattgcttcagcttgtcgaattttgagagtcttgtatttgtgtagcccccgactctttagttagttgggaaacaactgaacatagagtcgagaactgtagcttcttgtcgtcgtgtaatcattgcttgagtgaagataaatattgaagattggaacatcacttgttgtagtaaaataacacggcatcatattttgtgacacatgccgagatgtcgaggctattgtagacgtcgtggttggtgaagtggcaaatcatgcgaagtagaggctatagagtttgccggtgccgaaaataatgaagatgaagtagctccaccatggtgacaaagttgcacagccgtgatgaagtgaacacgagtcggcggcaacagaagcaaaccggtagcgaagacgcgtagccgtggaggcgaacaaaccagtcggcggcagacaaggcgaccagcaataaaaacaatgacgtccatcagtagtgatagcggcataaaccagccgtagaggcgaggacaccagtcaacagcagacgagacgaccggtggtgaagacgataaggccaataaccaggggcagaatcatccagccatggaagtgaataaaccagttggcagcaggcgtagacagcttgcgttgaagatgacggtgcctattagcggtgacgacgacgtagccagccgtgaagaagatagcatcagttggcgtcatatgaagcgaccggtcagtgaagacgtagatgcccaacaacgacggcataataggccagccgtgcaggcggaaacaccagtcggcggcggacgaggcggcctgtcggtgaagacgtagacgcccaacaacggaggcataataagccaacagtgcaggcggaaacaccagtcggcggcggacgaggcggcctgtcggtgaagacgtagacgcccaacaacggcggcataataagtcagccgtgcaggcggaaacatcagtcggcggcggacgaggcggccggtcgatgaagacgtagatgcccaacaacggtggtgtgaccaaccaaccgtataggcgaaaacaccagtcggcgatggacgaggcggccggtcggtgaagtcgatgatgcccaacaacagcggcataataggccggccgtgcaagcggaaactccagtcggctgcagacgaagcggccggtcggtgaagacgtagacgcccaacaacggtggcataataggccagccgtgcaggcggagataccagtcggcggcggatgaggcggccggtcggtgaagacgtagacgcccagcaacggcggcataataggccagccgtgcaggcggaaacaccagtcggcggcggacgagggcaagccggtcagtgaagacgtagacacccaacaacagcggcataataggccagccgtgcaggcggtgacaccagtcggcggcggcgaaagcaagccggtggtgatgttctgactgatcccattcctgaagcgtaagagataagcttaaagccatgaatcccttttatgcatatctggatctggatcctgtaaaacaaacatataggatgagtagtatctgatataaatataatactcgagaaaaattcaagtattttaaaatatttataaatatgtatttctcctctactcaattttgatttccccgagcagatgactccgtacgtttaaacactctgtccgactagtcatagcccccgagcatcgggagtcggcctaggcacttcccaaacatgcatatgagtgacatgagttcgtcattaatggaacaaagtttcacgaatcagaatttactactcgggtacttttgcaattgtagagagcagaaaatagatttatcttatctctatgcttttgatttattccgaataatatttagcaccttgcgttacttggtccatccaacgagcccccgggtgctaggaatcggcccaaaggcaactatccatcgacaaaccaaatggaaggcataggaagatagaactccataactcgataggcactttatttgaactcggagtattttgcaaccaatcaggataaatattatgaaaaatgttgaaaaatatgatataacatctgtagcctccgactcactagtcaacagcgaaccagttgaagtagtgaggcagaggaaaaggaaaatatcatataaggaataaaacaatgatgacttagctttgtaatattccccttggtgatggcagaggtggccaatgtgggaaaaaagtcgtccatcaataacaatgaagacaccagtcggcggcaacgaaggcggtcgatggtgaaagcgaagatgtccaccaacggcggcataataggccagccgtgtaggcggagacacctgtcggcggcggcgaaggccaaccggccggtgaagacgtggacgcccatgaacggtggtatgaccaaccaaccgtataggcgagggcaccagtcggcggcgacggaggcaggccggcggtgaagtcgtagacgcccaacaacggcggcataataggccagccgtgcaggcggaaacaccagtcggcggcggcgaaggccagccggtcggtgaagatgtggacgcccatgaacggtggtgtgaccaaccaaccatataggcgaggacaccagtcggcggcgacggaggctaccggtcggtgaagatcaatacgcccgtcagcagcggcatagcaggccagccatgaggacgaaggcaccagtcggcaacagtagtgccgcggtattacatgtaaacatcagaaaataccaagagattaatctgatatttagagatcaatctaataaacaacaataagttgaaaggaaaaaacccggcgaagtcgagattaaatcgttgaactcgccaagattggtcttcccggatgcgtgcatgtcattggaccgatccatgctgctgccatgcgtgtgtaaatcattgacccgagtctggattaaattctagccggagggttcagatgatgggaaacgaactcgggtgacgaggtggcatagccgcgttcacgcgtggccataactcagaagaatccgatgacagctccgataacacatgcaaccagacaaatcaatctgattagcaatggcaaagtacacagaaatatatgtttcttatactgtatatgcatgtaacgtagatgcatatttgcatagataggtgcaaaagccattcatattaattcagttgattgatcccgtgcttgcatggacagaaccgatctgatgaccccgcgtaactccggccgttttccccatggcttatgtttttttcaacccgcagtgatcagaagaattcacagcgcggcggcacatgtaaccagagaggaaaaacaacagaaaatcaattgtgattatagatcaatctgataacaatatattgaaacgacaaaccgattaacatttggagtcgtcgaactcgttgagattaatctcaatgcttgaattgattccatcgcactcgtcgacgggaaactcgacgcatcccctgcctggcgcgccagctgtcaaaacatgaattcggcaataataaaacggggtagcgcacgaaacctaaaagtatatggatgcagagacaaggatttagacaggttcaggccctctcaatgagaggtaataccctactcctgtttggggatttgaatccgccgagtgtagtatagatctgacgatctaattgtctcatgccccctagagggcctcctgcccaccttatataggatgggggacatgattacaagatagaaaccttatccaatacggtatcggtttcctaaatctactttacaatcttatcaaaccaggactttaggccgttccgtaatatacaaggaaacgtaatacccaagtcatgatctgttacatatttcatatatataagttatcccctataactagtcggataaccgtgccgtgtgggtatggggtacccataatctccacaagtgcgcccgcgagtcgaactcgaagatgcatggtgtgttgtggcaacttgggaacgagctgcttgcattggcgttgtttgggtggttaatcgatcgagtgcgtgcgggtgggtgatgggtgtggcccacatggctcacgaggcgcaacagtcaaaatctctgtcactgcaactaaaaggtcactacaactaaaaggtggtaaatgtctacttggacaggcaaagtcaccatccgatcccacgcccctacgacgcttcttttccgtgccgataggtggccctagctttgcacacacctctcccatgcgtgtcacgcccagaaattcccgaatagaattccaagcagaatgtgcattaaaatccccgtccaggactggctggggtacacaagcgacaaagttgacatacagatccacgtcttacaaacattataaaagtcttacataaatgcagcggaaaaacaaaagataaaaggggctaagccttgactagatctgcagcgggaacaccaccccacaggcatcctcgacggcacggacgaagcctactcctcggagaaaccaccatctgacgcatactcatactctagggtttggggaaaaatagagcaagactgagtactacccactgtactcagcaagtcataccggaataggggtatgatgcagggaattatcaagggatagctatactggtttatttgcgtaaaacgggcatttataaacagaagttgagaacagtaaaacagttgtaacaattaatcaatattaatcatccactgtccaacgctataccacgttgccacaggcccaaccatccacctatactatctaattccattagactaaactagggtgagactaatcacggtgaatctggttgaccgcccataaccgcgggcacggctattcgaatagttttactctgatcagaggtgtacaactgtacccacaagacacagccccacaacacgtttctgtgcgccgacatgccaccacgacataccagaaagagactgtgacaggacccttcgcataaccccctctagctaagcacaccacacctcaagtttcacccccgtccccagcgggcaacgggcagtcccctctcgtgcctaggtgaatccggaagcgacagaggccgtcgcagggcccgccccgctccatcacgcccacccttgcctggatgcgtcaactagaggaaagctacactataagcccagccgttgcccacgttggcttgtggtaagtacgataagttcttccagggcatcctgcgaaccggtccttaactgccatgggcgcgaccaatgtcacgcccggaatttctatccaaaattccaaacgcttacatgtgtgttaaaccctcgtccaggaatcaaccgaggcacacaataacaaattgataatagagtacaaataaataactatttaatattcgcaaataataaattattacagaggtagatagttcctctcaaagaataacattctacgcagcggaaaaataaaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcaagtgcataggataacaaaggatggcataatatagctcatttgcataacagcatttaacaaatatttaagagaatagtaaaacagttgtataatgaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgcgactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaagaactgtgacaataccccttgcacaacacaactcaccacagtgcaccgttcctggatcataatctccccctcaaaaccagaggcaatggactccccagcgacccccacggacttctcgccgcttcacagtctggcgcactataatgaatcatgctatacaaaagataaagccgttgcccacgctggcttgtggttggcacggtaaaagttttacaacagtagctcgcgaaccggtccttaattgtcatgagcacaaccatcaaaaccatatgctcacaacccaccttaaccaggttttaatcatcaattaattaacatcacacgattaaccatcgtgagctaccatttaatgtaaccataattaaaataataatgtaacatagtttataattaatccctttagttagctaacgtttctaagcatggctaagcaaacttgcatatagcatttagctgaaccaatccaacatataaggttcatgctaatcaaattataacctataggaaaataagatcatcttcggccattaattaattgggaaaggtttaccacccgatgacattcgaaaacaatgcatagctgaaataaaataatagctttaaatgggttcaacatgttcaaagggttgtttgggatctgtgtgacttgccttgggcttccgcaaacgcttcggaaccttcctcaacggaaacgctctcctccggaacgtcggaaactaaagcaattaaacaaaaattaacaaaacagtacaaaaacaagcatacacagtacatgtggatatttttaacatgtagatcttgattttagaaaaatttagcaacttgaactacctgaaacggatctacggttatttagttatgattttctgaagttttaatctattagaaaaacgggaaaaagaaaagatgatgatgtcacgatgacgtcatcaatggtggccggcccgaattgacgacctcgccggagctagggcggtcggccggaactttggagggcatctacacgtagagaacgacgagacgaacgcgacggtacttaccaacacaccgaacgaccaccgacgatagccggcgtcgagaaggcggcggcggcggctcgggttgactggcggcgacgaggctacggcggccggcggcgaaggggaggaggcggccgagcttccccacctcttggcgaaaccagcggcggcgacggcaagcgacggcgacggcggaggcggcgcggcggcgcaaccggagtccggccggcggcgggtggcttgctaggcggcagtggcgacggagctacggagcacgggaaaggacgggagttggggcaaacgaaagaggaggactagggggtcctatttatagccttggattgaagagatcggactccttccgcaagaaatcgactcgggaaaatcaaaaactcggttttggagataaactcgaaaacgagttcgattcgggcaagatactcaaccatttgctccgattcttgaggggaaagatagaggaagatgtggggataaaaacccctcaaaaatccggactaggggtggagagatcggggcggaaacggaggcagaaggcggcggctcggccggctcgggctcggcttgcagccggccggaggtaggagacaccaccgacaggtgggccccacctgtcggcctccacgcgaggaagggcggtggtggcgggttgggccggatgggccggctcggccacgggatgtgggagggatgttgggccaaaatggcccaacggcttcagggaagagcctgcgactttctactttaacaatagactgcgaaaagtcggttcagtctgcgatagtacattgttttccgggtgagagactcgatcgaaacctaaccttaaatgacagcccggcagttaaccatattccaacgaggtcgctggtagcgtcaaaaatcccgcataacactaaggtttagccttcccgctcttacacaatgtcccaaaagggctccgcacttccttctcaatgaaaccgccttaaggcgcggcaccccacaaaaacctg

SEQ ID NO: 21717 - DNA, 3035 bp, Oryza sativa
  unsure (1)..(3035): unsure at all n locations
tgatcatcgttatcactggggggatactttgggatttattattcatacatcacatatactcattcaacttttanggataatatgttttatgaacactttcncntccncnccccnccnccggttttgattgcttgtacgctcggttcccacaaagatngaagngtccaacttcaggaaagcacaggtgaggatgctataacaacaatagagcatatcggccaatttattgaacaatgtggtaaggctggtagggatggggggctaaaaatgaaggggggggggctttccttgtcaaaatatgcatttaaatggatttgaacactggcttcttaattaatttgaacattagggcgtgacaaccaacaaaaccatgcacccacagcccaccatgtgatttattttaattgacccacaccgaagcggtggcattaatccaacattaccattagaacctacagtctatacattaataggattttccccattgtgtgctagttgaactaagcatggctaagcaatccctagtccaatatctagtcatgttatatcccaagctaacaaaggagcatggtaccaaaatagcatggctgtaacagtaggtaaacatctcatagtattactgtaaaacaatgcagtatttgatggaaaacattagaacatttgcaatataggatcaacatgttcaagtgacaagcatgacttgccttgctctgctgctggaggaacctcggcgactatctcaaagtacaccggaaggtcaggagagccggaatctaagcgacatacaaggcaaacaatacaaacaggctataagactactgaaacaaagaacaaaaccatttttaatggattctacacatttttcttgatttactgagacttgaatggacttaaacggagctcggatgaattagttatgattttaagaagattctctgtgtttttactagaaaagaaaagtccttaatgaattattgcgcaataaagcatcccagggctgacgtcatcacgggaagcgggcggcgccgacatgcgggccccatgggtcagcggctcgggagagagaggaaggggcgccggcacgtgggccccactggcagagacacaaggcgggagggggtgcggctaacaagcaggccccacgggcgcggctccaagggggggcgagacgccggcctggcccggcatcaagccggccggcctgccatggcaagggcggcggcgcgcgcgtcgctggcgacggcaaccggcggcggaagacggcggcgcgaaggcggcggcgcatggcagaagcggcggctcgacccggctcggctaggagggagagggaggggaaaagaggaggagggatgcctcaccgtgagttggccggtgcggggaaggacgacggcgaacggcgatggcgactaccggggaacgacggtgaacggcgatgacctccgagacaccctaagagagggaaattgagagaggggagggagagagggagtccacggcgagcagcaaccgtggccgatggcggcggttatggagagactcactggcgcacgaccgaagcggccttcgatggcggaactcggcggaggaggggtggaccaggtggagctcggcctcgcgaacccgacggcggcgacggctcggtgcggtggctaccctaacggcggctagaggcggccggagcaacgaaaaaggcgacggcgggtgggagcgcggtgtgggagcgatggggagcacgggagaggccggtggaaaaaaggaaaatgtggaggaggacgcggggacgaattatataggggcggagaggtcgggaacagccgggagtggctcgatttcgcacgagttagtgggggaagttggaggtggggagagagagagagagtggcgggattcgaagtcgaatcccgcccatttttggggcgcgcgagggcgggagacccagggaaagccggtgacatgggctcagcgcgcggagtggggcgaaaagggcgcggaagaaccgaagggggtgggcccggcggtttcggcggctgttgccgtcgtggggcgggcggccggaggaaggggatgaccccgacaggtggggcccacctgtcggcgtcctagagagaggagggaggggcgcatgggccggcccaagaaggaaaagggcgcgcgcggcggtggggtggactgggccgacggcccaagaagaggaaaaaggagggaaaagaaaaagaaaaggaagaaagggtttttcctgggattaaaaattgcatgtgctcaattttaattggttaaaattatttctagggctctgaaaattccactaaaaatcttgttagtaaatttcgacatgtagaactcaagaaaaattccacatgccaattccgattattatttgcattggtttattagggtttactcttgcttttacaccgatattttcttgggaccatttataaattcaatttaggtttgggaggagaacttcagggtgtgacaatgcggctctcactcgtcgatgactaaatctcaatcgttgtcagggttacgggtcaggcataccctctacccttcgatatacgttacgtatcaacatggcatacccacgcgtacgcggatatttcctttatgatctaaggaaacctttcacgaaatcaatagacgggaagagtccttctcggataagaactgggttacctacgtattgagctgggtctggtgtgttcgagtcctactcggagaccaccagacctgcgatataaaagggaccccccggggagggcatagaggatcgaatctcagagccaacacaacccacacaggctacgaagccggagcctgcgaggggccacgtcgtcaagagctagtcgaatcaactcgactttaatctcgccggattcgacaagttccatctttcctttgtaacctgtgttttccaccatataatcccatatcaaatggattnnnnnnnnnnnnnnnnnnnnnnnnnnnnnnnnnnnnnnnnnnnnnnnnnnnnnnnnnnnnnnnnntggngttcatggngatcataacac

SEQ ID NO: 21718 - DNA, 747 bp, Oryza sativa
  unsure (1)..(747): unsure at all n locations
ggtgtttgaaccctgatagccagttatacaannnnnnnnnnnnnnnnnnnnnnnnnnnnnnnnnnnnnnnnnnnnnnnnnnnnnnnnnaatgagaaatgacacaagtgatcacctcttctacatcgagcaactcaatccttggtacaaactaatgcttataccattttcgagttcaagtttagtacgaaatagatcaataacacgtccccctgcactaaaagctgattctaaagcaacaatgaaagcttgaatggacaagcacgtgaacaggatatacatctttgtgagctttccaccatgataagacatcaaatttatctccattaggaaccaacagtgatggctaagccatttatttatccaagtcacttgcatcacttccactatccacatgtgaggcatagacataattcataaaatcataatctgcttcttctatagtatggctttcttttgattcaacattgacactagttgttggtgcaatagtagtcttataaaaagaagcatattcttgataaaattgcttaacaacactagtaaacttttgcataggtgcatgatatgattgcttaccatacacctcagcatgttatactctactggctttgtcttaaacctaggttcaagaaagtatgccacaacaagagtaagattggacctcttccagtacttaacaacctttttaatcattgagggggcaattgttttgatgcaacatcattacttggcatccagggagaaaa

SEQ ID NO: 21719 - DNA, 749 bp, Oryza sativa
  unsure (1)..(749): unsure at all n locations
acctttatgagtttatttactcgaattttacaccacatatgccgtatatttttgggtgtagtgaaaccatgtgtcttttagggacttaagcacatctgttaaagaagtgtgcgcatggcgtatgtccaatactttggaaatttctttactcacagcattcgagcttttttatagttgttttgctatgtgaattttcaatgatgtagtcagctttaggttgcatgcatcaatttttacaaagcagtcggtatatcacttggatcatgttgctatatattaatattaagtcacttggttgactacaattatcaaaaccacttggttggttggattatttattccttgactatatgcttggtttgttcaattaaccacatgatcgggggctaaaccaattaggtgcatctagtcgatgcacctgactttatttttcagccatccacagtcttctgatttagtaaaagtactcggaggtcatggcgaagatgattgaagcactcggctttggagtaatctagttcgagagaagattatcttttcgactgtgaaggtctcaggggctactgtggagattatgggtaccccatacccacacggcatggttatccaactagttataagggataacttatatatatgaaatctgtaacagatcatgannnnnnnnnnnnnnnnnnnnnnnnnnnnnnnnnnnnnnnnnnnnnnnnnnnnnnnnnnnnnnnnnnnnnnaggtccatcaaanntnnaca

SEQ ID NO: 21720 - DNA, 2071 bp, Oryza sativa
  unsure (1)..(2071): unsure at all n locations
acgttnnnnnnnnnnnnnnnnnnnnnnnnnnnnnnnnnnnnnnnnnnnnnnnnnnnnnnnnnnnnnnnnnnnnnnnnnnnnnnnnnnntcagcagtactatgagcgagcaaatttaatacaaatggaaagtgctcggatcagcttatctgcacgactaatccggaaatgccctgttcccagcacatgtcgcgaatccatccgtgatccttttgctctcacgattttggaacaaaaaaactatttgtccgtttcacaatgtaagtcattttagttttttccatatttatattggtgctaatgaatctagatagatatatatgtctagattcatcaacatcaatataaatatggaaaatgttagaatgacttacattgtgaaacggagggagtaattaaggttccgaaaatgctatacgtccaaccgacgcgtacgaccagcgcacgactacgtcattggccgtccgccgtccgtaacttctgcaacgatcgctaattcaattgggcttgcgccgtgtatttcgccgttgagtcgtacgctggtcggacgtatagcagcgttgttaaggttcatacattgactttttgaaatgtgggctgttagctagctgtttgctaattataccacgcgtgccataataatacactcaatgatttaataaaattgtgctaattaagggcttaaggctcactgatgatctgcatcttaattactaagcagggccatgtgcgatatgttgactccgataagcattcggttactgagatcaccgccagatcgaggcatgcatgcatgcgatggcagctgatcatagagcatggccaaaattcggaagatggtcatgaagataatgtgttacaccctcgctaattagcttgatggaaacctagctaattagtgtttgccgtggaaattttctaagatactccctttattttaaattgatctatatatagttttttaggttattcctaaattatcattatatttatgtgcattcattaagcctattcgttggagtatttgtgcattaatattggagtaaatggacattgatacatgtatccatgcacacaagtatttataacccacatgcaatatcttgatttgctattgaatagaaaataatgggatggtgtatgcatcgagcttgtttttagagtaaatatagtatgagagagttattagtttttcttggttttggtgtacctatgaaatatgtagatcaatttagaatggagggagggagtaatgtgttacacactcgccgagcgaggattaattgatttgctaggtagttagacggcttgactgccatgttgtcagcttatttactaaatcattcaattaattagttgctcaaaaatacatttcccaaaaaaaacttattccattgtatagtaagaccacttatttcattattttattattttctaaaaatatctaatttatccctataatgaaatatgtaatccacagaaataatccagtcaccaatccattttaaatttatagacttcgatgtaacctatttcttagatcaactatgtacaagatagaaggctagaaacttttgagataatatagcttatcaaaaaaaaacagagagaaagctagcaataatactgtcgacgtttgatgtcgcggttctggtatttacatagtatgaggatcgttgttagtaggatatatgcgagactgaggtaaacgagacggagatagagatttttatataggttcgggtccctgaattatcaggtaataacccaacatcctgttggccgaaaccggtcgttgctctttattcaccatatcacaccagtacaatatttggggagcccaatctaccggtgttggaaaggcgggtctgaagttttgattggaagtggccacaagggtagtcttccttctggaaccggggccggccaagacaaaaaaaggggttccggtttatcctgccggtttccaaagccccggtaggggattannnnnnnnnnnnnnnnnnnnnnnnnnnnnnnnnnnnnnnnnnnnnnnnnnnnnnnnaaccaaggctgtcaaccaatnnntnccat

SEQ ID NO: 21721 - DNA, 1202 bp, Oryza sativa
  unsure (1)..(1202): unsure at all n locations
ccgtccatgaatgcatgacactcaattatanangngcnnnnnnnnnnnnnnnnnnnnnnnnnnnnnnnnnnnnnnnnnnnnnnnnnnnnnntcttggttttgtggataggacacaaagaccagataacttctgaagtcaggttgggtggcccatggtttatggcggagggacaagacttggccgcatcaaaatccttcacgagtttggatgtagtcgataatccgttctctgtttcaacgggtggatttttcgacatggagccgtcctggttcatagccactgcgttctcgtttccagtcattggaagaccggttgagatcggcatcgtggtgtaaaccgggaagactatttcgccgacttgagtccataccagcattattgaagctgaaagtgcttgactggagctggtgttgacgttgttgtcgacgaagcttgatggcatagtagtagaaccttgagtaccaagtgcccctacctggcgcgccactgtacgtagactggatatagagggtattggggtacgcttgtacaaggatctacgtattacaacatcaagttatcaaaaaaacagaattatactggttcaggccccttgataggtaatagccctaatccagttgatatgggattatatggtgggaaacacaggttacaaagaaaagatggaacttgtggaatccggcgagattgtagtggagttgattcgactagctcttgacgacgtggcccttcgcaggctccggcttcgtaggctgtgtgggttgtgttggctctcagatttgatcctgtatgacctccccaggggtgccttttatattgcaggtctgtttgtatagaagtaggattgatgtctatgagtcacatacagagttggtgcattaggatacaccgttaagtttccagccgagttatttcacattcgacaaaaaaaattggtaaaaatcgtatcaaattttcagccaccgaatgggctatacgatctatgcatgttgtattgggtaaaaatcagaggacattgcgcgaggtgagggtcaaactgacaaccgcaggcagccccccctaagccagcacaacttttgaattttttagggacgtaagtacatgcgaattatattataattacaccataattatatatatatatatttatcgtagttatatttgatatagggtaccgagctgaatagtcaatcaataccgt

SEQ ID NO: 21722 - DNA, 875 bp, Oryza sativa
  unsure (1)..(875): unsure at all n locations
cgcggggcaggagcggcgcgggcgtgctcgggcgccggccgacgggaggagaggagcggcgcttttgcgcagtcagcgtgccgaaagaaaagggggggacgccagtgttcattacggggatcagagaattctgctacgttaagatgccttgcggactgataaccaccgggaatactttccagcgtacggtccagggcgcacttagcaaccagcttggcaacaatgtcgaggcttacgtcgacgacatcgttgtcaaaaccaagacaagtgactcattgattgacgacctgcgggaaacgttcgacaacctcggacgatatcgcctcatgctcaatctagagaagtgcacgttcgaagtaccgtcgggcaagctactcggattccttgtttctggcagaggaatataggcgaatcccgagatgatcaaagcaatcgagaacatgaagccgcccacatgtctcaaggaggtgcagaagctacccggatgcatcgcagcattaagcaaattcgtccctaggatggcagaacgaggtacagcctttcttcgccttattgaaagaacaagacaaatttgtatggacacaggaagccgaagaggcatttattgcactcaagcgctacctatcaaacccccctgtactcgttgccccccaacttaatgaacaattattcctttatattaccgccacgccatattcagtgagcaccgtcattgtggtcgaggcacagataattcagctcccagttgattacgccagcgaagctctccatgaggcaaagtctagatatccgcagatccaatatctgctatannnnnnnnnnnnnnnnnnnnnnnnnnnnnnnnnnnnnnnnnnttctcccaaccaaagncgcgg

SEQ ID NO: 21723 - DNA, 1350 bp, Oryza sativa
  unsure (1)..(1350): unsure at all n locations
naaactcatttaaaccctagactataggttaatatgataatgtggaataagtaccaccgctctggtgttggttaaataaaatgaatcacatggtgggcttgtgggtgcaaggttttgctagtcgcgcccatagcaattaaggacccggttcgcgggaaaccctgaaagaatttatcgtgcttaccacaagccagcgtggccaacggctgggcttgtagtgtagcttttctctagctgacgcatccaggcaagggtgggcgtgatggagcagggcgggccctgcgacggcctctgtcgctttcggattcacctaggcacgagaggggactgccagttgcccgctgggaacgggggtgaaacctgaggtgtggtgtgcttggctagagggggttatgcgaagggtcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagactcaccttagtttagtctaatgaaattggatggtataggtggatggttgggcctgttgcaacgtggtgtagcgttggacagtggatgtttaatactgcttaattattacaactgttttcgcattcaattcctgtttataaatgccagtatttatgcaaatgaacctgcttagctatcccttgttgaatccctgcatcatacccccattccggtatgacttgctgagtacagtgggtagtactcagccttgctctatttcccccccccccaatcccagagctcgagtatgtgtccgatggcgggttctccgaggagtaggcttcgtccgtgccgtcgaggatgcctgtggagtggtgttcccgctgcagttcaagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 21724 - DNA, 2451 bp, Oryza sativa
  unsure (1)..(2451): unsure at all n locations
cgcgaacttgannccctttgatatcgaccctgatatggcgaattcgagctcggtaccccttctctctcatccccatttgatgcaaataatcattttttattcaggcttacccctattaaatgttcatgacacaccagtgaaacccccattgtgactggccttaggctgagtttttcgcacgcaccttaaggtgaggttgttattgcaactcgttaaaggtgtatgatattattggttacgacagctgatctgatacagataagttttttacattattgatcattcatgaatgactagacccttcactatcacaaatgacggtttaagtacgacatagatgacatgttccgcaccagcatgatattgaattagcatgttataatatttcaaaaattcaaaaacatggattttatcatcgtttccttagtaggaatattccaaatatatatttttctgttttttctgacttttctatatatgacaaatatgaagcatttggaatcctctcactggccccatctacaatactccctccgtttcgaaatgtttgatactgttgactttttagcacatgtttgaccgttcgtcttattcaaaaacttttgtaaaatatgtaaaattatatgcctacataaaaatatatttaacaatgaatcaaatgataggaaaagaattaataattacttaaattttttgaataagacgaacggttaaacatatactaaaaagtcaatggcgtcaaacattttgaaacggatggagtattttactaaattcgcattttacttcttatcaagatctccctgccatcgatgggaatcatactacagcaggcgcttgacctcactatgaccaccaagacaatagttcggtcgtttactccaatggtaataaaaacacatcaaaataagttaatgtgttaactttatttttcgaaattcgatgcagcaatctgataaaaaaattgttaccattaatattaatgcagctaattaattactttttaattaaattgaagtattttccatgataccaggcccatgataccacattgctgatcacagagctagtagctgtggcaagagaagagcatgctctgttgcaagagtgtctcgagttgctgggccgagtgtctgcattgcaggtagctttgagtcaatatgttccatgaaagaaaacagcatatattcttttcccttatttttatttaacgcgatgcttatgctaatcttcattgatcgtgcaaatccgcaggttgaagaagagagcttgcgttgccatatgcttcagtcatagttactgaatcttatgtccgttgatacagtatgatgacagtagctaaatgttggcttgttcgctctgttatcatttttaaccttaccaaactaaaataggttgaataacagcagtaaattaatatttttaagctgattgcatcaatcagctgtagacatcacatttttgtcagtatacgtaggggctacctaatgcaatacaggaaaaaaaattgaaaatatactgtttattttttctaaaaaatactataagcaaactttattatatgaatagaccatcgtcgcgcttgaaataaacgaacttgttaacgatatcatcgtgtcctatcgccgcggncacttccgcctagccctnnccgccgcaccagacctaacctaccgcggtcgtcgctgacatgtgagatgtgagagagaagaggaggggatagagagagaagagagatgggagagctgacatataggtccaagggtatttttgacattccacatgatttctctctcctattcaaccgaaaattattatttaaattggtgcagtgtccaccagcaaatatccaacttttgggagtattttccccaaagtcatttcgtgtcatgtcctacagttaaaaccgcaaactcacgatgtcatgtagcaaaatttgcctaataaaaaacaaacagtggatccgctgcatcgcgctcccgacaagcgaacttacacgattaataattagtatcattagtaattgattaatgaactattatttttctaataattgttgtcgtgacccaaggtcacggacaaatagggggatagacgggagctaatccctttactcattttggcatttgagtcgtgccttttcgttttttgtgccccctcatctgcgagtgctccctccacctcgcgcctatataaaacattgttggtcactatcagagagcctcacgtgctccagttttatctcgttctttgaccactttctctttctactcgaactttctatagttttcgagtttaaccatgggtaaaactgtcaagaaaatcgccacaagcctaagttcaaacagtcttcttcaagcttnnnnnnnnnnnnnnnnnnnnnnnnnnnnnnnnnnnnnnnnnnnnnnnnnnnnnnnnnnnnnnnnnnngaagtataattntcaagccgtg

SEQ ID NO: 21725 - DNA, 697 bp, Oryza sativa
  unsure (1)..(697): unsure at all n locations
ccgtaccatggtagcccgctannnnnnnnnnnnnnnnnnnnnnnnnnnnnnnnnnnnnnnnnnnnnnnnnnnnnnnnnnnnntcttcggtgtcaccgccgccgctcgctgaatgtggaacaacgcctgatgccctgaccctagctacctttcacacgatgccaagtggatacgcgaatgcgaggtgaagcggggaacttgcacgatgcaaagcgcacaacacatcacacaggcatctatgatgggctggctcatgcgttcatactcatcaacttttgccccaaactaatacatgctatatactataagtttttcgtttttttgggtgtgccggtgcatacccggcacaccccctgggtccggccctgtgctaaatgttccaaaaaataatcatacataatacaaatagatatgaaccgacacaatttttctcatcaatttaaggttatatggtttcaagtaattttacttttagtatagagtttatacgtttcaaggtaattagaaaaaaatcataacccatgtccaaatcagttcttaagcaaaacatgtttaaaatgaagtcagggaatatttcaacaaatttattctaacataagcatttacaattaaaattaaagcaaaatttaacaaggtgtcccggcatttctagttcgtattaataattgaaaccactcaatgctagaaaaataatgcag

SEQ ID NO: 21726 - DNA, 782 bp, Oryza sativa
  unsure (1)..(782): unsure at all n locations
gtggaatgaacatcaactnnnnnnnnnnnnnnnnnnnnnnnnnnnnnnnnnnnnnnnnnnnnnnnnnnnnnnnnnnnnnnnnnnnnnatgcatatttccttctactggtggtggagggctttttaattaaactgatagtttacataatatttgcaggatatcatgcatcggtcgatcgatagcactgcaaaagcctatatatctacttgatgcctaactcgcagtgagctggctgatgtttatcgggtaaaccaacggcggggatccatcaaacgcaaccttggagagtctcttggccgtgaactacgtcggatggaccatgtgccacaacatgtatcttgttcgggtggcgcaataccagcttgcccgagtgcactggaacatggcgctgttgtaccctaagccatagcttgctgctttcacctcagtattacctaataaaaataaaagaaacaaccccacgatggcattggattaattcataagagatgtatttttaatatgaaatataaaatattaaatgtagaccctaattcaccaaattacatagttaaaaccttggctcgcactcaaatggaccgattatttagtgacgagattatcagaaaatgcccaattttagcccaaatattacaaactacatttttactattaaagagactacaaaactactgattccaatctttcaatccttaccactaccgttatatatgttggagctctaagttgccgctttgatattgtattggtacatgcaggtctaatgcaaatctactagttag

SEQ ID NO: 21727 - DNA, 798 bp, Oryza sativa
  unsure (1)..(798): unsure at all n locations
atggattgacgactgtacccnnnnnnnnnnnnnnnnnnnnnnnnnnnnnnnnnnnnnnnnnnnnnnnnnnnnnnnnnnnnnnnnnnnttatctccaaaaccgagtttttgattttcccgagtcgatttcttgcgggaggagtccgatctcttcaatccaaggctataaataggaccccctagtcctcctctttcgtttgccccaactcccgtcctttcccgtgctccgtagctccgtcgccactgccgcctagcaagccacccgccgccggccggactccggttgcgccgccgcgccgcctccgccgtcgccgtcgcttgccgtcgccgccgctggtttcgccaagaggtggggaagctcggccgcctcctccccttcgccgccggccgccgtagcctcgtcgccgccagtcaacccgagccgccgccgccgccttctcgacgccggctatcgtcggtggtcgttcggtgtgttggtaagtaccgtcgcgttcgtctcgtcgttctctacgtgtagatgccctccaaagttccggccgaccgccctagctccggcgaggtcgtcaattcgggccggccaccattgatgacgtcatcgtgacatcatcatcttttctttttcccgtttttctaatagattaaaacttcagaaaatcataactaaataaccgtagatccgtttcaggtagttcaaggtgctaaatttttctaaaatcaagatctacatgttaaaaatatccacatgtactgggtatgcttggttttgtactggtttgttaattnttgggttaattgcttn

SEQ ID NO: 21728 - DNA, 5847 bp, Oryza sativa
  unsure (1)..(5847): unsure at all n locations
ctggnttgaanaatggtacttcnnnnnnnnnnnnnnnnnnnnnnnnnnnnnnnnnnnnnnnnnnnnnnnnnnnnnnnnnnnnnnnnnntaggcatataattttacatattttacaaaagtttttgaataagacgaacggtcaaacatgtgctaaaaagtcaacagtatcaaacatttcgaaacggagggagtattgtgatggggccagtgagaggattccaaatgcttcatatttgtcatatatagaaaagtcagaaaaaacagaaaaatatatatttggaatattcctactaaggaaacgatgataaaatccatgtttttgaatttttgaaatattataacatgctaattcaatatcatgctggtgcggaacatgtcatctatgtcgtacttaaaccgtcatttgtgatagtgaagggtctagtcattgatgaatgatcaataatgtgaaaaacttatctgtatcagatcagctgtcgtaaccaataatatcatacacctttaacgagttgcaataacaacctcaccttaaggtgcgtgcgaaaaactcagcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagggtgcgtttggcagcttgtgttcacaactacacctcctctgttttccacgcacatgcttcacaaactgctaaacggtgtgttttttcaaaaaaaattctatacaaaagttgctttaaaaaatcatattaatctatttttcagaaaaaatagctaatacttaattaatcacgtgctaatgaaccatctcgttttacgtgtttggagggagagttcccaactcccctaccgaacacaacctaagtgtattcatcaacgtctttttatgttggaagtgcatatttttaagaaatagagctttaaatgaaaaaaaaatacaaacctttgcgccattggtaagagggagcttacaaatggctgcctgggtgcaaactacggtagaatccaaagccacagcatgcttgctctccagctgcccccagctttccaaacctctcatctgcacatattcaccatggcatggatgcatcataatgtcagagaagtaatcactaaaggatcaattttgacggacaaatatcgaactgaacaaaaacatgtactcctatgtatcaacctgagaagaaagtacggaattcaacttgattttgagcttctctttctcgagttgtacacgcctccttgccactttaccttgcagctctgatatcctagcccatgcacccatgaattccacctatatacacataggttaggagtaaaataaaacataacgacataatataccatttgatgaattgatgtttaatttccaaaggcggcctaaagcacatacatacgtacatttaagcatatgcaggtataccatgtatctcaatttgggaaaaaaaattaaccactgcaaattttgttaacacattaagaaaaaacactattaggctcgttttcatttcgtcgaatacttgagaatttcactgttcactgagctgcaggtgttcgacgctgagagtttgggctgaaatccaacaaactaggtatgtcaccaaactgaacaaattttagttattatataggctcacaaattataagtgtgggtacttataatattgatgtgaacggtgcattcttgatatatatatacctcgaaaatagacagcttgttcttgctgacggcttctgccttggcatttgcgaagcgccactgcaacagccggcagtgcatcatcttcatctgatggccgatctccctattaccacctccaccgctccgccgcgacgccggcgaggacagtgttgccgttgcttgcgctccggtggccgtttccgccgccgccgccttcctccggctaaagagatggccccatccaaggcctattaggctcttcgtcttgcccttgagctccggcaccgtcgccagcgtcgtcttcagcggcgagccgctccgtcgccccggcgacagcgcccactgcgtgttgctggacccgagcaggcgggtggagttggttcgcgctatcaacggcgagggcggcggcttgggcagcttcgtcgtcgtcctcggtgtggagccgccgccgcccctggaggcgtcgctgcactccgacccggagctggcgacgtcggcgccggcgtcgagcctgcggaggtcggacggcgcgacgcggcccggggtgagtgtgacgccggctggcctcgtggacgggaggagccgcatggagcggccgatcgcgctcgcgtggccgcccgacctggcgacgacgaccttcctcgcctcggcgtccgcgtcggcgaagcgcgggagctcggtgcagctccgctgccgcgagagcgcagcaggcggcgcgtccagagagtcttcggcgaggtggtcggcgagcgtggtggccacagacgaggaggaggagggggttgacgcggctggcgcaggggacgagggcgacggcgacgccttcctagtgctcgtgttgccactgttagaggaggaggaggaaggccatatcgtgcgggcgatggatggcgccggatcggggcgcgacacggcgggggagcggcgggcgctcgggcggacgggggagagcgcggcggcggggagaggcgaccggccggcggacgacaggtccgtaacggaggccgacgcccaccgcctcgacgacgacgacgacgacatgcctgcgttgcttgatctctagctagcttgttcgtagcttattaacaaacacgcacgacgtctctgtaacggaggcatgcgtgcgcgcacaaatacgtacttgttggtgtgtgtgcgtgcgttgcgccggcggcggccggcggtggcagctgcacgcacgtagcgatcgagagcgaagccagccggcagggcaaaggtttttgggcgtgcaggacagcgtccgatgcgcgcgagacaaatggaagagcaaggggactacctatacaataaaaatgatctcgtgataagttgttgatgcgagtttatttgttgcatggtcagttactggtttttaaagtataaattaatgtggcttaatcgtggattctaatccctcgaggggatatctcccctcgtatacctgtttcttccaaattcgatgtaaatagttgtgaaaaattctaaaaaaaattgataatgtagagtataatgatacctacttgtccaccaaaattcatattcaaattcgatctacacatcgagaaacaaaaaagacaaatttagatataaacagtacgctactatttatacgctgaatttgtcttttttatatctcgacgtgtgagttgagtttggagttaagattttgtggagttgtatatatgtgttgtatgaatgttgtcaaatttttccagaatttttcataaccgtttagatgttttttgagcaaacgagggaacatcccctcgagggattagaatagtttccgcttaatcctagcccctgaaatatatatggaatggcacatatttggccaacttcacccggtagagttatacccaactctaggggatctggatcccatccacacccgctctacatccgcttaaaaaaatgatgttggatatggtatgaccaatgtccgtccgaatccgctccattttcacccctacgtagccacttttctcatcggtttcagagctagtggattagacaaaaatactatccatcttaccccttttatgtttatttccatggtggttattgttagtagaatcaatcacgatcttatatcatttctccttcaatgagtcatttataattatttctactggtggtagagtactttttaattaaactaatagtttagataatttttgcaggtaatcatgcatcggtagatcgatagcactgcaaaagtactatatatatacttgatgcctaactcgcagtgagctggctgatgtttatcgggtaaaccaacggcggggatccatcaaacgcaaccttggtgagtctcttggccgtgatctccgtcggatggacgatgtcccagaacatgtagcttgttcggttggcgcagtacgagcttgccggagtgcactggaacatggcgttgttgtcccctaggccgcagcatgctgctttcacctcagtataacctaaaaaaaataaaagaaaaaacaccaaaatggcattggattaattcataggagatgtatttttaatatgaaatataaaatattaattatagagtaaattacaccaaattacatatttaaaaccttgtatcacaataaaatggaccgtagatttagtgacaaatttatcagaaaattacaaattatagaccaaatatcacaaactacatctttactattaaagttactacaaaactacggattccaatctttaaatccttaccactaccgttatatatgttggagttataagttgtagttttgttattgaattggtacatgtagttctatggtaaatctactatttaatctttatttttatgacacttcatcataaatttatagttattttataagaaattttgtatgaaatctttaattttgtgatgcaacaataccttaaattttatagctttattattatttgattaaagcatcggaagctttgtgaaaatattcattcttaattatattttcatgtgagcactcatacgtactaaatatgttcagatattccggtatatacactgattgctctttagtctatgtactgcgttctatgattaaatgggcacatatagttccatgaaaaatctgctatttaatatttattttttgacacttcatcttaaatttataattttatgagaaatttcgcattaaatctatatttttttatataacaatatcttagatttatagttttatgataatttgattaaagtatccatagttctatgaaattcactcttaattagtatagactgattgctctatcctttctccgtcacataaaaatcaaatctaagatcggacgtgacacatcctaatactatgaatctggacagatatatctctactatattcgtagtattagaatgtgtcatatgtagtacttcctccgtattttagtgtatgacgctgttgactttttgaccaacgtttgattatccgttttatttacaaaaattatgtaattatcattcattttattttgactttgtttatcatcaaatattccttaagcatgaaataaatatttttatatttgcacaaaaattttgaataagatgaatagtcaaacattagtaaaaaaagtcaacggtattatatactccctccgtattttaatgtatgacgccgttgactttttgactaacgtttgaccactagtcttattcaaaatttttgtgcaaatgtaaaaatacttatatcannnnnnnnnnnnnnnnnnnnnnnnnnnnnnnnnnnnnnnnnnnnnnnnnnnnngcncaatcgactgcaatcaaggacc

SEQ ID NO: 21729 - DNA, 35103 bp, Oryza sativa
  unsure (1)..(35103): unsure at all n locations
cgcgccttggttgccnactagannnnnnnnnnnnnnnnnnnnnnnnnnnnnnnnnnnnnnnnntatcatgcttaaaaaaaatttgatgataaatcaagtcgcaataaaataaattataattacataatttttttaataagacgaaaggtcaaacgtttgtcaaaaagttaacggcgtcatacattaaaatacggagggaatattaaaatacggaggaatcattaggttggttttttataggacggatggagtagtctacactgtaaagtagtactagtaccatatgcctctggctgccggatgtactgcagcaacgcggtgtacgtgtcgaagaaggcgtagctcatgcccgggtgcatcgcgctcatgtcgcggaggagcatggtgacggcgttgttgtaccgagctgataggtaattggcctccgcgtggcattccttggtggggctctgctcccgcagcatcaggcaacaccccagtggcgccgcgcccacaaataaaagccttcgcgtcccgaggtcatacatcctctgaaatttatggcacatcacatatttaaaggtcagtatcaaaaacttatttaaaggttgaactgacccaaaaacttactaaaaataaactatttgatcagccatgagagctataatgtctgagcaccgagatcttatgcgatacgatgccatcggacttttggtactgagtgaatggtatatttttagaattagtttttagcacggtttcttattcaaacaagttctctaaaatggttagtttgtcaaaatttctggtttgttcgatatacattcagctggacggattgtatatttgtcatttgtgtgtacatgcatacctgcagctggcgtttcagggagttggccagtgagctgatgaattggtcttgggtgcccacgagctggctcagcaggacgcgattgattatatcgttgccgccgatggcgacgctgaagagcgattcggcaaggtgggtcgaggcctgacgcgggccgagctgctccaccagtgttgcatgaacagtggagtagtgctgatctatctgctcgtcgaagctgatgcactgaccctgcatgcatggcgcaaaagtatacaaaattaattactacttgcgcgtaatcatggaccagagtactacgtattcgaaagacattaatctcgatcgtacagtttcaagttctagctaatattaccatgtttgtgagattagacacccctgatcctcctgaagaaaagttgacacccctcaggtataccgaggtgttgcttatagagaggtatggaggagggctggccaccccgagactgtcagctgcaattaatggaacaacaagagaagtatttgccgtgaaaaaaatattttcccttaaggccatcttcggttaatcccaaagagaaagagatcagcggaaatttattacatatttattgtggtgtgaaattattccccctcaaacccctccaatccccttcaaccctctccaacccgaacgagccttaagacaatggtcacatgtatatacatagccaatacaatagcctctaattttaattcccaagagtgcgcagtgtacgcgttgatgaaatactcaccaaggtagtcgacgaagttgtagccgttgctgaacctgccggtgggcttgccccccgggtagtcgacgccgttgtgagggtagttggccttgtacatcggcagcgtcgctggcaggtagttgttgttcccgacgtccgcctgcgagtcgccaagtacgtacaccgccggggcagcgccgcgtgcgcgcgtcgggcagcaagccaaagccacaaggaggagggcgacgacacagacgcctgcacaggccgatgtcgacggtgtgcaccggcgccagaaacccattgttccttcacagcgtacagtgtgacgtgtgtattaaagcctcctagctactctctccgtcctaaaatataacaacttttagcccttagaatttatcttaaaatataactacttctccacaaatatttctcttcctaaccaatcacaactattcaccattcatttttcccacctgtctccactacccatccaatcacgacccttcaccacttatttctaccctacttttttaataatcgtgtccaactctaaaacctcttatattctgagacggagtgagtagtgtatataggctgtgtttagttggatccaaagtttggattttggttaaaattgaagataatgtgactgaaaagttgtgtatatatgacaggttgatgtgatggaaaaggactgaagtttggatgcaaactttagatctaaacacaaccataggatcggaggacgccaaagctagctacatttatagcctattgttgtgcacacaaagacggcagcggctgtccaaagctatgccaactttaggattggacgagagggactagtcaaccctagtcaccgtacagtactactctctctgtttcgaaatatttgacgccgttgacttttgaaaacatgtttgaccgttcgtcttattcaaaaaatttaagtaattattaattcttttcctatcatttgattcattgttaaatatatttttatgtaggcatataattttacatctttcacaaaagtttttgaataagacgaacggtcaaacatgtgctaaaaagtcaacagtgtcaaacatttcgaaacggagggagtatatatataattgagtaaatttcatgaaacaaaatatattttgagaaattccgtacagatttaacaccaaattacatattgaacatgttattggttggggctctagccccagctctctggttggcaggaatctaatcccatatatctgttgcgtagtgagttcatagtgccagcaaaatttgcacagcaaccagcatacggccaagcagtgatggctagttggctggagacgttcagggtgaaagaaatgatgtgcatgaaaaaacattaggctgtttattactagctggatcatttgtgaattgtgatcattaattatattgtagattatttttactcttgtgttctagctagtagctgttgcagtgtgcagctcatggcctttatacatggaaaagactataggtactaactttttcttactaaattctaacactgaagtgtcatgctacgagttcatctagatttttcataacttccatctacctaaatcaaacggttgagatgattattagtaaagatttagtaagaaaaaactagtatgtgtagcagtgctcttatacctattaatttcaatctttttcagttcacttcagtctttaatcctctttttttccctatccgcgtaggattttgaaaaagtatattataattattatgtattatgactttaatataaagccccaataatattttcatcacgttgtacattcgccactgcacattctgatggtacattgaactacgtttgtacctgaagaaggtgcaagtgcacatcatattatgtctgcacgactgcactagactatttgccgaactaatgtggaaatacctgcgccagcagtagctgtgaatctgtgatatgatcctttctttttattatcacgtttttgaaaataaataaataaaataaaataaggtcaatagcttaggacacttcgtcagtgcccggtttttaagggccactgactttccgactatgatgatcgttggtgccgattgcactgattttctagcactgagtggtttcaattattaatacgaactagaaatgcacggacaccttgtttaattttgctttaatttttattgtgaatgcttatgttagaataatattgttgaaatattccctgacttcattttaaacatgttttgcttaataactgatttggacattggttatgatttttttctaattaccttgaaacgtataaactctatactaaaagtaaaattacttgaaaccatataaccttaaattgatgagaaaaattgtgtcggttcatatctatttgtattatgtatgattattttttggaacatttagcacaggggcggacccagggggtgtgcggggtatgcaccggcacacccaaaaaaacgaaaaacttatagtatatagcatgtattagtttggggcaaaagttgatgagtatgaacgcatgagccagcccatcatagatgcctgtgtgatgtgttgtgcgctttgcatcgtgcaagttccccgcttcacctcgcattcgcgtatccacttggcatcgtgtgaaaggtagctagggtcagggcatcaggcgttgttccacattcagcgagcggcggcggtgacaccgaagagcacgacagtcaacaggccagagcaccgatattggctggacggcgagtgtggagcgtcgacggtggagacgagagccgcagccactagcatttagagacatggcgaagcaatgtcgatgcgagcccggtgagtctgtgagcaacgcaaggaatgcagctagcagcaaccacattgaccaaggcaagcaagcaggtccagcttcgcatcatctatctaaaacttcagatacagatatactctttgggacttttagtctctcactatttttagtttctttgtctccctgaattttcttttaaaggagagctagagattggttgaaaaattgaaaattctgaaatcagttaatacgaagaggaacaagggcattgtcttcttttagcaaggcatcagaaaattcagattatgctttgtctaggccatgtacagggctctacattttggtgtataaaatgctcggtttgcctatatttttgtgtatatgctctagaccaatgtgtagggcttgtatttgtgggcacacccagggtataaatcctgggtccgccactgatttagcatatcggtttccaaaattttactaacattttttcttgtgtgctataaatgactttatggatttacgaggaagcaccggcaccatcgtctttgctgaccgtgctgtggcctccacagattcaccctcctgaagttcgagatggtgttgctccattcttcgctcctccagatttttttttgtcttcctcacatatctttaattttgacatggaattttgctggtggagcagaggatatgccatacatctctgtttgtttgcatgcattcatatatggtagatagacatctaccagtaaaaaatcatttgtcggtaattaaaaacttttcctgactactggatcattggcaaacactggtggtagactaagtgtcgacaaattgtttgacgctaagagcaggtacaatagcaggctataagccagctgcaaatatattttaaggagataaatgagaagagagaaaagcagtgggctacagatttgtagccagctgtagcacactccaagacgcagtgtgtgtatgacaggtgggtctatgtattaatagtgtagtatataactattgtatgaatgagctattagattagctatagatgaattggagctagtagttggctatattattaaacttgctctaatggccatttataccgacagtctaagtgcttccatatgtaggtcatggtgtagcgtgctctcgtgttccattatcttctcgcgaatgctaggcgacacataccatcccccatcccctgcatgggacgctccaatccctcagacatgaatcgctggagccgatgaggatggacacacttctccaggagatgatgagattgtgtacggtggactgtgaaggtagtcccgccactcccgataggcccgcatccaagtgactgtatggggcgagagttgactagagatcatggagatcgaagctcctcaccacacgacctcaccaactacaagcggttcacgaagcatgcgatggaggcagatatgctcctcacgggcactgatgagctcttcgccatcactgacgtcctcttcatctcacagtcactcctcccctcgggccactgaagatctgctcaccatcctcaagctatacgcccatgtatggtacgaatcaattttttcttggtaccaataagacaatgagcattgggcgatatcagtggatatcaatatctagtaccgacgagtatcggctgatacccagggattaaaattttggttcgaaattttcgaaatttcagaaccctcccccctccccccggcatgccaatatctcggctgaaatttttggtttttctccaatttttgtgaatttagtcaaattcagttaaattgtgtcaaaatttcagtaaatttcagtccaaaattaccaaaattcccagaatttcggttctaccaaaagggccgaaatcaaaattgaaaattgtgccgatacctatggggtatcatatgatacctagcaagtatcatgcatgactctggtaggtatcacctgatatatagctactagctagtatacctagcaagtatcatgcatgactctggtaggtatcacctgatatatagctactagttagtataccgggtctggatcccctggagttgagtataactctaccgagtggagttggccaaatctgtactatccattgtttcctacggctgagatcattcatcatcaatttcacctaataaattaactccttaaattaatggttaaggcttccgaggaaacttagttttttcatgtgtttgctctataatagcgatttgattaagttctcacccccaaaaaaaaaagtaacagaacaacgttttgttattccccaaacaacagatatagtcgatcaactctaaagcaactcgcagtgtataccaacatagtgctttcacatatatgcaaacagtgaaccatatcaatattaatgtgtatgatttttttagataattgatgaagcatgaaatttttgttctaattatacaataaaaatgatctcgtgataagttgttgatgcgagtttatttgttgcatggtcagttactggtttttaaagtataaattaatgtggcttaatcccagcccctgaagtatatggaatggcacatatttggccaactccacccggtagagttatacccaactctaggggatctggactagtgtggatgtggatgcagatgtggatcggattatttcggacggcggatttggtacagagtcagtgcaaactcggttcggaaatgaaataaaattgtcggatgttatgtttgtattcatggtgttgttgaaggcatgtttctttaacgatttctagcctagcgagagccctattcattacatacaacaagaaggcagcaatacaataagcagcaatgcgatagtaaaataacatctgaacatgatctctcaaggaaaaaccagccaaaacacatccataatagtataattttgcttaagtgcttaagtgcagcttgcataatatataacatcaagtgcttgaataatccaaaacccttccaggcattgcttgaaaatataagtccatccatggctccagcctccatgccaatgccataacatcaggtgtaaagtcccaagtcctaacaaattaacacatccaagatcaagataacagtatggtaacaataattccatgcagaagtacaacaattactcttgcaatttactaagttgcaaatatgaactagatctatacaacacacatcaacatgcaaggatccagacttcacttctcactcttcatcattactgtcggagggtgaactcctggagcgggggactaaggggcccccctttcagttcggcggggggcagcgggtgagaatcaaggtttggtgcaaggagtgatgtggagggggtcgggcccctcaagaacgatgagataaaatgggtttatacaggttcgggccactgagaagcataacaccctactcctgtgtgtgcttgatttctatgaggaacaccgtgtactagttggttcaatcagagagtgatcgatccccctctcactaggtctagacctccttttataattcaaggggttaccacaggggcccaaaagatctacctagggaagaaggaagacatcctttacatttattacacatcttatttctctgacagaggaaatcatgccttcgacgctccagcatggccctatcaaatcaccgcgggtgacacgggggacgtgtgcgtcattccccattaaccatctgaagactttgggtacccgttcccactaaggaatggataccctaatttaaattggagtaggaaatcatccccggcttgcacacggggcaagggatttctcatcatggtgatgtgactagacggcaccggccacacgccacctgacagcgggccagtgcacaggcggtcagcgcgcaggcacactcaccctgccacgccggtcaatcgagtgtcactcagcctgtcagccacgcctgcacgccgcatttaataatgcggcgttatgcggctgcagcaccagccttaaatgctgttagttgggcgttgagcgcgcccacctaactcacgcatgctgggggggtgcgtggagggggtcgggatggcctgacccctaactgggagggggcagccgctgctcaaccccgggcccgaccaccctcaggggagtgccacatgagtttgggggcggcctcctccctctagacacaatacccccaggcctatatcaccgacaatcactactctgttgcttttctgtaattatgagcaatcaatatacatttttttgacaataggactacaaaatgtatgaaataaaatgttcctactaatgcaagattaagttggtcagtgtcataccatatcatcaatctcgtcaagcgtcaaattagcaaccaaggtctctgcaacctcatccaaccctcttattaggatctgaaaaattagaaacaaagctatattagactattagcaaataaccaagaatgccctttacaacaatataaatgagaaatgacacaagtgatcacctcttctacatcgagcaactcaatccttggtacaaactaatgcttataccattttcgagttcaagtttagtacgaaatagatcaataacacgtccccctgcactaaaagctgattctaaagcaacaatgaaagcttgaatggacaagcacgtgaacaggatatacatctttgtgagctttccaccatgataagacatcaaatttatctccattaggaaccaacagtgatggctaagccatttatttatccaagtcacttgcatcacttccactatccacatgtgaggcatagacataattcataaaatcataatctgcttcttctatagtatggctttcttttgattcaacattgacactagttgttggtgcaatagtagtcttataaaaagaagcatattcttgataaaattgcttaacaacactagtaaacttttgcataggtgcatgatatgattgcttaccatacacctcagcatgttatactctactgcctttgtcttaaacctaggttcaagaaagtatgccacaacaagagtaagatttgacctcttccagtacttctcaaccttcttattcattgaggtggccattgttttgatggcaacatcatcacttgtcatccatggagtaattaaagccttgatttcacgaaagttgtggtaaaataaatttgcagttggataagaagtacctgaaaaaaaaatcttagtgatatcatcaaacctcttcaagcacatgcaaagtgtttagttgccttataccaatcttcagcttttggaacaagaccctcataaatttctcttttagtttcataaagcctctcgaaagactttctataatatatggcatctgacaactgacaacatatagtacgttgaattccaccatgtcaaaacatcatttgagactcccctcgctatatccaatccactctcagatgcacattttataaattcctccttctgtataggagaacacttcacaagaatcacgaatgatcgaatactaaaaacagcttgtccaatatgtgccaaaccatctctagcaacaagattaagtatatgacatatatctcatatgaaagaatgcctcatcacacatgaggggactttttctattcagcaccttaataacatccttaacacaaacatcatttgctgcttaattgtccaaagtaagagaaaacatttttttatcgatgaaccacttatgcaagcatggagaaaatacatcagctaaatttagcccaatatgcctccctttacatgcatgaacctgataatccttttttgaacacaccaattgtcataaacccaatgaacagtgatacacatgtaccccttgttttggttagaggtccatatgtctattattgcactaaagtgagcattaacatttttaaaaagctcatacaaccttttccattcttctgaaaatataccaagtatatccttcctaactgtgatacgactcttcaaaggaaaagtaggccaaagagattttatgaagtcaacaaaatactcattctcaacaatattgaaaggatactcatgcatgataattgccaaataaaatttttgtaaagagatctcttgatcatacctgtatgtttcaaccgatgttgtaccggaacccttatccattttgagttactgctatcctggaaccacattgtgggtttttgtgtggttcaagaacacataagtaccatttcctgctattgcgcctagctaaataggcacaatatttgaacttggcccactctttttaaccatctagccatttatcttaaccaccttataaacaatattgtagtgttcccaagctggcgaggatctcttctttgctttttttgctatatgttcatcattagtttcatggtctcaatccccatctgcaccattgttatccacatgaacaacaacaatagtgttggttgccactgcccacagttgatgacctttctaccccttcagttggagctagtgatgaggcaaccatgctagtttcagcagctgctgttgctttagtacctctttttctaggtgccatttttagggtcctaatgaatgatgaacaattaaacaaattataagttgctattgacataatttcttaaagcaaagctcatcactaaatttctaaatcccaaatttcaaattagactacaagaacacaatacctgatttggagccatggagagtattgttggtatttcttagcgacactactagaaatataattcccagcaatagcactagaaataatcctggtatattatggttacatatgtgatccgcaagtgcacggatataccattgtagcatttcacccgggagtattccaaggtgtcgtatttatttgatcccaatgaaagatatgataagagagaactttactaacaattcatatattacttatatacatgaaagtttatgcagaggttaattcagttcaaagggtagggtgacacacagaagaaaaaactaagatactctcactaaaatatagtctaaaataaatggagaaagaataagaaaagtatcattcctgtacttctagtatacatacatctttagtctatacttgctattatacagtcatgcaaccaataccccgtacctagtgtcctcctggtgtttcaagagactacccctggttgctgagttccttacgacaacctgtcctggccatccaaccggggctaaatacggaggagtaccctccccaggaaattgcacttagaataatatacacatgcagaggacacccatactgagccgtcaccatcagcggccagcctctgaaccactgtatattaccccaattaatggtatctaataaactaagcaccgtgcttatattactaaatactactctacatccttgcaaccgacatagagcaaccgaatactcagacactaaacccacaccaatacacctatctggaaagctagttgcatggctatattgattcaagtatgaagtaaagtcggcactcaagtaatatgaatggaataaaataccgaaaatgtataaagaagaatattctattaattcaatatgtcttacaaaagaagagaggaaagctactggagccataccagcaatctcctgaagactcgaggactatgaagactattctattttctactccactagcactagaactactaaactaaacttgagagagctctagatctttttcttgaggtgtgtgagggaatgaatgagaggaggggtatttataggtggagaggtgctctgggagtgtggagatgctccaagcatcctatgagcatctttgctctcctcatgacaagtggcatactcaagcatccaaatagcatatttcatctcctcttgctatgtgtccatgacgatttcttcagatagaattagctccaaccgtcataggatgccggtagtaaccgcctggccgaagatgggttggattgggccaactggggggtcggccgaaccctggctggctcccctggcccacagccttcttcaggatgctgacatgtgggccccactttatggtacaccatgttttagctcagaataatttctcattttatatgttgtagctcaaaaccatgtgagtccatcggcgcaaaatatattcacattcttcacgttcattctctcccaactttggtggttaatcacctctcgacggcttccgattgattgttcgtttgttttccatcgattctcctccattcatgcgtgcttctcctgcatacatgttagtagcatagcacatagtggaagtagatattttatttgggaattatgcattgcaaacatagctagtcttcatatattgggtaataatgacggtcgaaactggtcgatagcgaccgtcaacaagtatcacctattgctgttggaggcgatgcgccaatgccggatcgatgatctgtttaggaggccgtcggcttgttgttgtcatgggaacatggaggaggcggtggggagcaccgaggctgattgcgtgggcttctgttttttttataactgttaaaatcttttatgatgtctattttttatccatatataaagttttcatagatgtttacacatacatagcagtcacacataatgtagttcttggtcattcaaacttacggtaaagaatttcacgcctttgcacatataaactttcagcaataaaactatagctgagatctttgataattaccaaactaattactctacaaattttgatatctcttttttttcttaatgactcatgagcatttaattttctcatgagttattgtgatatcaaattggacatcagcaaatatgaacatgtggtacatatccatttttcaggtgacctccgatccatgattccctagcttgtttgtagcctatagaacggtgtagttgaggctcatatatgcaaaaagttattgaaattaattatgccatataagggtacaaaatcaaccgaaatatttatgccatgattaaaaagtatgatttttccaaaatattgctcaatagcataattattttgatgctatactaaatagcttctaaagtcgattatatagtaacaaagaatatattttagaacacctatgtaaaagattactccctctgctataataactttattttgcccccacaccgtttgttttcaaataagtttatttttgagtaatcattgcattagagtttgtgaaattaaaggataaatatattgggagtagataaaaagagagaaataattgcattgggatttgatatagtaagggtattttagtcttttatgttttgtatcggtatacgtaggatgggtgaaaatggacttatttcggacatagcgactattaggcttgcttggattactcgagcaaatttcaaaaaaaatatagagtaattggattctttccttgagcacgtgttgtcctatcaaatattatttaaccggttttttatgccgcgacttggactattcatacttgaattaattctatatccaattagttataaatgtttgaaaaacaatgtatgatggggcaacctgtattattgaactgtttcatacttttatgttaattcgcatgacatatgaaagggtagggatgttgtctctcgataaaatattatttaatatttgaatttgtaatttttgtttggatattgtagatttaatttagatatgtatgtttatggaatgatatatgatgactcaatatatgctgtcaaatttttatagtattttattgctagattaggaatgagatttgtagcttgaaaatttttgctgttttagtatataaaattattgatttttctcgattaatttagtagctaaattaaaggaggaggagagagcatgagctagagaggagagctacagagcagtgtgcaccgcaaacgcatgcgagtgggagggggcagcgagtggttttttacttttaaagttctctacatatagttctaatggttaaaacaaatgggtccatcgatctaagtgagagtgcggtaagttttttttccatttttgttctcagaatttttagatcaattttctaatttattagatgcatcttgtggtaggttaggagcacagttaagaatgtttaatggacttttattacataatatattgatatacacgatgtttaatttaatgaatatttattatttgctagctagaaattaaggaggccaaagtgagcaatgagagaggatttttggtagatggtattttgtttttttctattaaaatagatctaatggtgtaaaataatgggcctattaagtgaaaatcgagggtaagatgttttgctttttttagaatttcttggatttctctaatttattagagcgctaagtgatgttttagaagcgtttgtagaaattttaatgaacttttattatataatagatagataactttatcttttacctgtgatccctcttactaaaatcacatgtgacaggaaaaaaggagaaaatatgtagtggaaactgcaacctatatgaaaacttgcaaactcaatcgtggaccattggatccaaaatgtgcagcctgatgaagccttgccagcccaaccgtccccacgttacattttatgaaatgccccccgcaccatgctgtgtacaatttcatatacatcctttaaatttcctcttttctcacgttgctacatctccacttcaacaccaaatggtctagatccaaaccagatccatggaggaggggggaggctgcacggcgcgtggagattgatagagcgacgacgagctcgggccagtcgaatagttgagtgaggagacacaacggtggaggcagaggcggctcatgagcttgaatctggtcttcctcttccccatcgatcctgcggtgagcctctctgaagacctccaaatccctttcctccttagcagtcaaggctggagctgctgctgttctcttaattgccaagagaaatgctccgagaactgagttgttgtggctgctgcattgtactctcgatgattttgtatctttagttccttagagcatcaccaacaatatctgtatatggttatcctgaaatttggagattttcgttcaaaaacccagtccaacagaatccctagccaagcgcccaatagttcaaaaaccgaatttttcgttctccacaagtagggagaggcgctcgctcccaatctccctctctcgtgccgtcgtgcgaattcccacgcgcacgtgaagtgttctcgacagggggttcatcacgaggttgttcgccgtcgcatcgaggtgtcctacaggtgcccacatctcacgcgcgcgccgctgcctagagctttctcggcgtcgatagttcctgctctggcggcggcagcggcaccatctccactacagccaggcgaacttccatcggcccgagttggtttctcctcaaatcgggattggtctctcgatgatggagatgagcgaaggtatctgctagtgcttgctagttttggcgctgctaatctgctactacgaattctacagttggtactgaataatgttgttggtgccggtggtggtgttgaaagttgatgttggtgttgctgatgatgtgctgttgttgatgctactgacctgctgctagttgtgatctgctgcttgttgcttgccatgctattgctaattgccatgctgttgccgatctgaatttttttttgaacgacgtttgctgatctgagttgacgctactgatctgctattgttgaaaatggtacgatgttgttggttctggttggtaattagggactttgctgatgctgctacttgtagtggttctgcttgattgtttgcaggatcagatttgctgacgtgctactgcgtggagaggggtgacagggaggtgaccaccaagtggttcccgcgatcaatggtcacacgggcgagcgtgataatctcacaggagggagagcctgaaacagatttcagttggtagttttgtagagggaccactttttagatttagggagtcaattttagccaatctcttggagggctcaatattttaacaccttaaattttatttaagattcccataaacaaaattttgggatactcttggtgatgctcttactgagttattctagtacagtactgaattttaacacctatcattattctgaatttttttatgctacttgtagagaagtaaagagcaatactttctagtatatctgttagtgggttttattatgacccacacaacgggtaatgtactaatgagaatgatttgaactgaggaaattaaatttatattaatatttggtgctatccctaaatttatattaatatttggtgctatcccaatctgcagtccattggaaaagcttgagaggagagcaacatgcaacagacaataatcctgtgggtctggggttcagcacttcaaaactgacgaccattgtgagaatacataggaggtgctaactaagatgattgaaggtgacaatctagaggaggtgctgcaggaattggaggagatgaagaacttcatcaagacaatgcatagcacttatcatgctattaggatttaaaaagaaaattcatataagagttagtttgtaatcaatttgtctatatactgaaatgacaatattacacaatgtgtaaaatgcctctgcttcttccaacttgacttgcactgcttttgcatctcaatgacagcccgcgcacgagcagaactcgacggcaatccacgacaatgcacggcagtgagagttatcgttcttcccttccttaattcaaaaatgagcacaagaacaaggttttgctgaatttcaagtggacaatggacactgcagagcagactgaagtgaatataatctaccttatgcacatgacaacaggaaatcgtgcctagggtggaaaatggcatctccctcaccacatacacagaccacatatatggacgagggtgaacagatatataccttcatgaaaaaaaattgacatctgaacattcagggaacttaattctgaagaaactcaacatgaatatattgttatagagacacgaaaaactttcatgaccatggtgtgcaaatgcagcacaccggtttgtgggaacacaggtgcagaaaattactagttcaagtagaaaaatacagcacacagaaaatttatccagttcaagtatatttaggattttcctagaaaatcataggtccagattgtggccacaaacaattggcagagtcaacctagtccatcaatgtataccgacatggtctgatattcagatgtcttctgctgacacaatttagatcccacagagttttggcaggtaataacattcataagttacaacacttgtgcacaaatattagttatccccttcaaggtgttgtctaatcaaaatgcaaccttgctattaaatggctaaaatctattaatagatcacacacgtgtgcactggatgatggcagtggctctactttgaacaaaaaactactctcagcaaaagaattctcgccagctgctctcagcaaaaaaaaacctgcacccagcaaactgcatagtgaaaaaaattgttaagaaggacatatatacttgtgagcatagataaaaaattgttaaggacatatatactggtgagcatagatacatacaaagttttattcacactacggaccaaactaagataacaaaatgttcctggaacacaatggttgttctaatatttttttcctgtcttcccatatgtactcttaaccatttcaagctgaatattagctgtccaaaatgtccttgtcgcaatatacatttgtatatgagccgaacttgtcgcaatatatttaaatattttccatatgtaattcttaaccattccaaactgaaaatgcaatccaaaatgattgtgcttcctacacatcccgctgtatattacatgcccacttgcccacctcgaatccttcccatatttttttatactttgttccaagttgataacactaggtcccaaatcatacagtcaaaaacttaaagagctataaataagaacccatgcaaaaatgcaagggaccacatcagctaacaggacaattgtacatttgcgatttatattattaattagactcacgacgacaatactaaaaatgttattacctcacaatggtcccaactaattatatttcaacatgtgttcactacctactgttagttaaatattatatggccacctattatcttttacatgaattgctactttgttccaaggaaatctacagtatgtccattagaaccagaatgttcttggcacactatagactttacgatacaccgttagttgaattttggatgacaacacacaatcttttacagagaaacgctaacttcttccaggaaattgtatgacaactattataagatgactgatagttaaggaagcatgatgtatagaaccttgcatcactgttgtggttctttgttaggacagttgcgcgaatcgtgcagcacgacttgtttgcacttcttgcacctttgtggtactctctcttttttctttatcttcttgttttgctttttctccttgtcattgtgccctttaattctctttatccgacccctggaacgagtgtcatttggcgggtggatttcaatttgacttggaatgctacatccaagatatgattcaaattcctcaatttggctaagctctttttcaggaaccatctcatttaatttatcaccaagcacaactagttcatccctcaaaagttgcatagctgctgctgattgcttagcttgtaggataagcttctccatttggttgcatgcttctgaaagcattttttgcatcacaggatcattactgttgcttgtgttttcttccaacaagataccatctgcatcgaacacatgtgtcttcttgcagtccttcctaaacctttctaataaatagtatctcggcagttcacttagctgggcacttcttaggactggaattagatgacgacatggtataccatgagtttcaaatagcatacatgtgcacgttgcaaccattgtctgtctatcataacgcacaactcttggcttcctggattcttcaatgatatcaatgattttgacctagccctcttgttgcacattgtcaataaggcaacggtccctggcagctagcacctctttctgaattatgctaaatacctcatgtgtgaagaactcacttgcatgcttctctatcacccattctgtcttcaaattgcggattgtgtggagcgtaatgttatcttcttctagttccttatgtctttgttcttctagtgcagcatcaaacctgagccaaaactccaccaaagcaagcttccgcccaattagacgagaaaagaatgaattggcactctctgaccttgaggtggtccttaacaatcctgacaaaggtatgtcactaaaataagctggcacccatgaacgccgttgatcgaactttgtactgaaccccagaccccagacccacatctcaccatcattctaatgcaatatgcaagataatggagaacataaagcacgacggcaggccggcagcagcaacatcaattctacgcacgatcctcccatcgatgaataacacaacagtaacagctgcagacgccgccggttgctccacatcagtgggtagctcatcataaccttacagaacagcagtaatggagggacaccattactaccttttgttggccaatcgatgaggggccaggcccaagtggagggaaggacaagaagaacaacaagaagaggaagctgtagctgtctctacaagaacaccgacggaatactaactctagttcatctgcagttgtcagtgttggtggcatcaaaaccctagttcatctcagcccccaaattgttcaaaccaagcacattccacggaagaacatacacgaactatagcagggatcaagaagagagaatgaccttaattcagtggatgctggaggagcaatcggcgaatcgaggccgccgttcgcagatgcctcgacgtcaccggagcagcatgggggttgattcgtgttgccgtgaatcacgtggaaaggtggcgctgctgccgaccaccgccggtgccccaccccaccccaccgccgtgccgccgccgcaccacccctcccccaaccccaccgtcgtgccgcagcagagagttgagtttggggatggatttggggatggatcccttctgaatcggagaagatgtgctgtgggacaatttgggggctgagatgctaaagtttggaattaggcggggtgttttttgaacatttcattctgtggtgacgtggacatatctggaacctacgttttgcatccaagtgtggtttctatgtttgcactagagatagtgtttccattacatatcttctcggaaaaaagctcacctctcctccctctcgcctcatatcaccgccgtgccctccagctggtgccgccgctgttgaccatgcaccctcgatctttcatgtatgcacaataatattttttaaaacaattgaaacatgcaaacaccctataagtaatacccaaacttcaatgatactctataaaaccactcaaatatttgaaataattttagaagcatacttagacaattgtcaataattttaggtcagtttttagaacgtatgatatgatgtgaagacatggaaaacaaacatgaatttaaacggttgaatggaaatagtatatatggataatattgtttacacacaaatttggcacctatggacgaaataggggaaaattaccaaagtttagaaagtgacgggttttcttcacagggccggtcagaccacaggtgtgtgggcggtctgaccggctagtagggccggtctgaccgcaggtatgtgggcggtcagaccggcagggtccgtgtccgagtctgttttcgtcgggtctcgggttttattgctcgggaaggcatgtttcgtgttttctttggtttctatcccgagttgggcatggagaagggcctgtagagggcaagaccaacccctatttaagggacaaggccggttcattataaaacccccgaatacaatctacttgaatcgttcttttaccatgtttttctattttaccctagtttagtccatctttgtcggtttgcgccgtaaaccgtccgccgccgctgcgggagtgcgacacttctttataggtttgtcttgaaaaccttccgttttgcccacgagacgggtagttatcctcttatcgatctaaatcggcctagaggctgattttgatatccaaatcggctccgttagccggtttacctgtttttctacgaaatccatcttgatttggccctttggctagatcgaggtggttggcgactccatatcaccgcaaggcgtttaggtgttacgatcgtgcttgttgacttgtcacagaaagttgccaacacgatttttggcgattccactggggaacgatctaatcggccatatcacggccgaatttcgtttaatctaataattactgtttcgtcgaatcatcgaattagtttcggctaaacagccggaattaacctacactgtaattattattgtcgccgacattggttttgtcttcaagcttaagcttaattgttctgtttgatcacggctagacgttaaaccctgttcacacagggagcagcagccggattagcaacattgtttcctttttgttccacacggcaacagaaagatttgattgaccaaagcttactgtacacgggttagaaaagatcaggctattcaagccgatctattactgttcacattaaaaaaaaagagacaaaaaccgattcaatttgtatcggttacactgtgaaactttagattagtttccaaattttgctaagtctactcggttgattaccaaataaatcaaatacttttgccgagtacagtagcatacaaggaaaatttatgaccgtatattaatttattcggtcaaatattttggctatgagctatatggccgaaattaatcaaggattttcttcatcaactatgacaagcgggaacgggttcaacaatactactacacaatacattaggaccgatcaaggcgtcatgagagaaaactttcaccaaaggtaacctccgattcgcccaacccatactttgctattcaaaaggttaatgatcgttgtgtagattcatatgctacttctagttttgctcctatacaatatgcttataatgatatggggggggggtcaatgggtgtttatacagccgattacataggaatcggctatatgcaaagtcgaactgacggtatgaccagtcgtgacaccggtctaaccgcaccctatgtcggtcagaccatgtccaacatggccggtcagaccatgtactatgccggtcagaccgtgcccaccatagccggtcagaccgtaccctatcctggctagatcaggcctcctatggctagcctgaccgcaccactgacctccggtcagaccgggccatgggccggtcagacgggctatctatagtcggtcagaccggttccctaggaatttctccaggttttcataccacgactagcagtactgattttaattattattcatcacctgttaatactgttagtcatgctactccacatgtccctaatacttacaatgatcctaatggaggatattctcacgatactaggtatggccaatataacaatattgtgccacaacaaccgctctttaggccaccaaatccaccaaggcctgaaatcatggaggtaaggaatcgtgctagggagaaccaaaagccgtattctgatttttatgacgttgtcccatatcctcctaattataaaattcctgaatttaccaaatttagtggtgagtatagtaggactacatacgagcatgtagatcaattcttagcgcaatgtggtagggctagtagtatgaatacatgtaagttgcgcttgttttctttatctttgtccggtactgctttgatatggcttacttctttaccggcaaattctattgatacttgggctcaattagaacaaaaatttcatgattattttcacactaatgaaactgatcttaagttgtctgatttaacatcggttaggcataaatacaatgaatttgttgctgattatattgaaaggttaagagatgttaaaaaccgatgtttcaattagaaaataactgacaaagatttggccaacattgcatatgatggattgcttgattcttttaaagagaaattgaatggctagatatttcttgatgttgatcatgtgttgcatgaagctctggctcaggaaagccgagtggatgacaatagtttaaatgccaccttagatgatagtgcaatatcatgtatagccgaaccaagcgatggttcggatcgtggtaataatttgtgcaatgatgccgtaacgagtatagccgaaccaaatgttgattcagattgtcttactagtttggatgataacgcaataaccaatatagccgaaccaagtgttggttcggattgtgttactagtttagacaataatggaatagtcgaatcaagtaatggttcggattgtattgctagcttacagaataatgccattgaagatatagccgaactaaatgatggttcggattgtatcacatgcgaaagtgaaatagcattgtcacctaagaccgagtcacaaatcggtcatgtggatgttggaaaagatgataacaatgtcttgcgggatagtagtgaaatagaatccaaagttgccatacatacatatcaaaggccgtatcctgaacatgtagattcagttccatacccgcaaagatttgaagtgtccaacttcacgaaattcacaggtgaggatgctataacaacaatagagcatatcggccaatttattgaacaatgtggtaaggctggtagtgatgatttgcttaagttgaagttgtttcccctttccttgtcaaactttgcatctacatggtatagtttacttgctcctagttcaatttctacatggtcatgaatggagcatgagtttcatgattatttcaaagatgcaagcttgatggagcaaagaccgattgatacttcatcggtcacttgtgaaactatttcggttacatctattcctaagaccggaattgttagtgatcctcttcctgttagttctattgatgttgacaaaaagaaagggaaaagtgttatttggggatcctcggcccaagaataggatcaaaaatacgaaggccgaagatcataaagttgcaaaggatgagtcatctatgtcacgtcctgataaattcatcccgaaataaaaatcattcgctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcaccagaaataattattaagcaaaaaaaacaattatcaaagtttattaaaaagaaaaacctaaaaataatcctccttcctcctttgggccaagtctggcccaaagtcctccctctctctcttggcccagcccaaagtctccctctcctccctctctttcccctctctctcccgggcctctcctccccctcccggcccactccctcctcctccctctctcccccgggccgcctctccctcctctcttcctgggccggccgcccggcccaagccgccccctgcccgagccgcccctccttcccgcgtgcacgcgcgtcgcacgcgcgctgacgccgcgcgcccgcgtggggcccacgcgccaggtcgtcgtcctcctcccgcccggcatcctctctctcttctctctcccgtgaaacctagcgtcgtttcctcccctaaatccacgcgattcaagccggctctttccaaattaattggggggttttaatccccattgaatcctcttcaattgcccccaatttcccccttgaatcgtgcccccaatcgccgggaacgcccgcgccaactccggccaacttccatggccgccggccgccttttccaccgccgttccgacctcccccatggccggctccctctcctctcctataaaatggaaccccctcgccccgttctctcgttttagccccctcccgcgctctcccgtggcctccccacctctccccgccgtcctcctctctctcccgtgccgccggccgcctccagccgcctctcccgcctcgcccgcgcgccgtccggccgtgccgtcgccttcctcggctctgcaacaccgtccccttcaccggtctcaccgtctcctcgccggaaactcgccggaacggtgcccccgccggcaaccagtggcattggtgccactgtactccctccagccggctactgtccctcgtcggtgcggcagccgtcgtcgtcgccacctccctcggctccgcgacgctgccctcatccccggcatcacctcctcctcgcccgaagcttgccggagtggcctcctcgtcggcgtccagtatctccccgcctccggccggctcctgtacgtcgccggtacaccgatcgacgtcgccgcgttgtcctctcctccagctgctcctttgtttcgccggaacgccgtcgcccgtgctggcctctccatcctcatcgtcgccgacgtcccttcggccgcccgttcatcctcgccggctcgtcgtctcgcggcgccgcctccgtcgtcggcatcgcagcggcgtgttccgcgccgtcctcgtcttcgtgcagctgccgccggctgccctcgtcgccttctcgccggttccggtcgtcgtcctctcgtcgttcccggtcgtcatggcgttcgtccctccgtcaagccattctcgtccgtctcgtccgcgtccgtcaagtgtgccgctgcagccccgtcgtcgtcttcgtcctcgcctccgcgtcgtcaagccttgtgccggccgcgtctcgccttcgtccaaggatcgccgccgaagtcgttccctcgccgtccgtctccgcctcgcccgttcgtcgttgtcgttcccacgcctcgtcgcgtggtggtaaggatccctctccctcgctgccccgtcctcgtcctttaggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaatggcgcagccttcctgtcttttccaggctagcgcttacatatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggtttgcggtcgttgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtgggcactctattcatggttccactagtatgaatttaggtagatgcttcgctgattaattaggcaacattaggtggtttcataactctagactttgggaatattcatatcacttggacattatggaatggttagattattgtggaattggatgcatacctccccctctattcaaaaccctcaaaatggttttaggctgggctcggggtgcatggttttgttagtagcacctcggccacctaaggaccggtcttcgggcctctgttgcaaagcactaccgtacttccacatgtctagtgggtaaggcttagtttgtggctcagtctggttataaacaaaagtacacggatggagatggatgaagccgggggtcgatggacatctctaggacaaatgaaggctacacgggctgcggcccggtagtcgagatgtcatggcacagggctggtgtcctgctgctaggggctcaattctgcctgcctgtctgggggttccggccgtaggtaggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtataacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgcctttataaaatggctttgggcaactaagtgacttttaaatgctgtttactgcaaaacttaaccccgatattattatccccttgtacccccttgcattaattatgcatctccggtgtgacttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaatctagttcccaaaagaccaaaaagccgaagctcacttttgagatgcttatcgctaagttcaagaaaggattagccggtcagcgatttgataatcaaattagtgattcaaaaagaccaagatcatctcgtaggaagagatttggtcaaacatcaaagcaatcggagccatcaactataccaactccatacaaacctccggttgtgatgccatggtatccatattcaatgtcactatatggttatccttttatgtattatatgctatggatgcctcaaccacctatgccgtattatcaaggatggaaggaatcacctaggacagtgtcaaatcattcatctaacccaagacaagaccgtttcccacaaaagaatcggtccggtggatcaaaggtgaaaaaagtgtaaaaggtgtgggtgaggaaagaagccaaaactccggaggtcgttgctatcaaagaggagtctcaagatgttcatgtacctactggagatgcggtggaaaccacgcaagcaaaggagatcgaagccgacgccgtgactgtcaaaattggtggtctaaccgagacagctggccggtctaatcgccagtctacggccggcctgaccgaccttactggccggtctgaccgacggcttatggccggtctgaccgggcctagaggccggtctgaccgaggggcattagagaagagtgggaaaattgaaagcaatacatgagcttccacttcgacaaaaaatatcaagaatcattgcttagctcctggaaaacaaccacagccgaagtggataccttatggcttatctcgctctcaaaagaggaggctacagcgtcttcgggccataggtcaaaaagaaaaggaggccgaagatgcggagaacaagacatgcaataatttagagcctcaaacagcacctaggcaagtatggagacctaaagaagtaaaagttaagagaccggtgatttcccatagtagtagtgataaatccaatttgatgagagaagaatcatcggtcattagagataagtctccttcacatgatgctatggatgttggtgcggtgttcgtcttgccttcaaaatcgtgcagtcgagaaagccgattttgcttggggggcaagacattactatgctcgtgaagaaaccaagagaagatgaacagcgatggatacaacatcacatctttgagccgcattttgttggatgctaaggcaaggtatgggtttattgtgttcatcatcatattatttacctatgtcatgttagaacattgcttactatctagcacatgtgtttgcttatcaaattgatattatacatacatgttgcaaataccagttctaagtagtgaaattggtaggttggcatataatttgtttgaagtatgatttggcttatgagtctttgatatttatttaaagtcaaattgtatgtgtttttatggatcaccatataagatatagattttataattattgtaccatggaagttttgcttattagtaattcggctaatgtcaatggtcaatgtgatgatttattctagagttgttttctttagaaacattggcattgttaatattttgcatacatgctcaagccgattacttacatttgtagtttattggaattcatgtctgtgaggcatatgactttggtgattcattattgaattggctaagtgttttgatgccatgatgattattgtttcaaaagccatttgaattagtattcaactagacatgttagttggatgttatattttttcatatgtctagagagaaggaatttcggtccaataatttgatacaccaagcatctggctattatgtgaagaaaaattatatactaaaggccgatgcttgatttcaaaagtttggacgaaattggcaaagtcatagacagaggtggtctgaccggcattgcacggccggtctgaccggctctgcatggccagtctgaccgggtagacagtgaggtctgaccggcattgcgtgtctggtctgaccgatcctgggcagagagctggggggcacgttacaattgatttaaagaccggattaattgtgaattcggacatttgtgcccataagtaagaaatagattggagaatcactttgaatagaatatttcaatgatcctagtcttgggattgatcggaagattcggcggcaagcgctcaaatattatatcgccgaaaaataaatgtagtattacttggataatgatcaatctaaagttgctaggagagtagtacatgaagggatttgtgaaattcatcaatcggcccgtaagataaattggttgcttaggagagtggggtttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagtcctatggccggtaattggattatcaccctgagacaacatattctatgcgtttaggttcacatatgatcaccaaaaaggcggggggcacgtgtttacacccaaatttggcacctatggacgaaataggggaaaattgccaaagtttggaaagtgacgggtttccttcacagggacggtcagaacacaggtgtgtgggcggtctgaccggctagtagggccggtctgacctcaagtatgtgggcggtcagaccggcagggtccgagtcagagtctattgtcgtcgggtctcgggtttcattgctcgagaaggcatgtttcgtgtttcctttggtttctatcccgagttgggcgtggagaagggcctgtagagggcaagaccaacccttatttaagggacaaggccggttcactgtaaaacccccgaatacaatatacttgaatcgttcttttaccatgtttttctattttaccctagtttagtccatctttgtcggtttgcgccgtaaatcgtccgccgtcgctacgagagtgcgacacttctttgtaggtttgtcccgttttgcccacgagacgggtagttatcctcttatcgatctaaatcggcctagaggctgattttgatctctaaatcggctccgttagccggtttagctgtttttctacgaaatccatcttgatttggccctttggctagatcgaggtggttggcgactccatatcaccgcaaggcgtttaggtgttgcgatcatgcttgtcgacttggcacaaaaagttgccaacaaatatacctataactggcctcactttttttagaacaactggcctcacttagtgtatttgtcatggttatggataccacatacctaatagtagtcaactaaatctcggcaggacccaccacataccacgtcttatacggaaactgacttcggatatggagggagttccggataaggaaagacaaccagagttctacatggaaacgacaaggactactcggattgtatccatattgcttttcctagttctacttggacaagggaacacctatgggtataaatacaaggccccctaggaggagaggggacacggacaatcgacgaccacctcaatcaacacctaccacaatctacggaacaatagatctagacacaagatcaacatacaagccaacatacgccaagacaagacgccggatatcgactttagggataagcacggctagtcccctacggtgtctccggatactgtcaggagagacggaagtgctatctctgatctcgccgggcacggattcgaggaggaagactaccctgttgtcgactacgagtcagaactttagacagccatgtcgacaacagttagataggctaccccaaatattgtactggtgtgattatggtaaataaagagcaacgaccggcttcggccaacagggtgtagggttattacctgacaattcaggggcccgaacctgtataaaaatctctatctctatctcttttacctcagtcttgcgtatatcctagtaccaacgatccccatactatgcaaataccagaactgcgacatcaaacatcgacagtggcgcgccaagtaggaggattttggtgcttcaggattttgaagagatgggttcaagagatgaattctccaacaataaactactcgacgacttcactgtggggaagatcaaatccgaccggagtatgtcttccgacgagatcgaaattatcgccgtcgtggaggacgaacgatactggcagcattggtgaccgatccaatatgggactgttctggaagctgacggatgtcctcgcaggcacagacgtgttggtttgattcagactaaggtctacacggcgctgtactccttggattcatacgaaggccgacttcctctatgcgcgatatcgatttctaccgagacaaatgcatccatgtatgtcggttggatttcatatgcgcctgatccaaatatctgtatcgtgtacgtatacggcctgtattggtcctacatgcacacggacaccagatacatgccacgctggaaaagtcaaagcgactctatacacagtcgtgtactcagagacgaatcgaaactttacccaagtacacaggaacatatcagcgcgctaatcaaggtaattagtggattgattttttaaattaatctactaatttcgtaaatacatttggcatgtatctacaaaggtacgcaataatttatatccaatttatcatacctactttttccaatctatacgatattgtcagatctataatttattatgtttacctacagcatgtcttttatacaatatctgctgtgcgagtgtttccgatgttaaatcgactgcggtttaacgctgggggctcgctctattttcttatgtataaatcatgcttacttacggtttacataatgattgatatttaatctgctcgttatatcctgataatactagaagacccatgcagttttttaagtacatactcgatattctctgctatatgtcttgccttctagaaaatatttttcaggaacaattgagcactcgagtaggttgtggtcgagtacatcccactatcgagagcattctcgataaatgcggagttgtcgcgcccaacctaccaacgaagaccgacgacctacctcatagcaccggccatggctggactactcgagaaaaggttgttaacggataattcctcgcgaacgtcgtcggcttgatcacctgacatgattgcgaacggacatccagatatgttataagttgggtatgtgagtcatgctggccacatgagatacacatgtaataaaacaactctagcacttccattggtgttcgagagataattctactcgctcgctggttctcgaaccagtacacagcaatctctcgcaccgcaacttacattggtgttcgagatataattctactcgctccctggttctcgaatcattacgtagcaatctctcgcaccgaaacttccattggtgttcgagagataattctactcgctcactggttctccaaccagtatgtagcaatctctcgcaccgcaaactttcattggtgttcgagagataattctactcactcgctggctctcgaaccagtacatagcaatctctcgcaccacaattttcattggtgttcgagagataattctacttgctccctggttctcgaaccaatacgtagcaatctctcgcaccgaaacttccattggtgttcgagagataattctactcactcactggttctcgaaccagtacgtagcaatctctcgcaccgcaaacttccattggtgttcgagagataattctactcgctcgctggctctcgaaccagtacgtagcaatctctcgcaccgcaatttccattggtgttcgagagataattctacttgctcactagttctcgaaccagtacgtagcaatctctcgcaccgaaacttccattggtgttcgagagataattctactcgctcactagttctcgaaccagtacgtagcaatctctagcaccgaaacttccattggtgttcgagagataattctactcgctcactggctctcgaaccagtacgtagcaatctctcgcaccggaaactttcattggggttcgagagataattctactcgn

SEQ ID NO: 21730 - DNA, 860 bp, Oryza sativa
  unsure (1)..(860): unsure at all n locations
gatgattgatgctgttnnnnnnnnnnnnnnnnnnnnnnnnnnnnnnnnnnnnnnnnnnnnnnnnnnnnnnnnnnnnnncggaaactgacttcggatataaagggagttccggataaggaaagacaaccagtgttatacatggaaactacaaggactgctcggattatatacatattgcttttcctagttctacttggacaagggaacacctatgggaataaatacaaggccccctaggaggagaggggacacggacaatcgacgaccacctcaatcaacacccaccacaatctacggaataatagatcaagacacaagatcaacatacaagccaacatacgccaagacaagacgccggatatcgacttcagggataagcacgactagtcccctacggtgtctctggatactgtcaggagagacggaagcgctatctctgatctcgccgggcacggattcgagaaggaagactaccctgttgtcgactacgagtcagaacttcagaccgccatgtcgacaacagttagataggctaccccaaatattgtactggtgtgattatggtgaataaagagcaacgaccggtttcggccaacaggatgttgggttattacctgataattcagggacccgaacctatataaaaatctctatctccgtctcgtttacctcagtctcgcatatatcctactaacaacgatcctcatactatgtaaataccagaaccgcgacatcaaacgtcgacagtattattgctagctttctctctgtttttttttgataagctatattatctcaaaagtttctagccttctatcttgtacatagttgatctaagaaataggttacatcgaagtcta

SEQ ID NO: 21731 - DNA, 794 bp, Oryza sativa
  unsure (1)..(794): unsure at all n locations
cagcgnattgannaattgannnnnnnnnnnnnnnnnnnnnnnnnnnnnnnnnnnnnnnnnnnnnnnnnnnnnnnnnnnnnnnnnnnnnnnnnntgctatgcaaaaattgcaacataggatcgatgctgcaattttttaatagtgatgtgaagcatataggacccaacaatacaactagatgttgcgtgtacaagctgcaaagtaagttatagatgagttggacataattggagctaaattaccttattattgatcatgctctaagaattatagatcttgcgaaagtagtacatacatgcaggcactgacacaagagatcatttataatgatcataccgtatgctcagggcgttcacagtgtgccagaagaatttggcctggctcacgtgccatgggctaaaaccacaccttaaaaaaaattgtctcccacaatgcatgggtctctatgtgtgggttcgattttttgatttagcccctcatattttctattttagccctttctatttctctattaacaagatggcacctctcccttccctctccatcaccggttcttctcccctccctccctgttgacgacacctnntccttcccttcccatcgccgacacctgtggcgatgagtagatcggggtgaccgncgaccagatcggggtagtggcgtaatgcaccggctacgaggtccccacggtggcttgggcctacgccgctgctgagcttcgcccctcggaatccgggcgcggctcgtgccgacgaggcctgcaaggctatgtgctctccttcattttttgcttt

SEQ ID NO: 21732 - DNA, 752 bp, Oryza sativa
gctcggtacccagagcaggtacattagtcaggcgacactaagtccacgtagatagcaatggtgatatagggaaaagagctaaagagagagaacatgcatgagctggcgcgagcggacgacaattttatcatcgggctgcaacacgcatctctagataaaaacgttggacgtgagagagtgagagaaatgctgctatgcaaaaattgcaacataggatcgatgctgcaattttttaatagtgatgtgaagcatataggacccaacaatacaactagatgttgcgtgtacaagctgcaaagtaagttatagatgagttggacataattggagctaaattaccttattattgatcatgctctaagaattatagatcttgcgaaagtagtacatacatgcaggcactgacacaagagatcatttataatgatcataccgtatgctcagggcgttcacagtgtgccagaagaatttggcctgcctcacgtgccatgggctaaaaccacaccttaaaaaaaattgtctcccacaatgcatgggtctctatgtgtggcttcgtttttttgttttagcccctcatattttctattttagccctttctatttctctattaacaagatggcacctctccctttcctcttcatcaccggttcttctcccctccctcctgatgacgacacctttccctcccctccccatcgccgacacctggggcgatgagtaaatcggggagaccgccgaccagatcggtgtg

SEQ ID NO: 21733 - DNA, 794 bp, Oryza sativa
  unsure (1)..(794): unsure at all n locations
cgagcagttgtttggcnnnnnnnnnnnnnnnnnnnnnnnnnnnnnnnnnnnnnnnnnaaatggtacttatgtgttcttgaaccacacaaaaacccacaatgtggttccaggatagcagtaactcaaaatggataagggttccggtacaacatcggttgaaacatacaggtatgatcaagagatctctttacaaaaattttatttggcaattatcatgcatgagtatcctttcaatattgttgagaatgagtattttgttgacttcataaaatctctttggcctacttttcctttgaagagtcgtatcacagttaggaaggatatacttggtatattttcagaagaatggaaaaggttgtatgagctttttaaaaatgttaatgctcactttagtgcaataatagacatatggacctctaaccaaaacaaggggtacatgtgtatcactgttcattgggtttatgacaattggtgtgttcaaaaaaggattatcaggttcatgcatgtaaagggaggcatattgggctaaatttagctgatgtattttctccatgcttgcataagtggttcatcgataaaaaaatgttttctcttactttggacaattaagcagcaaatgatgtttgtgttaaggatgttattaaggggctgaatagaaaaagtcccctcatgtgtgatgaggcattctttcatatgagatatatgtcatatacttaaatcttgtgctagagatggtttggcacatattggacaagctgtttttagtattcgatcattcgngattcttgtgaagg

SEQ ID NO: 21734 - DNA, 797 bp, Oryza sativa
  unsure (1)..(797): unsure at all n locations
cgagcacttgtttggtcgacnnnnnnnnnnnnnnnnnnnnnnnnnnnnnnnnnnnnagtatagtaggtttgctatacttttaaaatggaaggagtacatacgtaccatgtgcctctgggtaacgaatggactggagcaccgcggtgtatgtgtcgaagaaggagtaggtgaagtccggatgcgtctcgctcatgtcgcggaggagcacgaccgccgcatcgtttaaccgagttgccatgtagttggcctgagcatcacattccttggtggggttcagctcccgtatcaacgggcaacatcccagcggtgctatccccacgaagaacaaccgtcgcatcccaaggtcgtacaaggtctaaaatcatgatagatttgcactccttattcatattacatgtcgttttgatttcttttatcaaacttatttaagtctaaactaattttataaaaaaaatatagtagcatttccaatatggaaaacccaaaacaaatttacaaaatatattgaattctatattacataaactaatttggcattttaggtattgtaaattttttctataaagtaccaaagtagcccgcatatatacgggggcatcttatttaatgtgcgtgaagttttattatgaatgttcatgttagagtgactgttaatttaaatattcttttactatatcctaaactaaaattaaacttatttgatgtgttttgaacgttggttatgatttttttttcttattattaccattgcagcatataaattctatactaaaaatattngaaaccgtgccattttn

SEQ ID NO: 21735 - DNA, 775 bp, Oryza sativa
  unsure (1)..(775): unsure at all n locations
cgttataactcctcnnnnnnnnnnnnnnnnnnnnnnnnnnnnnnnnnataatattttagtttgaaagcaaatgcgctaattttcataaatactgtttgccagcttacagtacaagtacaggaggatactggttaataagacaactctatggtctgttgagaagtggttaatatcttattaaccagtatccccaggcattagtcccctttatgaaaaagatattaaccacttctcaacagattagatggttacgaacaatgtcatgtaaaatttggggtactaaaatgtcccaaaggaaaaaggaaaaaaaaaaaggacagggcaaggcaatgtcacatatgcaactgatgcctttgaacacatggtacagagtgtgaaaaacactaacctctccaagcaatgaagcggtatgctcaagctcatgttcttgcagagcaattgtacgcagggtacttataaattcctgagagaaaacaattttctcgatatatgatggaaccttgcgttgaccactccagctatcactaggaaaaggacttgtattatttttgttctccttgttttcaccagaacagctaccaaaaaatccatttttaagcaaactacgaggtaaaagacatcgcaatttcgcattctgtaaacacagaagatatggaaagtgagacccgtgatgtccaggatacttggtggggctaaatttttcacacattcttcatatcgtaataaaaactagagctaagaatgttgtacctgtatctcaagagcttcatttaan

SEQ ID NO: 21736 - DNA, 9935 bp, Oryza sativa
  unsure (1)..(9935): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcttattttgcgggattgtaaccattatgtttaatcaataaagcctaaccctttctttaaaaggtaactaaaatattgtgagaccattatgtttaatcaataaaaccactctacacgcactcgcttggcaagcaagactcggttaccgaggtcctttctatggatttgagagatcactttgctctccgcctgtcgtcgattatggctgaacaatttaactaccttcgtgttctcttgactgagcataccacggcaaatgacagacctgatgtgagaaactcgaaatattctagtgacattctgaagacgagccacctctatcttgtccaacgcagtgaactgcctccttgcctcaattggaagtttatctggaacaacaaagcaccgctcaaggtccagttcttcgcctggctccttgctaaagatcggctcccaatgaagaaaaacctttgtaagaagaacattgtgtccacccccgcctgtgatctttgcaactcggctaaagaaacggcttcgtatctgtgcctacactgcccctttgctgctgctttttaggacaaccttaatattcaggtcaacattgcgtcaatgtgtgagctggcttctcttcttctgccacatcaaattcccaacaaacattccagggtgttctacctactttgtttctggtgtctttggaatcatcgtcatggtgtggtcttccggcatgaggaagcttccctgtgtcgggtatgcattatgtgtgtttcggaagcctctctatgggctgagcggttaaaattatatgatcgtcatgtaatctcggcgtggaagtctctattttcttccactattcgctcttttgatgtataattggataaactgaactttcaactccttatatcaatgaattcaggtgggaaagctctccctcccggtaaattttctaaaaaaaagtaactaaaattttaacttcaaatcatattatgatcaaatttagatgtttttttctaaggacatgcacaaatccacaagcgcaaatcctcgtgttatgaaacattaagtatcatcaaattttgtttcttaatggaataaaacactactcaaaagtgtacatagttagaatttcttttagaagtaaaaccatgatactaattaagaacacaaagcaccacatgcatctatcaaccatctccatgcacatatatcaacatttttacgtgcgcctataagaaaaattaaaaataagattatccatttgtttgattataatagtcagttgcttggatttggcaaaaaattgtcaaaaaaaaaataagaacgtgtatcttcatgagctacaggtggttcacattggatcaaggtttggcacccgatgttggctcttcgtcaccgagagttgcaggtgctttcacggattagaatgttattaatgtggtgtatgagatgggttcaaaatatcgtgagacagtttgactcatatctcaagttttagtgttacaatattgagagaaatttatagtagttatcagtgtcttgtaagttgtaaatagccaaacgtggaggataagtgccgaaaatccgtgtaagttgtggatgtgcccggatcaaaacggggcaaattgggatatgtttaataaataatcgttacagtcccggaaggaagctctttgtgggtcccagctgaccaagacgagaacgaactcgtgcctgagttgagactagagaagtagagagtagttgagacggcagacggcgtcgttggaagcatgttacggttcaagccttgtttcatgggccaaggcattactgctattatgggcctcaccctgtttcgcagcagatgggccctaacccgacccaaatctcctacccgttacttctcttttctatttttgtcaaagcaattttgctatatgtgctacagctacttaggccccttttaaacgtgggatagggaaaaaaaaaaaaggagaaatagagaaactgttggaattgaaataacgtgttgcttcaatcctacagaaattgaaaatacagaaaaacagaaaggtatgacctttgattacaccacagtaaaaaaatggaaagtttccaagaggtgtaacctcttacttattttcttacaaatttgaccatagaaatgcaattttgtttaaaaaatatatacctttatatgaataaagagttctataggagaaaatcccaaaggaattgaatcctctagaaaaattatttgccaatcctacaatacaaaaggccccttaatggtatttactatttagtcatgcaacaagttcaacgaggtacaggacacactgacccgtagagcatctccaacagcctctccaagtattctctaagctaaattttagccgttccagtcaaaaaacgtccttcaatagcctctccaacccggctggccaaaaccctccttccactggccaaacttggccaaccaaaaatcactggccaactgtggccccacacacattatcctcccatctccttgccgactattctcctcttgcattgccccagcgccgccgtcgtcgctagccgcgaccatcgccaccatctgcgccgtcaccgagcgacttccgccgccttcacgcgactggtgcggggtgccgaggtcagcgcacctagaggagatgaggagtcggtcggcgaggatggtccacccaccaatggcggctgctttgcccccccccccccccacctcccttttcccgcaatggctccttctcctccttgatctgcctgcccacgccgtcgtcgtcgccctccatgtgcggcaagggagggagggagcggcagcggggcggctcgatgcctttgccaccgcctccgcagcgtcgccgccgctgaccccgctagcacgagcaggggattggagagtggaggaagaagaaagaggaggagaagaatgacaggtggggtacattggttaatagagagtgaaatgtgtagaggctgttggaatagaagataagtttgactctctaaatttttgttaggctggccaaatagttattttgagagtcaaaaatggtcgctctgtgttgaagatgttctaagtgactcatcaatatgcccaacagctcaagttctgtagtagtgagtacggctattttcactttaggcatgatctctccctcttgctcgcctctcaccatctgaattctgatgatcaataagaagagatttgagaaacaaacaaagcaagagaagatcctggtatgttcttcctacagtttcaaggcattatcagtacttactcttgtgtcatcctcaccagtgatgacagttttaactttttcaccacacggtacaactggaatgagattgaagaatctaatctagccatactaaaaggcaggcagcatatataacagtatcatggtcagggcaagtgctgtctgaaacctgaggaggtacccgtcgtacgccaataattctatggcactgtcagatctgtggattcagcatcaaacaagcacatatacagtttcagccattctcgatcttcacctgatgatcagaacgagacacgcacttatgcatcgcattgtctgcagatcgatcgatcagcatcttctggtccccgagaacactttcgatctctacataactaagatacgcacagccgaactcgcacaccggcaaaattcagaagaagaaagaatacagcaaatatcaagcaccagcatctgaaactcgtggtctcagcaattcagcatctttggtcgatgcaaagagagcagctgctcctgtgtctgtagctatgtgagcactgttcagcttgtgctctgtccccctgctccgatccctgcaggctgcagcttgcttgtcactggatcatttggcaattgggcatggccttcttgatcgcgctagctatcatatcgtggtatgtaatgtacagtacatatgcttgatcgatctgtcattggatttgtgatgcttcgcctttgttcatcaatccgagcggccgggaatctttgcttcatactccggattattagatagacatgattagcttgtgcaatcagtaccgggacttgtcactgttgctgtatcattattagtcggtgataatgtaaggcataaatttggtactttggttcagcatggacagatagatgaatcgatggggtaatggatctgtgtgaagaaatcaaactttattttcatcgttttaatgtttgcttggttggttaatttttccatcatgggctgaattaaggtttgaaatccgagagttaaattaaacgtggagacatattaattagccgagaagacgagaattaagaccccaagatctaattgagcatagctacttctcgtttccgttaacatgtttttcaaaccgctaaatggtatgttttgtatgaaatttttttagttaatactaaaaagccaaactaaatttatttttcatgtttctaataattattcccttcgttccaaaatatagggtattttggttgcatagaatacattctaatactatgaattatggacaatgtatttcatccaatcaaaatctcatatattttagggcatataaagtattttttttaattaattatatgctaatctattatattattaaaacagctttgaaaggaggcaccacattcgctgtgggagctagaaattcccacattaatcggagaaaaaggaaaaaaagaaaaggagagtccaagtagaagtacaatttaaaaatagctgaaattcggaattaaaaataagcaatattgaaagaagtttccacataagaacccaatacgagattaatcaaaattcaaaataaaaataaaataaaatccaaaattagaaaaaggaaaggagagtccaagtagaaatacaatttaaaaatagctgaattcggaattaaaaataaggaatattgaaataagtttccatataagaacccaatacgagattaatcaaaattcaaaataaaaataaaatgaaataaaattcaaaattagaaaagaaaacgagagtccaagtaggaatacaattagaaaatagctaaaattcggaattaaaaattaggaataataaaagaagagtccatataagaatctaatacaagattaattgaaattcgaaataaaaataaataaatttgaaattaggaaaataaaataaaataagagttcatgtaggaatacaatttaaaattagctaaaatttggaattaaaaataagcaacattgaaagaagaatccatataagaacccaatacgagattaattaaaatttagaataaaaataaaataatatctaaaattagaaaaattaaaagagagttcaagtaggaataaaattttaaaacaactgaaattgaaaataaaaaataaaaacattaaaaataacacaatacgatattaacttttttttaagaaaatctgaaattagaaaaagaaaaataagatttcaattaggaatacaatttaaaaataactaaaatttgtgataaaaatatagattattaaaagaaaagaccatctaaacacatgacgagataaattaagtaacaagcctataaagaagtagagtggtggcggttgatacgagatataaaattgttaataaaacaccaaattgaatcctaatgacgattaaaaggagggacgtcaggcaggccgtgaagcaaacgagtaaggcggttgccggggcttctagaaagtaaaaaaaacaaatcccattgataatcatattgaatttttaaaatcttaatgacaataaaaagaagaagcagcgggcggggtgtataagagtataattgcatagtcgccgacggttgacgggacttctagaaaataaaaaatgaattccgatgatagttatgttcgattattagaatcacaatgacaataaagagtttggcggcggacaggctgtagaggggcatagtggcatcgtttgatgggacttctaaaaattataaaaaataaaactacaagtccagtttttaaaggtttgaaacttctaaaaagtaaaaaaaaaaccaatgataatcatgtttgattttaaaatctcaatgacaataaaaaaagataggcagcggacgagccgtagaggagtacaatggcaaaaccgctgacggttggcgggacttctagaaagtaaaaatgaacccaaacgataattatgttcgatttttaaaatctcaatgataataaagagaggagacagtggacgggccgcagaggagtatagtggcaacgtttgacgggacatctagaaattataaaaatgaagagatgacataaggggtagcaactggtgtgacttttacaaactatatattagaaacacgaggatgataaggtttggtctttcaaagtcttaagacaatgagatagctatttaataaattttaagtaaaatcataaaaaaatataagattttgtttgggtgctagccgcgcaattgcgtgggccaccacccagctagttaataattatgtttcggagttgctagaaatatggcgtcatatgctacagtcgattttttttcagccacttacacagtagttacacctcatttacaccccacttacatatgtaattagtatgtaattttcgaatttacatatgtaattttattacttacatatgtaattttgagacttacattgtaaatacactaaaattacatatgtaatttaaggacttacaatgtaaatacatgccgactattttttaataaaaaatatgacgccataaatataactacacccttatgtttctcatgttttagcgtgcaggtagctaatcagccaaaccgatcagccgaaaagaaacgcgcgttgccctgcattgccggcggcgtcggtgtaggcgaagaggaagcgtgttcatccatgtgtccgtcgtcgaagttcgccgggagtggtcgctttcaagaacgccgaccatctcctttgttctcacccctcgacggcgaccacgtaaccaacatccccccatttctagactcacctacagcaccagttgccaccttaatttcagttcaaactttactattatcaccttcaaaaacactttatttttaagctatgtatttggccaagtatgactagtttatctatggaattttcaggatttttattctgcctgacgagcttatgattagttagttgaggactgtaaatcgatgatgacgattggctgatgaacaactctgacgagacatacatgataaagatccttctgccgttagactcgttacctgccctttttgtttcttctcttgttgtttttcttagttatttaaacatgaataaatcagtgtttaacaagctggttccacgccatctcgtggagtatgatctctcaccaaattaaagaaaaggaaagattggccatcatcactcgagaaacatgtgactcaaaactctctctctattcagcaccaaccatgcaatgttgctaattggcagatggtaccatgtcattaccttcagaaataaatagcccaactttaaaagaaacaacaaaagaaggaaggaaggatactatcatgtaatttggtgtcattagcttggaggagaggagaggaaggaaggcaacatctctctctagccagcaatgcaattgcaaatgtgacaggcacaagaggagaagctcagctcaaccaccaggcaatgactagtccactactaatacatcactaatacacacatgatgcttcactctctcaatactgacactgcaacggcaaccagctagtaattaattgaatcaatcaatcaatcaatcaacgcttgatctctcatttcatcagacatccaagctgaatcaacaaggaggaaaagaaagaaaattcattcattagagctgattagtttgttgtaataatcgccaaataggccaaagcaactcgcaagttttcttcttctttttacctaaaacaaaacagctcggactctgatggcttgatgcaacacctaaatgtggcacagcaataaagtatttagatgcacaccaacccctgcactattcatttctgaaaggaatcaagcctgacagataggcgccaactaactcaagaacacagacaacaccaacaccaacaacaacaaggagaagaaagaaacaatttttttaatcataacaactaacaggaaataataataaaaagatttaagaattcatcatccacagtccaagtccatggcctctccccttatcaagaacggtatgtattggtatctgtatccatatgggtacaacattttctttgccttttcttcaaacgccaattggagaacaataataaccctttttgacttattcccaatctgaatacacttcaatttctctcttcccccctaatttcctctctctctctctctctctctctctttctcagaatatatgcacacaaaagaatatcaaacatttgatggtgaagaagaagaagaaagaaagaaagaaagaaaaaacaaaattaaaaaaaaattactctcacatgatgaactgaactcatctagaagtggtagtagtaccatgtaatgtggccaaccaaattgctagagcagcagcaaataatccagggcaattcaatcatcatcttcatcatcatctcatcagggacaggacacctcggattttccggacatgggtgcaattcttgccaaccaagcaccaccattgcatctgccgattctgtgatgtgtgtgctcagaatagcatccagtcgagccggttcgccggcggcggcagcggcggcggcgcgccggaggaggccgttgagctgacggtggtcgttgaggaggccgacgacgtcgacggcagcgaggacagcaggtcgaacatctcccaccgcgtctgccccgccgccggctgctgatggtgttggtgagcttgctgctgctgctgcctcgccggcgggtgatggtgttgtttggaggtgagcttctcgccggacttgcgcacgatggcggcgttcttggccatgacggcgtcgagcgtctccacgtacttctgcacgcgcttcacctgcagagtcatgggacgaacaggttgagctcattaaccatggcggtcaagctagtcggtggagattggaggaggcggcgaggtagctcgtcagctcacctgtagccgcctctgcgccttgacgtcgccgtcggcgaccaccgcgtcgagcttgagcagctcgttcatgagcagctcggtcacctgcaccacgtcgttctccgccaccttcttcccctttctcaccgacgcgttcagcgccgccacctgccgaaccaaccaaccaaccaaccaaccaatcggaggtgagcctactacctcggcgtcggcgtcgccatggatggcgggcaatgtgggtgggtgcctaccttgggggcgagcttgtcgacctcggcggtgacggcggcgacggccttggcggccttctcgaggtggccattgcggcgctcctcgatgaggcggcgggcgcgtgcctcggggtcctcgacgaccaccagcttggacctgtccttgacgccggccatgttcaggaacgccttggagtccctctgcttgttcttgacatcaccttctggtcgtccggatgcagccccgatcgcgccggcacatctttttcagcttccctgcaccacccacaacgaaatcagacatggcccccattcatcgagn

SEQ ID NO: 21737 - DNA, 10426 bp, Oryza sativa
  unsure (1)..(10426): unsure at all n locations
gccgcgcaagtagaacacnnnnnnnnnnnnnnnnnnnnnnnnnnnnnnnnnnnnnnnnnnnntggccgcacctcccacacctcctccgccggcaccttcccacccgccgccgccgccgttgctccggcggcggcgccaaccaccgggggaggaggaggattcttcatcgacccgaacttcaccgtcgcgcctttcttggccttagggctcgctcccagcatcctcctctcctcctcttcttctccccagctatcacagagctcgtcggatctttgaagccaagaaagcgaagcacaccaatggcgggaaaggcgagcgagcaaagcacagagcagagcttgtggcgggaagaatgggggtttggagaagctgaaatctcgaagctgaggaggaggaagaagaagacgagatggatggagagcgaggagaggagaggagaggaggaagaagagaagaggagagaagaaaataatggtggtgaggttgatgagggaacaaaccgcaacgccatggacaaggggaatatatacgccaattagattacttgccactggccacatgacattttccattatcaaattccaaagagatttatataaataaatgtttctggaaaactatatttaattaacatgataatatatatattcctgttcgatttagattattggcggactatgcactcagatataaatataaagtaggagtacatgttttgatgaataaacttaataatagtgtttgaaactcataagattaagattaagttgacgcacggttaaacgataaagctattagcacattattagttaaattttaatatttataaacttaacaaatgaatatatttgatattttaaatcaactttcatatttagagttttcgcatacagtttagtagttttaaaagcgtgcttacgaaaatcgaagtaaaatctttatattaatgagaaaataacactagcgataagaaatgcaatagaggagtgtaaattatttataaagaaaatatagtttttaaagtgtacgataaataatatgtttcaataatctggtaaataaactgaaaagatcagggtcagagttgcgttggttcatgacaaaattgatttgattctactgtggaatgtgagagaaaggaagggtggatgctccacattgtgctagatgcttgatcatggcgccatcagaaatgaatacacttcatttatttgtttatttgctgaattttttggtgtttcctccttgtcgtctctactagtattccacatgcctgagaaattattattttcttggcttttaaaaccaggaaatttgcagcaagctagtccaagttttgattcgttttcgtttggttagatggtgattcgtattgtgtcggctgatgctgctgcaaaccttttccttcctgtttgatttgcttgtcgatataacgtcccaaccatcgcctaatagattttttaaatactatatattttagcaccgagtacttgtaatcaaaacaaaaaaaaattaacgatgtaactacccgctttaaaaacagttacaaagtagctagcgtagtagattagcagtgctggtacagttcagcagctgatcatcagtggagaatacgcagcacatgcagatgaaataatcggggagcattattcgcgccaaggtgcgaaaataatttgtttgtgattagttagctagatccaactaccggaaaaaaattgctcttgattaatttgaactgtccaacataacaggatatttttttccaagtttttatttaaaaaacaactaaaaataaacttgcctatatgatcaaaaccttttggcaaggccattgaggttggcattggcatggtcttatttggaacagaggaattttgtggaaatcttgaaggaaatgaattgtttcctatgaaaatcttgtgaaattctaggtcagcaggcagcatgacaatgccaaataataatgttgaaaaatgtaagagtttgtttttttaatttatttagaggtgtttaaaatctagtaatacaatagtagtggtcataggaaggctttgtgtgccaggagggagaggaataataaataaagagatcacatgatcctagaaaaaagaaaaggcacaagttaagggacatgaatcatgcttgtggaattcatcttctatgattcaaaagtgaagtgcaatggttcagatatcagaatttatcacagctagatttgctgttgcaggtttgcaggacagctacagtagtgctggcaatcagcttttcgatgcatgaattgaagtggctcttgaattatggttttagaaacaagctactccctcagttttaaactactcgtcattctagtaagtcaattttttttcttaataaatttgtatggtttaacataataaatttcaagtatatttttagattcagcatgagactttcataacatatatataattcatatgttattagactatacgaacctattaaaaattaatggttaaagatagacgtgtttgacttaaaagaaagctaaaatgttcagtaatttcaaatgtagagagtactatctcttttggttaatagttcaaaaacaaaagaaactataaaactatagttccaaattgagatgcacttcatagtacaatgacaaggggtatgtagttttaaccccaaggtctcgtgttcaattcccgatacactcataattttttcttaaaaaaatatttggagggacgtcactccctctaaatgtcgtttttggtttatagttcaaaaactacagaagagttattgtaacctggtgtacatttgttaccaaccagctgagtaaactgctgctgtctgtatgagattcatacacaaacacagctgacagtatcagccagtatgcagtctctgtctggatgtgagctgatcagcctgacaattactagtttgtattccatttattaagaaaaaaatatcatcattgaatcatacaagtctgatgacaaaagaaagcaaagcatcatgctaatgatccccataattaaccattgattcccaaacagtggagcacggaaagtaaacagttgaatccaatcaggaacacaaggcattcagcgatacgagtcaatctttaatgaatggccgccaccctaacagtgctactttgttgtgccttattagtgtgtttttgtgcactgtcaaaaatataatccaatgaataaaacatacaggatcagttgcattgtgttcttgtaatcacaactgatactgaattgttttttagttttcagaaactgttactgaatttttaaatgacactgctacatgtgcgtggtgctgtgcattagtcgttggagggtgagcttagtttaactgaaactgaagtagtaactactatatgctcatgtgcacagcaatcaagtcagcttgagagattggattagtaaaccaaagccactgaattctcctcaaaatactactacaaaaaagatcaacaagttgctaataacaagagatcaacttttccttttttttctttttgtctaacaactcttcatcaacagtctgaaacacgcaggccggcggcacaaggtgacagacagtctgagctccaccgacagtcaggagtgtcgcgcgtgtggggcccacctggggatgccacgctggcactgtcaacgctctcctctcgcctgcgttgaccgaggaaagagacgctgtaacccacctcctcgtctctgcttcctttcttcctcctctcttctcctccttctcaagttcttcttctccttaatcagctttgctttctgatgaaaaaaagacaggtatctgattcgaaatgcagccaaccacgttttgatttgcacaatgttttttatttccttttctttggcgattgctttctgtggttctcctcttattcctttctttgtccgattcctttccttttcgttttgttgtttttattcgttgcagagattagttaatgtcggtctatgagttcttaactactaaatgtggttttatgtgtgttgtgttcggacgcttgcattgccgtattttacagaaacaaaaacgcacgcctgattattctgtacttaatcttggtttgagatcgcttaattgttctgctctgaattttccattcagatcatttgacacgttttagttagttggtttttcaaatatgcagtagttgttgttttgaattgtcagcaccgtgcatttttatggcacttctatttccatctaggcaatgctatatttaaccaggcaatatggataggatcaagactgagccaattttgattaccagaaatccaggcccggtttagtttccaaaacaaaaaaattcacgctgtcatatcgaatatttggacacatgcatagaatattaaatgtaggcaaaaaaaattacacatattgcgtgtaaattgcgagacgaactttttaagcctattacgccatgatttgacaatgtggtgctacagtaaatatttactaatgacggattaattatgcttagtaaatttgtctcgtagttttctggcggaatctataatttgttttgttattagactatgtttaatactttaaacgtgcgtccgtatatccgatgtgacaatcaatcctaaaaatttttcccagataaaaaaggcctcagaactacacaaggaaaaaatatccaattttgaagcatgtttttcgaaacactttttgaaatatgtaaagcattgctctcttattcttcctcttcccaacaactgttcttcacgaaacctcactattctttttgaacgactcgcacgagacggtgcgaagttctattgatagagcaggaaaaaaattacaagattacaaccctggagggtcgtaaccaggaaaaaggaaaaaatatacaaccacccacacaccgacatcgccaacacataatcccaggagaaggctagcaccggatcgaccgccgttaagcgtgaccgaccgccgctagaccaacaaagagacacagacgagatcgccccctagggatgccagaacgaagcctcactattcatttcatcactgatgaaccttcctattagtcgcaacaaggctcatgatcaaaagctaagcttacgatatcttgtagctataccgacaccgatgctaaatcatgtagatttaaattaagctaaacatatgggaatatatatagaggcgtatgtacattgccagtatgacataaatcataatagcatatggttagggagtcatatcaatcagagaggctaaagacaataatagagccctccaaagctgcttccaagcacacagaaaatacagattagctatatattgagatggatggatggatgaatggatggatggatggatgaatggatgaatggatgacctgagtgatcggaaggtgccgcttccctgtcattggtcatgctgcccatagcctctacttccgtccaaacacggaccaactcgctcactcacttcgtataattttcctttttaaatgtatgattcccccgagaataatatagaaaaatagaaaaaatctcatgaaatctatatggagttcttttgttcggcgagggttttcttttcccttttcttgtaacccgtctaggtttttacttttgtttattgaaatgtaactgactattgttatgcggtcataccggtttcttttcttttcgtttttttgaaaaagaaattattttgttcgagatggagtccatagtttatgagagtttgaatcatgggcctagagaaaatgtttgtgtgaaaaagacagttattgtatttatgttagaaaatacttttcagaaagtgttttaatcgcctttggattgcagggatttgttaaaaggcagaagtttcacatgctgtccatgcctatatttgtggcccatggaatccaaatggcttccaagacagcctgggtgcctgaatacgacacaaaaggttcagagcaaccaaaaatcatttcatatataatactttcttagcacgaactaattaaaattagagagatcttgcgtgatcctgggcaggtttgaattgaccacaagtgtcggtttaaatcattgcgagtgttcgtcctacagtatagccacactgcacgtaaacctgaaacctgaatggcccatacttccatcatcatgcatgatagtactagtttaatactggtttataataccagtactagcagttggtatgcgatcgttggagtgttaaacataagtgatcaaataattaaatcatttggcacagtttgccttgagtattcagttagcaattaatggccaaaaaaataataatagagagagaaggagcaattgccaggtagttcgatcgtctggtggcttgtgccatctctttaatataaaagcagatggatcgatcaggatcggtttagcgaggcattaccatgtgctcgatctgctgctcattagctcgccttgcttaattagtctggttacaacaactgatcatgtggagtggagtcctgtactgcagtcctgcaggctaatttctctcccgagttttgattatatattccggtgggatgtagagcttaatacagtggacattgttgtactcatgtaattttaacaattgtcaagctctacatttcacgacagttgcttctgcaattttcgctttgaaaaaaaaggtgtacaagcaactggcgtgaaatgtggagcttaaggggtgcaatttcttcgtaacattctgatggtcaaagcaagaggcgatgcagtagtgcaggagtttggtagagagcagttcagtgcttgaagcattttcaaaatgtttaggcaattccagacacagctgaatatgagttgctaccacttagaaaacatgtatggatgcagaaaaacggtaaagagagaagggcaagcaatgggtgtacattgtgaagtggggttgtggaaatttgcagtggatctcccagaacaagaagcatgatgatcatggtttgctaccacagaaattgcttttggcaacagagagagagatgcctccggaccaatcatctgattctgactttttcttatgttccagaccacaccatccaaccatcatcaactcttctctgctctgctctctctctctctttttctttttgagggatgacatttggaacgtttaataagaagccaggggttgaacctagttaaaaaaaattgattaaattaaaaacatgtctagctaatttacgtgctacgcaatttatcttccaattacaatacccaatagagacattctctaaaccaaatcctcgactgtgtgttcgctcggcaggtcaggttccgtgtgttgtcgcctcctggctagaccgctctctcttcctcttgtggcagtcggcttcaggattggtggccaacctctagggcctgctttatctgagcatctccgtgccggtttcgactctctgatacttctggtctcttggcactatggaaggaacggaactccagagttttcgattctacgctctcttcggtctcagtggttctagagtatatctgcttggaagatcatctgtggtctttagcgtgcattgctacttttggagatttattgaaaatgtaacgtggctctaccccttcccaccaatcggagtttcatagccgccgtagtagttttttttccttcctagctacaatttttgttttgcttttcttcattcccctagcataagccgatctggctgattgcgttgtgtatcaaaaactatttttcctctaatatattaacgtgcaattattttacgcgttcgtgaaaaaaaatagaccaaatctcaggacatgacattcatcaactctgctctctttcttcaaagagatacggagtatcatgttttgttggtctcctgttaattacgcctactcggtgggcctcaaattgggcggggcatgtaggcctgccacgagggccatacaaagcccaaccccaccaaatccaggcccagtatgacagtgtccaagtcaaaggtgcgcgcccgaggagcccggccaaaattcgaagccgagtcccgaccccgattttggttcggccctggccgccgcgcgcggctttctatataaacggtacctcccgctgcgtgctccggcgtgcaaccgccatggccaacgtgctcttcggttgggagcgccgcgtcctcatcagagcttccgccctccctccgccgaagaccctcctcggccgcctcgaccagctcgacctccgggtgagcgcgagagagcgtcccctcgcgtgtcgatcgatccattcgtcgattgatcagtgatcaccatgtcgttgtttgatctttgtttcagttgcggcagctggaggagcagcggcgggcgaatgccggcgacggcgacggcgggccggcggcgcaccaccagcacagcaagtcgctgccggcggcggcgctgcagcatgtgcaggcgaaaggcagcctgatggaccgcctcaacctgctcgagtcacgcatcaggcagctcagctgcgagctggacgtcgcggcggcggccggcggctcgagcgtgccggcggtggcgcggccggccgaggaccgcgcgtggtcggagccgccgctggcggagccgtgcaaacaccaggcgccggtttgcgccgccgccgcggccggcggcgggagctggagcggcgcgcatttcctgtacaagggcgcgcggcagcttcatcgcaccaaaccgaacacatccacggtgacatgattattacagattaattaatcgcattcattagcaacacacacattaagctcgctagattagtactaataataattgcagaaatgtacaaagaaagaaaagtctggaaactgtgcattatcaatacacattttatcgatctgatataaatctgaatctcttgttcgaaaaatatataaatctgaattaatttgatggatattttttttatctgaagatgaagaatctgaaggaagcgaaatgtgcgtgcgagaaggagaagaggaaggcggaggagcggtggaagccagcaaggaggaggtggttcaatgtcggatgctaataatcaaacaagatatcatgcgtggattaacttatctatccttattctctaagtgcttattactcctattaggagctagctactatataccgtacgtatacacagtactattatgtactctctccgtttcacaatgtaaatcattctaatattccccacattcatagtgatattaatgaatctagacatatatatttatctagattcattaatattaatatgaatatagaaaatgctagaatgacttatattgtgaaacggaggaagtaagcgtttttgttctatacgtattgttttaattcttctgttcgatgttagtgtctgttgtgttattggttgtaacgtgcaagacgtataaaatataaacgggaatttttagctacttcggtgttttgatcgttaatgcacaagaaattaatatctccagtttccctgatcactaatgaccattgattcgagcctgtttgggccaaacaaccgcagaatttgcagcaggtgatcgatcgactccgtcattgcaattcagctgtgtaattattggaggcaaacaagataatagtcagtcacccctactgaacaatagtaacgttactgcaaacataggattttggaccactgcaaacacaaaacataaacacgggttcctaattaatcgaacttattatgcatccatgtgatgtgttcggtgcttgctccatcaaccagtgttgtctgctgtccaagttcatgcattattagaagaagaagaaataactgatgaaatctctgaatacaaccgatccaaatttgcagcgccatttctacctcccatttgcccaattccattcttcaactccaaaattttcaacttcttcattttccgttagcacactattcacactattcaaactattaaatgatgtgttttttaaaattttctaaatagaattttttaaaatacaaataaatctattttttaatttttataattattaatattttattaattatatgctaattagatttcgtgcgcggtacaaatcttgctacctcacctgcgatcgaacaaatccgtcactgttttatacctatcgaccgacccggcgcgcgtatgcgataaattgctagcggtggacctcacgaagccgtccaaccgtaggggctggctgctttaaactaaacttggcgttctcgttggcgcacatgaccttccaaatacttgagatcataagttcgcccaaaagtaaaacatcggtgaaccaactcctaatagtcccctatgtcttcaccacttttaccaagggttttaaaaagtgtgatcttatagactatttgtccccgttgtggaatatcccaatattaattttgtgacattaaacttctttaaccaggtaatcttcttagtcgctctcgatgaagg

SEQ ID NO: 21738 - DNA, 13540 bp, Oryza sativa
  unsure (1)..(13540): unsure at all n locations
attttgaacttattatgccattttatgatatgatcacatcattatatttgttccaattaaatcttttataacaagatatcatataattgcattccgatgaaaaaaaaatatatgtttcaatccattaaatttaatgtttcagacgcagtagcaatatgtttcaatgtgtgtttttgttatgtttcataaaaaaaattaaatgtttcaataactgaatttttttttgtttcactatgtgcaactcaatgtttcaccaatcactgaaaaaatatgagacgctattgcccctagtctctcttatgctattctattagctttctcccccacaccatgcatgatgcaagtatttagtgatcttaaaaaaaaattttcttctaaactacttatccgttgaacgattcgatcacaccgttgaaatcgttataattaaatctttacaacaagatatcgcatgattatattctgatgaaaaaaaacatatgtttcagacaataaaaactcaatgtttcatatgtgatagaaatatgttacaccatgtattcttattgttatgtttcacaaaagttctatatgtttcataggctgacttttttgtttcactatgtataacttaatgttgcaccaacagtcaaccgaaacatttgactgtccgattttttttacaacgtcggacgttcgatttgtagctctctccgtttactccttctctatttaataaaaattggcagcttgtcttttcttaaaaaaacaaaatttaaagaagaaaaataaaccttggattggctatgtcaatatgttatgacctcaccgctcaccactagtccacggcccaacgaaaaacaacgggctaaaccggcgtgtctcctcgaccgccactgcgatgggcttagagtgctgcacgccggcgcccgacggcagaggaaaaattggacgcctcgggcgcccgcgcctcctatcgctccttttaaaacgatttttctctaaaactagttatccaatctacgatccgatcacaccgttgtattcgttgcaattaaatctttataacaagaccacacatgattatatttcgataaaaaatattttagcttttctattgatatttttttgaatattgcatatgatctcttttgatgtttcagctagtagttttacgatgtttcagctagtacttgcgatgtttcactatgtacggatcaaatattgtagtgtattttgacattatggaacgcgccgttacaacaaatcacccacatattttggaaaccccctattaagggaatttggtttatttttatttcacaaaaaatatttcatctagtgtactcacaatatttcactatgtatagatccaatgttgcagtgaactgaaatatttcattgcaacaaaaaacccatatattttggaaaccccctattaagggaattcatttcatttcttattccaccaaaaaatatttcacctagtgtacttataatgtttcattatgtatggatcaaatattgcagtgaactgaaacattctttcgctatttgctgaaacattatttttagggacaattgcttatttgaccccgttttgaagtctaactaccaatttgaccctactttttttagtttgcttatttgaccctgcttttcaaaaatgaatcttccgtctgaccctatttccactacaccgttaagatttgattttaaaaaaagaaaaaaaatatatttaaaattcataatgcccaaaatacccttgaggaaaccatatccatctctagccctatccacatgtctctgagtctccatgtctctctcttctgctagcgatttcgggcgccggtacaagcacgcggcgaagggagggaggggacccggccctagcggcggcggcgtcaacgcgcccagtgggaatggaggcgaaggctgccatgcggcgcgggaaggaagagaagccgggcctggcggcgccgacggtgtctgcatcggcgcgcgggaagggagtcgagaggccggcgccggcgaagggaggggagccgggcctgcgccagaggcggcgctggcggcatctgcatcggcgcgcggggagggaggcggaggcctgcgccggcgaagggaggagaggagccgggcctaccggcggaatgcgcgcggagggaagncggatccgcgccggcgtcagcttgtaaagttagggcggacgacgccgccggcgggtattcgcgcggagggaaggcggatccgcgccggcgtcagcttgtgaatgtaggggccgacggcggcggcggtatgcgcgcggaggggacatgcgccagtgcctgctcgccaaggcccccaccgccgccgatgacgatggcctcgccgccggccccgccgatgtccctggcctcgtcgcccgctgactcgtcggccgcggcgccgagccccgccgacacaagcgccgggatggccccgtgcagcgagctcacgcccgcactcgcgcccgccgtggccgggaagagcatcgtcgtcgccgtctccgcctccgtcagcttcgttgccatcgccggtcgtcagcttcgttgcaagggcaaaatagactatttacccctaacttaacaccgtcaactcaccttaacagaacagggtcagaccgatcgttcgttttcgaaaagcagggtcaaataagcaaactcaaaaaaagagggtcaaattggtagttagccttcaaaacagggtcaaataagcaaatggcccttatttttatataaggtgaaacaacacccgatttaaacgagtgaaacattttcgatctatttagtgaaacaattctgatatacctggtggaacatcgtgcaacatttaaaaataattcaacagtaagctaaaaaaaatcgtcggaatatatccatgtgtggtcttattttgaagatttaattgcaacgaatttaatggtgaaatcgaatcatgatttagataagtaatttaagagaaaaattaatttaaagtagtttttgcacgtaaatcgggcgctgacatcagcgcccgatttttccccaaacgtcggacgtccgagccggagttgcctccacctgcaaattagatttcgtgtgcggtacaaatcttgctcctccacctgcaatcgaacgaagccgtcgcgtgctaagaataggcggccgacgcggcgcgcgtatgcgagaatttgcgagcggtggagcgcgcgaggcgggcccaaccgtaggggcggcctgcttaaactaaacttggcgcgctcattggcccacataacccgcccacctctccgccaccctcttctagactccctggccccacgccccctcctccctctcctccgattggccccaccaaccagagagagagggcgagagggcgccgcgcgcctcctccaataatacactgccacgtcttgcgtgccacgtaggccaccccaccaccatgcgccgccgcgggaggatgatcccgccggcgctgctgctggccgccgcggtggcggcggcgctcgcgacggccgtgtcggggcaggggcggccggtcaccgagagcggcgcgcagacggcgccgacgccgtcgacgttcacgcccaaggacaacttcctcatcgactgcggcagcacgagccccgtcaccaccggcggcaaggtgtacaagacggacgcgcagtcgaacagccttctttccgccaaggacgccatcaaggtcgccaccaccgacgccgacgtgccctcgccgctctacctcaccgcccggatcttccgcgacgaggccgtctacagcttcccgctcaccgtcccgggctggcacttcgtccgcctctacctcttcccgctcaagaactccgactttgacctcaccaccgccaccttcaccgtctccaccgacaccaacgtcctcctccacagcttcaccgccgagaacaagccggtcatgaaggagttcctcgtgaacgccaccgagaaccacctcgccgtcaagttctacccgctcaagggctccgccgcgttcatcaacgccatcgaggtcgtgaacgcccccgacgagctcatcacagacatggccatggggatcgctcccgtcggagagatgaccgggctcgccgaggcggcgtaccaggtggtgtaccggatcaacgtcgacggcccggccatcgcgcccgacaaggatacgctggggcggcagtggaacgtgaacgcgccgtacgtgcagtcgaaggaggcggtgaaggacgtgtcggtgccggtggggaacatcaagttccccgacgggacgtcgaagctggtggcgccggcgcaggtgtacgcgagctgcgcgaagatggcggacgccggcgtggggagcccgagcttcaacatgtcgtggaagatggaggtggacccggcgttcggctacctggtccggctcttcttcgcggacatcgtgagcaagagcatgaacgacctctacttcaacgtgttcgtcaacgggcgcaaggccatctccgggctggacctgtcgacggtgaccggcgagctgtcggcggcgtactacaaggacatcgtcgtcaactcgtcgatcgcgacggacaagctgagcatccaggtggggccgatgggggaggacacggggcgcgtggacgcgctgctcagcggcgtggaggtgctcaagatgagcaactcggtggggagcctcgacggcgagttcggcgtggacgggaagaaggccgacgacggcagcggcagccgcaaggccgtggcggcggtggggttcgcgatgatgttcggcgcgttcgccggcctgggagccatggccgtcaagtggtacaagcggccccaggactgggagcgccggaacagcttctcgtcgtggctgctccccatccacaccggccaatctttcaccaccagcaagggcgggtccagcaagagcggctacaccttctcctccaccctcggcctcggccgcttcttctccttcgccgagatccaggccgcgaccaagaacttcgaggagagcgccatcatcggcgtcggcggcttcggcaacgtctacatcggcgagatcgacgacggcaccaaggtcgccgtgaagcgcgggaacccgcagtcggagcaagggatcaacgagttcaacaccgagatccagatgctgtccaagctccgccaccgccacctcgtctccctcatcggctactgcgacgagaacgccgagatgatcctcgtctacgagtacatgcacaatggccccttccgcgaccacatctacggcaaggacctgccggcgttgacgtggaagcagcggctggagatctgcatcggcgccgcccgcggcctccactacctgcacaccggcacggcgcaggggatcatccaccgcgacgtcaagaccaccaacatcctcctcgacgacaacttcgtcgcaaaggtatccgactttgggctgtccaaggacggccccgggatgaaccagctgcacgtcagcaccgccgtcaagggcagcttcggctacctcgacccggagtacttccggtgccagcagctgacggacaagtccgacgtctactccttcggcgtcgtgctcctcgagacgctgtgcgcgcggccgcccatcgacccgcagctgccgcgcgagcaggtcagcctcgccgagtgggggatgcagtggaagcggaagggcctcatcgagaagatcatggaccccaagctcgccgggacggtgaaccaggagtcgctcaacaagttcgccgaggccgccgagaagtgcctcgccgagttcggcagcgacaggatctccatgggcgacgtgctctggaacctcgagtacgcgctccagctgcaggacgccaacccgcccgagggggccgacaagccagccgaccacgacggcgccggcgcggccccggcgacctcctccggctccggcgtctccaccgtgcccgacgtgtccaccaccgccgccggcgagatgttcgcgcagctcgccgacatgaaggggaggtgatctccgattattgattggactcagcagcatgcatgatgcagtgatcgatcgagattatttcatcatcaatccatcgatcgtcgcggtggaacgtaaactgaaagctatcaaaatcgaattacttgtcgatttcctgcccgatttaagatggccggtcgcagtgtcttggattggcgatggcgagaaaccaaattgaaaattccgtaaatatatacagaacgcaaatgtacctacgtgttcatggtgtgttactgttactcttctctctgctgcgttttgttagctaggagacgtgtcgcttcaaattggattctttttgacttttttttgggtggtcaaggttgattgtacaatatcagaaatcatacatgctactcgacgcggctcgtgttaattgatccgtgtgaatgcatcgttcagggcttgtatatgaagatagttaattagtttcacatgtactgcgtacttactaaattaaagcaaatcatcatgtgagttttcttttaaatgtttgagtaaacttgatcaaacatatttcgggcaactttctcgtttaacgtcagcacgcttactaaacaattaatcgtgttttcctttctaaaaaaatatacataaaaattcttttaaaattagattaatattttttaagtttgtaatagctagtattaatacttaattaatttaatcatgctaatgattttttttaattttgcgtacggttgataattaagctcactccatactctatttcgaaggaagccttagttcatcggggctgctgtcgggaaaaaaaaagatgagttgacattgagttctctttctttgaaaaaaccagtcaaattacaagaaatataatcaagatatcgcggtagatcacgataagaacctcgtatatgcacatgatggaaaattatatagtggccgctgacttgtatcctcgtcatgtattcttccatgcgaaggatgcaaccgctacacgtcacacagactaatcaagtaaccagggatggcttggcttggcttggctggtttagcaacgcggttaacctggaatgcactccatcacaacgctagaaaccatcagctgaagcgattaatatgctggtttggaatatgtacattaacttttaaagctggtcaaaaacaggctaaacaggttcaaaattcatcccagttcgatttgaaaagaattatctgcatagcatagtcatgtactccctatgtcccaaaatatctggacaaagcatttgtcaagattcgttgtcctaagatggcccatcttaagttgagttattttgggacggagggagtacaagataataatataataattttatattattattggtagaaataataatataaaattattggaatgccactccaagcatgattatctgatttctttcaaaaatagtatactaaatattttactagatccgacgtgctagacaagtctactaatatcttatagatataaaagcatataataaccgtttcatgtattttggataggtttctatccagttattccgccgtatatttctcactatccgaagttgtgctctagacaagatatcacttttctgtctatgctgaatcacgtttttaggacaacctacactccataattgtattccatttatcacaaaatacatgttctataaccacaacaaccattgatcatcttcaatcttcatccttttgtatttcccacataaaaaaaatcccttatgcccccattacaatgatttaggctatgtaagctgcaataatcaagctaaaggaaagcctattatgatagtcttccagccttgcatagacaatgcaaaaccagtcaaactcagcacagcctctgctggcccccaccctttgtacagccacaaaaggaagctccccccacccttgtgtgtagccttttgtgtgcatggagcaattccacttcctaggcaaagcagtgagcagtcggtccttgaaaattaaagggcagaaacttcaccgttaatccgaacacgcatagccatacccacacacatgttagatctgacttacaggtgggccatacatcaatggacccaccgttcagtgacgataaagtcagtgttaccaagtcattcctgtcctggaaaagacccctcctatttcttcaagcgaccaacgcagccacccgccctgcataaaccctcacttacatgtgggccccacgaaccgtaggtgtgggccccacgaagagctacccgcgtgctcggccaaaaagatcacccgagccttccaccgcaaagcaccgaggtttccacacccgccaagccacacggtcgctgacaagatggccccaccaccgcgtgtgtacgcgcgcgcgcgcgagcggggtgcgcgtaacgaggagccgacctgcccgtctcccggtttcccccgcccccaccgggagccaatcacgcgcggccgcgtgtacacacccgcctcgcgatgcggctccgcggccgatccgacggcccggaggcctcccgtgggccccacggagaccggtcaatggcggtcaatgtgggcccggcccaccggctgcagccggtcgccaccgtcccgggcgccgcgaatctatttaaccggtttgctcgtcggcgaggacgccgcctacaggcgcaggaagaggaggagaagaagcggaagaggagagaaaaaaaaaattcgcagcaaaaaagaaaaaaaaatcgcagctgcaaggtagaggaggagaagttggggtttgggagggccagcgattgagccgacgaactcaaggtgaaaaaaatggtttggtagtgggggggggggggttgatggctcggaccgcgggaagtgacctaagtatttcttgtttttgctcccctttttggggggcgatttgtggttgggttgtgagaggaggggttgggtgattttttttttgggttgatgggtgccgattcctgcaatgtagcgtggtaattttgggggtgtagaggtggaatttctgttcttggtcgagtgttagcttaatctttgtagctcggtttttcgattggtttttggggggcgagtttgggctagggtttttatccatctgctacggagcaaagattaggggggaatttttctccttgtttcgtctcctgctcctctactttgctagggttggcgatccggctgcgggcacatctccggccttcgttgtcctctctctccatcctccccggacgtggcagtttcccctcccctcctctctcgattcgttgccctggagccttttgttgtgaagttagttcagtattctattttgtctgatgtgaacttgatttctatttcatttctttcgttgtttgatctgacctggaagacattttggtatatgctccattcttgtacttgtatgagaggaacctgggaaaaatatttttttttgtgtggtggaaagaatgctaaagctcggctaatttcaaccaaaagagtaaatttcagctcacaccctgcataaccagcatcaactgttttgcaatttgtgtttcatgctatattttctgtcccttattttcttttcaaagacgatttttttatttatttaccatttgttggattctagtttcattttctggttatgctattgcagtagcgtagtatggttagagaattgaaaaatggccttcttctgttttctgttttttcaaccattgaatcgagaaatttcatgatgctaaaatctcattactacttgcatctgtttggcttcagttactgctgaccatttctcagttctcacgcattaggctgttaacagttcttatccagtaagatatttgatgatttatttcctaataattcatgttcaccttttgcaggttcttcaaagtgatgattgggatcgaaccctggtaacctccatgtctggggcgccatgctccaaccttggacttgttcccagggatatgcatggtagtatccctattagcactacaaattcctctgggccaagcattggtgttagctctttggtgacggatgctaactcatcgctctccggaggtgcccagttgcagccaagtacgagcatgaatgctgattcattcatgcgccttcctgcttccccaatgtcgttttcatccaataacatctctggatcttcagttattgatggtcccattgtgcaacaaagtcctccccaagagcagatgcagaagcgaaggtcttctagtgtaacatcacaacctgttattgatgctgctggtgcattgcatgctcagaagaagtcaagggttgatattaggcaagatgatatcctgcaacacaatttaatccagcaactgctccaaggccagagttctcttcatctgcagggtcaacagaaccctcagattcaagccttgatccatcagcataaactggcacagattcagcagcaacagcagcatcagatgttgcaaccattttcacagatccaacaatctcaagttggcatacctcggcagccacagttgaggcctccactagcgcagcctggaatgcagctagctggacctgttaggactcctgtcgagaatgggctttgttctcgaaggttaaagcaatacttataccataagcgtcaccgaccagaggtgaggttctgcgttgtaaacatttattgcaagacacatgttcttggctataagatttactatttactggagtacctgcttgtagaataatccaataacatactggaggaagcttattgatgaatattttgcaccacgagcaagagaaagatggtgtgtatcctcgtatgagaaaagaggaaatccttcaggtgctgttccacacacagctccggtcagttcacggttcacacttaaatctttatatctgcattgtacattgacgccctttactttcctgtttcaacagaatacttctcagtgtgatgttcacaacaatattgattagcatctcttttaaactttgcttggatattgaacactatattttgacagtcaagtatcttgtgattgtagtgagaaacaaaatccatatgagcgtgttctatagatgaatattttgaaatagttagcattgcattttcattttttaatgatcgttctactgagagctgagatagctgatgctgttgagattttagtaaactgtgaagcataaattcgtagttgcaccttttaaattactattttctccatgtttcaggattcatggcgctgtgacatttgtaatacacatgggggcaaaggatatggttagttgactacttttttggaaccttatccagcttcattatcataacaatgaaccttgcaatttgctctgttcccactcctgtctttttttatggaagatcaattactgcactgttttgtgcctatagtacttttggtagataaactcaatattcctacatgtcttgtgctatagagattgcctcctcatctcaagacagaaaatgcaaatatataaaactgtattatcttgagtgtatctttcatatgagaaattagccatcacgagcaaaaaagaaagtatcctatgaagtttatatctcaagaggctttgtctgtcttgaatatacttggaatgattggtcagactggcagaaaatatttttcttgaaactacatggtgatatcctagtattgttatgtagttctggttctgcatttctgcatagtatatgttaccatatattgtgcagtttgcacctgccatttcttcaaaatgtacctcacaacatatttttccctggactactttgtattttgctccttttttaaagtactagtgtgttcttctcataagaagtcatgatcttttttgcttttttcattagttcagttccattgtatgatgttgatctcactttgttattattgtttcaatcttatctggcagaggctacctatgaaatacttcctagactctgtcaaattagatttgaccatggtgttatagatgaatacttattccttgacatggccaatgaattccggttgcccaatggactaatgctgctggaacatactaaagttgttcagaaaagcatttatgaacatatgcatgtgatacacgaggggcagttgagaatcatattcacaccagaactgaaggtaaaggcttatttgtaatagcttgcatttgtgaatatctagatgttgcaaatgattggacagtttaggatcattcttatctgctgttttcatgtgaaaatatgcagataatgtcctgggagttctgttcacggcgacatgatgagtatatcactcgcaggtttctttcaccccaggtagatttatgctgttctgttttatttgattaaactttgatcaatagagagcagatagtagattagctgctgtaatatacccaatacacctcttatgtgatagttgtcaacacgtatgtaagcaattttaataaagtggtttagttggatgaatattgcgaatcttggtaggctgggttgtaaaaagccccttctttttcctgctagactgctccaacatctatttagattcttgtttaattttccaatttatgtactggcttcctgagggctgcacatgcaaaaacacaagataatttcgaattttaagccatcttgaccgtccttgtctagtttttattttggtagtgctgtcctgatggtaaacatccctgttttttctgcacattttgatctctgccattctttggtgtactccaattttggtgacttggtatctcattgttcatatgtgctttttccaggttgctcatctgctgcaagttgcccagaaatatcaaactgttgccactgaaagtggtccagctggggtctcaaacagtgatgcacagaacatttgcaacatgttagtgagccaactatgccactagttccttgacatgcaattttaattcctcttctggcatgacaaatcatgattttttaaaaattccatctagagttttttttatttatgatctaattgatctcagcaccccattacgctctttaggtttgtgacggcgtcacgacagctagcgaaaaatatagaccaccacaccttaaatgagcatggtctatctaaaagatatgttcgctgcttgcaggtaagcatagcatttgtaggttatttaattatttttgtgatattatccataaagaagctcctgaattttctttagttattaatatctcgctgctaacagtattcatattttcacgagttctccttgtgttatttaacatttgctataatattatccagaattttctgtaatatacttctgcacacagcatcttcattgaatttgtgtcctcttcagatatcagaggtggtgaatcacatgaaagacctgattgaattcagccacaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaa

SEQ ID NO: 21739 - DNA, 9847 bp, Oryza sativa
  unsure (1)..(9847): unsure at all n locations
ntttccacacatttttatattaaaanattaatttcatggaaaaaaagccttgagaaanaatcattaaaaattagctatttctatcttgacatctgcatcctcatctagctgttcattgactgttgatcatgccactggcccgatgtgcactcccatctgtaatgactatgatanttcttaatcattttctgtcatttttaatcatatggaactgtttatgctaataaagctacatgctcctttaggtagtgtttggtttggggacgaagtgggatgggtcacacctatcctagttttgtgggatgggatggttccagttgtctgtttggtttatggtatggcatggttatagttttttgtttggtagaagggattgaggtgggatgggatggacggatttgtactcaccgttagtgccgtctaggggcagaggcactcggcggcgcccggatctgataggaccggcggcggcgcttgcgaaggtggcggcggcggtcgtagacgaggcagaggtggcggagtttgtggagatggcggtcacggtgctcgtggaggtggcggcagtcatggaccaagcggaggaggcgccgggcgcggaggcgaggcggcggctggatctgagtggagtgccaaggtgctagcggaggtggcggtcacggatgagcggcggcactcgtggaggcggcggcggcggccgtggaggcgaggcggcgctcgtggacgcgccgaggtggtggtcgcgggcaagcggcggcgctcatggaggcggcggcggtcgcggacgaggcagaggcggcggcgctcaaggaggcggcggcggcagataaagacgtgtggaggtggcggcgggtgtggacgaggcggcgacgctcgtgggcgcccggcggagctcgcgaaggtggtggatggcgcggtgacgccgtcgctcgtcccaggtgggacgagtttgtccgccagtttttggcggatcggttggtcccggatctgagaggaatattcctctccagggaccaacccatccgacccacccctaaaccaaacacccctaaaagtgggttcgtcccatcccatcccatcccatccttgcaaccaaacactaccttactggttaaattatgggttatcttaccttctgagctcttgctgttgcaggtattttcgcacttgcatgagcttgatcttcgttatcatctaaggtacttctagaaaatgcctcctattcatcttatatgtttgtttatcttaaatttatcaaatgatatatttccgttaatgcacacatgcacaatacaatatatagaaaagcatcacagttaatgtaggtggcttacaagttgtagcaaataattgcaaggaattgccaaattaggtagcttgactgcatgtatatatttcagcatttacgcatgggagatgatgagaaacctagtctagggctgcactattttggtggttatagcctatatcccactttgattcttctgaaaattggtgtggaaacaagttataagaaacaagcaaataatcagatatttcatgagttttagaactggaaagttgaaaattatctgagctcttatatgcctttacctggcttctatattttcagccggcaaactggtgccctaaatcgcataattgatcgaggtagtcgtgcgataaattacatccttacagtgatggtgttcaatgttgttcccacaatattggaggtactcagattattgtcattgactgttatatcccatcaactatgcatatacgcgcaatgttggtgtttctaactttccgtaatgtatgccagtcacattttacatttttgtctgatgtgtgccttctgttttttttctttccatttacagattggtatggtgtcaagtatacttgcatacaaatttggttccacctttgcttggattacttcagtttctgttgctacttatattgctttcaccttggctgtgacgcaggtgtgaatgatgtgctctatcagaccgtgtctgtcatccatgcatagtctaacaagattttttgctgtttttttgtcactaatgccttgactcgtaatgcattattatgacagtggcggaccaaattcaggacagccatgaataaagctgataacgcttctagcacagtggcagttgactcccttctgaactatgaggtaataccatgattttcaattggcctggcatctagtctatgttcttaagctttcatattctaattgtattaacctttttttttctaacttcctttattgggccagactgtcaagtacttcaacaatgaacaatttgaagttgagaagtatgacaaatatttaaagagtgagtacatatataatgttcattctgggaagaaaccttgttaacgtgtagacatgcatatgttactcgatacacttttttttgaaagatatactctatgcatttaattcactggttttaatgttattttcatcttctataaaaactaccaaaaaaacttatattgaggcatgaaatacatgtggaaaatgttttccatgagaaacagtagggttgatattgcatcttggattttttttttcaatcttcacaaacaattaggagcttgtacacattgatttatcaagtgcttagttatatgctatgtaaatctgatgaatcctagctgacatgttgctttggcatatatcgtaaattggtttataaaatttgatctattaattactatttctttttcacaatttggtcagagtatgaggatgctgcactgaaaacccaaagtagccttgcctacctgaactttggacaaaatatcatatttagctcggctttatccacggctatggttttgagttcatacggtgtaatgagtggtgctctgactgtcggtgatttggtaattttttatgacatccgcttatatattatttgatgcaagtatttcttatcccgttttgacatgttcggttagcaccatatccatttcatacagtggcaaagcatgttgttgcaatattatgtttattttatagtcaggaaggttgtttaagtgaaaagggctaactggaaagttttgatcatatgctactcctttagagtgtcaaattgattatttgccactcatgtttctatgacatgtagccccagggtccatgtatcaaaggcagagcggtggcaaatcatcaaatgccacttcgaggggtgtcaaatgatcattgattatgaactaattatgtggatttggaacaatagttaattttgaaccatgaaccatcagttccagatgttgccagttttctgcttttcttctttatttttgactgatttttattaatttgattaaattttgatatctaggttatggttaatggtcttctattccaactttctttgcctctgaacttccttggaagtgtctatcgagaatctaggcaaagcctgattgacatgaagtctatgtttcaattgcttgaggtaaaaacttcgtgactatctgttgggggcctaaatggcttgcagtttcagtttcatcctttcacaaccccagaaacttcattgctgttatttcactttgttcaggaaaaacctggaataaaggatgaaccacatgcacagcctttgcagttcaagggaggacgcattgaatttgagaacgtgcattttgggtaaattttgcgttctgtttacttattacatgcttgtaccacttccttaaaaagtcacgtctctcagagcatctgaacaccaaagtgaaatattgaagcactcctaacatttatctccgtagagatggaatttctttccttgttttgctcaagttaatttgttatagtggttctctttgtttgtgctctcctgtaatatttaaattttatcttgaccatcgcctcaattctcaatcaagttcaaataggtaaaatattctcatgttgttattttttaccatctggcatctgagtaaaacagtatcagatactgctgccttagggatctacgttgctgtcacgatttgaatttgaacaacctttaattacctcatatgtgggtcaacaatttatgtgcatattgggatgtaaatgactggcaatatatcattatggaatctatcaaagcactaagtacaattaagcaaattttatgactatctattatgtagtctaacttgtaaagtagacttatctgagttaatgttgtagtttacctgaaggaactgatttcttccaggtacgtaccagaaaggaagattcttaagggtgccacgttcactgtacctgcaggaaagagtgttgcaatcgttggaactagtggcagcggtaaaactttttttttgtcaaattgcatctaccaattggttaacttgactcaaaagttgaaggcgtgtttgagttctcccatggtcgtatcagcaaattgttttgttaaaaagaggatgggctttttggtgtttcccgggctccccccttctattaaagagtagcccaagcctatacttccatatttttttccatgccatggcaaagagagaaaagttattaatgaaggatatcaagttttctagcaatggatgttttcaaatactaattaaagcctgcttggcctacctatactgaacaacaataagctttgggtgtatattgtaattgttattttcctagaaaaatgtttgcctttttaatatccaacaggggctgtctcttaaggctttaatctgaattttgggttaactaaaaaaaattaggggttaggtgttctctttggtctataatttggacaaacatgcttatggtctgataaggtcatttcaaataaccatctggcatggttgtacgttttgtctatttatgtctgattcaaggctgactatagtgatttttttggggttgtatggaatgagatatcttgttttatcaatattagcaaaattcaaatttatgtgatcaacgaacaattcattaactgtattcctctacaggaaagtcaaccatacttaggcttctcttcagattttttgactcctcttcaggatctgtaagaacaaagaacgatctatttccattttgattccctgatgatgaaattgatatccgttttatagcatgtatatcttcagatgtgtatcaagcttgccattcttgtgatgccttttgtttgatctttgcagattcgaatagatgggcaagatatccgagaggtgacactggatagtctccggaagtgtattggtgttgtaccgcaagatacggttagctatctactgctctaaatctgtcaatgctgcattacttttcttgtcttattgaatttactatgctaaatggataaagcatgtagactatacacaattggaacattctggtgcccttgtgcaactttagttagcatatgtaaagttgttgagtaaatagaagtagctctatcaacatgcttttcacatatcagttaggagttaccacagttcactccaagagctcagtagctcacactgttaatgcattatccaatgcaggtactttttaatgacacaattaagcataatatacaatatgggcggttatcagcaacagatgaggaggtactgtgttctaccaatacatttacattatgaagttatagtactccccccataaatcccttatattttgggacggagggagtagggtcatttgaccttgttcaagctaaagtttatttgcgtacaggtttatgacgttgcccgccgggctgctattcatgatacaattatgaactttcctgacaagtacaacacagttgtgggagagcgaggattaaaggtgagatgcagtgtcttatgacatgccaaatccagaatagtcagaacctgttggtcctagcaataatgtctcaaaatctgtgattttacttcctttgcagttaagcggtggggagaaacaacgagtatcaattgctcgtgtattcttgaaggaaccttccattctgtaattccctctttccattttagccttaaaaagctttagattcagcgttgtctgactagcattaccatgctttagcaattgagcaagtggctgttttttattgttcctatgcaagcccttgtatgaagttaacatgtcatggtgatggtgtgccaaatggtcagagtgaaccctgctaaatctgaattatttcacactgttaacaaacactaattttgcaaaagatgagtttactgcattcctccctttgcttattttttttgttatctaatttataccagattgtgtgatgaagctacaagcgctcttgatagcaccaccgaagcgtcaattttaaattctctgaagactttgtccgttgaccgtacctctatctttattgcacatcgactgacaactgcaatgcaatgtgatgaggtatgcatgttcatgcaaatacattagaacaaaaaaacctgcaacttcattttgtgaaagtaatatgatttattgaactaaaaatagggattcagagtaatgtatcagttaacagcaacagattttcttttgcatcgattcaagaaatcgatagttaccatcatgggctagatctcaattatagctgatttatcatttgttcatatgtttgagctacagagctttccattatactcgatactgatgaatacttgtttgatgacacttcaatgattcttttataaatcttgtttcaaaatttgtattttcagattattgttttggagaatggggaggtagtggaacaaggaccacatgattttctgctgtcaaagggtggccgatatgctgaattgtggtcacagcagaataacagtgatgccatcgatgctgccgcggttagcttagaggtttcatagactatatacataattcccttttgcaagggaaaatgcaaaccatatttgaatgaaagaaggcttccccatatctgcattgtaaattgaatggttaggtttttagatatcggggaacagaaatttatagcttaggagcaaataactccgtttgaaagaaagccaggaggcaaaattttcctctttgaggaaacacccaacagttcgacatgtttccatgatgtaagcattttttttactaatccaagtaaatattttttcccactaaatcctatgaccgtgatctgatcgaggactgttgtcaaagccttgtggctgtggtggtgactggtgaggtatcatctcatgctacgtttgatatttgaggactgaggtgactactacaaatactgctgatgtgtgaatgtttatatgcttaactttttgtttaccgcaggtatgtgagatcaaaacttattttatgtaaatattttggtcgttgccaaggtaagaatgaatttatgaatgctgcctcctttttggatgaaaattagaagatgttgatgttccctccagcagattgtgttagtctttgagctttagctttaacattgttactacctgcagatataaagaaacggcaaggttttgtgagatactaataaaacactaaatttacaaatacggccatccccatatattatgcggcgtgacatcatgcaaatttatgtggtgtatgtattatcagataaattcttttatgttcatttccagctcgatttacggctgaacagtgaatataatacctggcttggtagcgaggaagtaatacgcatgaggtaaagtatccgccaaaattcgaacttttacaacacaaggcatggtgctccgacatgataataacttttgtagcgtcggcagccatcgatgctgttaaatatcacggcaaagctgcagcaaattgagctgctgcagccgtagcgctgcggcaaaattgcccttcgaagaagccccatagatactgacttgtcctgtctgaatgtatattggttgagattaagcgaatagagtagtttaattaatccaggatgctcatattactcattgtttgctttttttttatttccttggatatattggtgtcttgcattttttttaataatatatgcctagcctatgcttaagagcagacaaggaacattggacattccccaatgggaacattattctatgtcatctgctaggtgcctcctatgaccttcgtactcgtagcatgtgacagccagatgtattgtgattagctagtactgtgctacttaatttacacaacacaatagtattaatttagacatcttaacacggcatgattttcgtatatggtatttatgttttaccagccgatattgtggttttcaatagtacaaattgttgccatctatcgaaggtaaaaaggaaccaagaaaagcggggaaaacatatactccgacctacgttaattataaatcatcaaaacttgaaacgaaagtgattgatgagtgccatcaccagatctaccaaccaaatggacctttccccgggtcagcttcagcttcggtagttccagacaagcaataccaccggatgaggctgagaaacccaacctgcccgtgctgcactgtatgcctgtgtcgaccctccgctgccggtttcttttcataattttttttattgtgaacctttattgtcttaaaatttttaaaacaaatcatccataatattatttttcatagaataaattttttgaccacaccatttgagttaacatgttaggacaatatcatatcagatagcagtatgatgtttagtttatctactaccttgtgtttttaggttgctagtagcatttcttcaccaaccatagctaaggttagactatgaatctaacgcaacgctttgactagaaagctatgatcttaccgcactttacaagacaaataacatatgagatcaagatgagagagaaaaaaaatcgtggttatgtgtaacaatgaaccgaatacatagctaacttaattaaagctaacttgatgtgtagcaaagtatggcaacatgtagtcacgaatcaaacaaccccttaaactgtatttgattgttgattttagaaactaatccctcgcgcatgcaaaatagaatgaatcattaatgcatgattaattaagtattagctttttcaaaaatagattaataagatattttaaaacaaatttagtacatttagttttgcaaaaaaaatacaatgtttagcaaattgaaaaagtatgcgcgtaaaacaaacgaactcaaactaagtgccattgttcgtggcatggcaacaattatttatcttatactccacgatattttatgagcgtgaaaatgtcatctgatcacacctattaaaatgatgcgacaaaatatttagttcaaaattttcatagagctccttttgaaattaaaacttaaaagaaagttaaaaaaaaacaacaataacaataataataataataaattgcctaccagcaacactgcaagtctgcaacagcaagcaaagcagagatcacgtcctcccaggactggagcctggagggccaaaaccccccaaatttcccaagccaacccaaccaaaccggccgtctcgtctccttcgtcgttggcaatgcctccactgccagcctagcccacgctgcccaccggcccaccnnnnnaaccncaaccttcctccactccccctagcttttcccctacacctcnnnctcttcctcaacccacctcaccctcaatcttcaattctaacttttaatccctttcaaatcccaacagattcattatcttacncaacacattnttccatcttccactatacccattaccaccaactctccccattaatttaaactcccttccttcttcaattattgctggatgaccattatttgccctcatttatttagtcagcaaaaggtgaacttccgtcccggtctttttcacaatgaacgccgcaaattgtctactaggtcgcccttttttc

SEQ ID NO: 21740 - DNA, 7463 bp, Oryza sativa
  unsure (1)..(7463): unsure at all n locations
cctgtccnatttgttgacatccagctcggtaccctggctcgccgtctacatcgccgacgccgtcctcgtcttcctcgtcatccccttcgccatgttctactacgagggcgaccaggacaagtaagtagtatacatatacatttccactctttcctctatcccattgcgcatctgctgctaaactctcactgaatgttgttgattggatccgtgtgttgttgcttcctgcaggtcagtggggaagaggctcacctccgctctcctgtgggtcgccgtctccgcggtggtttgcggcctcatcctcggcatcctatacggtgcggatcactgctctcctttgcctatcatgctaaaatttctagactagtagtaatattggagtgggatttttgaatctgttcgaatttgctatgtgacctgttctacctgaatcttgagttggttggttactagtgttaattcttctggcttcacttggagtgactagctcaagctttgagcttttcaattagtacttattttcgagcaatcaatgctgtacaaaccaggaaggcagctgccagatctgaattgtcctgtttgagctttgcacttgttgtgtagtatatctccccggtccacattatacccgcaaattgttttcttatcgaccagtagtctgtagcttcacaattggtagttttgtttttgcgctgtttcttatataatccttgtttctttcttccacccgatgtattaaaatgaactcctgctaggtcccttgaatgccctctgcaaaaaaaagggttttttttcaaggaaaaaaaaagtggtcttgtgaacaccgtggcttctaagggtttgggatgctttcactttacatgacctcactttcattgttctgctgcaggacttgttggcaaagtggacttcactgtcaggcatctttcttcagcagttgagacatttccaaattcattcactagtttctcaactggtcaaccttgcatcagtacatcgcccaagcaggttagtcaatcaatcaaattatgctttcttatgcctatagtaatgatgttatgtgctccccatccaatagcaacatttgatcgacacctttcttttggcattttatctacgactaaactgctttacggtttgttttattcagtgcgcagcttacactgcacctgctaactctcaaacaacttggacaatgcgcgctaccttccctgaatatgtggttgctcttgctaccatcgttggatctgttctcttcacagtgagttttacttcaatcttcatgttttgctttatcaccgtttctgtatagctacatctattcactctactggtctgcatgtgaccgatagctttatgtcttttattgagtgtaagctgtactagaaacaatttgaaatatggatcctttccaacatccaattctgctgcaatcatgctggtttctttttacaactttcctattcctgtttggtagatatttggtggtgttggaattgcttgccttccattgggacttatattctcatttgtccggcgcccaaaagctgtcattacacgctcacaatatataaaggtgcctatattctcacatacttcttttcaattatgagcattcattagaaccatatttttctactacatataattatcactttgaaattttcaatgtggattgagactgaacatattttctgcaggaagcaactgaactaggtaagaaggctcgggaattgaagaaagcagctgaagcccttcaccaagaagagaaaagtgggaagaagggcagaaaatggcgcaaaaatgtcaaggcccttgggaaggtgagcattgccattcaaacttttagcctcactcagtgaacaaacttacctttttgagattagtgtggagtaagaagcatttgtgttccatttcctttctaatcagaacactcgtgtccatttgtgtaccacatgccaataatttctgtaatgctctattaatgctcttattatgttttgcctgcccttttaatcatcaggaattagtacttttagaagatgacatgaaggctcttgaagagatgtaccctcaaggagaacaggtaactgaacatgaaatcctatttacattgtttcttttggtttattgctggcttaacatccatcatggtgcaggctgaggctacctgggctttgacagttcttggttacattggaaaacttttatttggtgctgtcgggtatgtgtaaatagttgtacggactttgcttctattctagtccaacctatctgcaattgtcttctaatagctacttatgatctcaggttaattatatcgattgcttgggttgcacatatcgtcatatacttgttgattgaccctcctttgtcctccttcctgaatgaaatcttcgtaaaattggatggtgtttggggtatatttctgttcattacattgttctgaactcgtcctattgatgacagtagcttgaccaatattctgttttctgtattaggtctgcttgggactgctgcctttgcattcttctgtttctatctcctcatagcagtgattgctggggaaatgatgctgggtttgaaattagttttcatcaccattcacccaatgaagtatttgacatatcccatggcatttccttttctatgtagtatcttttttggaatcattgataacgcattttttttcagatggggaggaactttgatgaactcgttcctgtttaatgttggactcatcctactttgctccatcaggtgtgctactgaggcttcttttagatgtaattgtttattgctattatttttgtaaattatgatgccatcttccatattggaactttttccatgctgacaaggtagcgtctattaattgtgaatttgttgcatatatctgaaattgtttctatatataaaatcagtgtgtcctttaacggttagcagtagtgtaaatgaagaacttttgtaaagcaaacattgagttgacgtagcttagcttgtgcctagtgcagctgaaaaatcgcttcaacatgttgacatgcgactttgttggtttcatcaaccttgcttcctccataacatatgcatacctgctgattatctgttaattttctccactaagaggccatctaaaatcttttgcagtgtgattcagttctgtgccacagcttttgcttattatgcgcaagcaactgcagctcaggagatctttggccacacactgcaatctctccgtggaattaagtatctctacaagtatgtatctagcatgcaaatccatagtcagtttacagttgtttgctcgaataagctggatatatccatgtggtggatattggagcatcaaacttttgaaaatgttctgattttaacatctgaatatgcaggtacaatgttttccagtatggctttgtggctcttgcgatactcacactcttttactatgcaatatttgtaagtgcattcttccaaagtattcagtcaattcgtatgaaaatctggaaaaatgttggcttgcttatttgtcctgaactgtttgttcagggatggcgaaagaggaaaccgacaggaagattccagctctcaaattgatttgtggtttgttctgtaaggaagcctgacgaattgaactacaaacatatttgttcacgagtgatagattggttagcaatgtatatgatctttgaaaccgctttctcaaagagctggagagtttatccatgtaaattagcaaccatgaagtataaggagaaaactgagatttcagtagggcacggacatggttgttaaaagcagaacccagctgcctttgtaatgtacacatttctcatcgcggctcttcttttccttgtgtattattattttacacttggctgatgttattcttgacaatactgggtccttcgaggcagagatgtttgatgtgatcgggtgccactttgggacccccttgttcttttgttgggtttgtatcgagttaggtcagttgatttctttcatatgtaccatactgtgattaccatacgaacttctagattgtattaaggatgtcttgatcatctgtcctctgtcaatctgcatttgcttctcatcttcagactgctcaaccaatcgagcttttggggacaaacttggctgtcctgttccaaatttcactctatttgttatggtcccttgtttagcggcatgtttaattttaccagatgaaagtcaattctggttaaccgcattctaaaccgtaaagaagctgaacgtaataaatgtatactccgtatcatgttaatccgaaatccagtgactgttcacaccttaacaaaaatggtgcctatttctttaatatccgtttacgtcagataaattgccagataaaataataagaaaagacatatatggaaggaaagagaaaggagaaaacgaaaatgtaaataaaaaaaagctactccatatggcatgaaatggaaaggataaaactaaaacaatatgagagaattttaagaaaataaagaacctatatatggaaagaagacaggagaaaactgaaactatctgtactagaagaggggggacaactgaaactatctgtttctataaatctgcctccaatgttccaatctatagctcaaaatgatcatcagcatgatgaatgccatttttgcgaacccttaggctgtccagtaagacttgacagacacaaggatcttctccctctgcatcggcccatcctcatgatcaacgatcctgctctcccatctcatcccgtctgcgatgttcttgatcttcaccaggacatcaacatcgtctctgaatattaccgtgccttctggcctcagcacacggtccatctccagcaaaatgtcctccatttcacatctgatgacatgcagagaacagcaatagattcagctagcttcatggctggagcaactgcaaagttgagcacaagaaacagaagcaaaatccagtacctgtctttgtacattgtgaacagggagtacgcatggatcagatcatacgtcctaggataagttgacatcgcctcacacctgcaaaattttcacatactaattaaagaccaataaacctgtaaattttggaacattttgcagcaacaaatacactgacgaagaaagcagtgctggagtgtaagtgggctgacccaccaactcacttattcgccaaataagtgggtaaccagttgatcgatccacttaattagcttataagtgagttcacgggtcaatccgcttacacgcctgtgcatatatgatagtctgcaattttatttttttttttgaagattttgcagcaatgaatacactgaagaagaaagcagtgcacatatgctggtctgcaattgttttctgaagattttgcattagcaacgacactgaacatattttggtcagaagaattttcagcttaccaatcttggtacgttccgatgagccctcgctcgtagatcacgccgagcgtgttggcaacggcggccgtcggcacgacgttcatcacccagacaggatcgtcgacgagcgccgccgcgaagccgccgaggccggcgttcatgtccagcagattccggtaccggcctttctcggccagcccgccgctgacgcccttgtagcgatcgactcgtctcctccacatctcagaatccttgataaaggtgtccaccgtgacgctgcttccaaggctgccgccggcgatcctcggcggcggcgatgtaagcctctccggccatctcttgacctcccctccggcgacgtctccgggcccggacacctccggtaggggagtgatgcactcttccatgttcacataccttgaaatcatttttcaagaactttcagaaacgaagccaacatttttttaagagtttataaatgtttttgagtatttttcgtaaaactactgatattttgaccaaactattgtaaaactacatatttacgacggagtataaaaaaactacagatttaatgccgagtttaccacgaaactacagatttaaggtataatgtgtaaaactacatattgttaatcaaatcaaatcttaaattttcattcgaatggaatcatgtttggatcattttcaggtgataaacatgcataccagccagcatcaggatcttggttggaattgcagaaaccaagaccaccaagctcatttctgctagccttgcagctgacatggttgatttgtttctgccaaacagcaatgtcacccatctgctgcaccttggtccagcaaaggctcttggcaatggcctcaatggccgattgctcggagctcaagtcctccggcgtcctcttccaccccttgaaatgtctctcccagttcaccggcggccctgacaggacccagtacccgccgggccggagaacccggtccacctcaatcatgtagagcccgtctgaaatgcaacaaccattgttgatattgccatgatcaatcaaagctacccctccgatcataaatattcgatgtttagaacaagatttaatcaaacttcgaaattcccgaccaaaaatctattatattattaaaggaatagaatttctacgttcgctctcatggcctagaaattctcacattaatcggagaaaaagaaaaaacagagtccatatagaaatacaatttagaaatacctaaaattcggaattaaaaaataaggaatattagaagaggagactagagtccatatagaaatacaattaggaaatagttgaaattcggaattaaaaataaggaatattagaagaggagactagagtccatatagaaatacaattaggaaataactgaaattcggaattaaaaataaggaatattaaaagtagagtatagagtccatatagaaatccaattaggaaataacagaaattcggaatattaaaagtatagtatagagtccatataagaatacaattaggaaataatataaatttggaattaaaaataaggaatattagaagtagagtatagagtccatatagaaatacaattaagaaaaaaaagaaattcggaattaaaaaaaggaatattagaagtagagtatagagtccatatagggattttaaactaaataaaatttggaataaacataagaaaattaaaagtaaagtttagagttcgtataaaaatataatttgcaaataactaaaattcgaaattaagaaaaacatgggaagaagagtttaaggtcaatatagaaatacaatttagaagtaactgaaattcaaaactaaaaattaaagaatattgaaagatgagtttagagtccacatagaaatacaattagaaataataaaaattcagaaataaaaataaataatattggaagaagagcgtagagtctatatagaaatacaatttatggaaaattcagaattaaaaaaagaaatattaaaagacgagtctagagtccagtgggtnccgagcaggtagtncagtcaacaagcgc

SEQ ID NO: 21741 - DNA, 6169 bp, Oryza sativa
  unsure (1)..(6169): unsure at all n locations
agaaaagtttagagttcgtataaaaatatatttgcaaataaataaaattcgaaataaaaaaaaacatgggaaaagaagtttaaggtctatataaaaatacattttagaagtggctgaaattcaaagctaaaatttaaagaatattganatatgtgtttagagtccccataganatacacttagatataatatatattcagatatatatatatatatntgtgtaagaagagcgtagagtctatatatatatacaatatatgtatattcatgtatataaaaagaaatatttaaaagncgagtgtagagtccatataganatatatatatatatatatatatatatatatatatatatatatatatatatatatatatatatatatatatatatatatatatagttatttttaaattttatatatatatatatatatatatatatatgtatatatatatatatataatttacaaataactaaaatttgatattaaaaataattaataactaacacgtatataaaatataatatgaacattcaaaaataaaaataaataatattggaagaagagcatagagcctatatagaaatataatttacagaaaattcggaattagaaaaaataaatattaaaagacaagtctagagtccatataggaatatatataatttacaaataactaaaatttgatattaaaaataattaataactaaacatatataaaatataatatgaatattacacattagtagttttgtaaagttattgcaaaatttaaaattatgttgtcattttaatatatttgaataatataatgagaaaacatatatgctattatatgagagaaaatataatgatactagccgcgcaatctgcgcgggccaccatgctagttttttattataataagtatgatacaatgatactactttagtactttttcttctttcgtttttaaaataagcatttgaggtattatccatggatggttggaatttcaaaagtttgaccgaatctcgtccttaacttcgaaaaagcctgtcaacttggtggcttccaaatcaaattaagcacaagtttgattttgcaggggtgaaatttgaggtggtggagttacaaagcacgtactgtacttgctccaggggatgaggcagcgggagcagtgcgccatgtcgaaggcgcgagccgggtaaggaaggcgcttggtggccatgatgccgagcatggccgggacgccgcgctccagggcgaagagcacctgcgcctcgtgcgtgtccttgggcgcgaacgacatcgtcagcacgtcgcgcgacagcaggtacgctccccagctcgcgacctgcacatgtggttcgttcacacttcagagttcagagtagtagacagtgcacattagcatcagattgatttgtcaattgtcatagcaaagaagacacggatattaggaaatgacctaatatcaaataattagaagaggtgaagctctgaacccaagtcgtctagcccaccaccctgtggagctagccggaaaacccctgggcatttctcatcaattgtcatagccaacagcttgactcatgcatgagtgtttcccgagtaaggatgatttgtctgatgaaaaaactttgtttacgagaaatcttatttgacgcgttttatacaaccatcgttttatttatgatgattaaattacaggccgaagggtaaacgatactagtgttaaactcgtcgtactccggttgaagttagccaagaaacacaagccaacaacaagggggaagaaaatcatgtcttggacattttgttcaatagtgttgatagctggatatatatgtcgcatcagacatcttgtaccatctttacagtgaacacaaaggtagcaagaatgatcaattagtaaggtaagctcttcgtcctgaaagaaaaccaatttctaatttaaaaacttgatttttgattattttttttaagaacggagggagtacgagcaaccagatccaaagatgcacagttgagttcagataaagctatctgccgtctggttagttggactatgattagtattttcttatccaaataagctctcatcagtacacaattccatgtgcacacttctatcgaactctcctaccaaactagatatcaatcaccgactcagacctaacatcaattaatccattgtttcttttttcaatttctcacaccgactctacacatggagagggtacttagttaacataaaaccagctttgatccacatccagaagctgatccaaatatatctaattttgctgtctgtcctcgaagcatccatgtactctatgtctagtactagttgtgaacattcaactatcctagtggcatttttaatccaacaattaacaaacagataaggcaaggataactggtgaaggtgttaatcacagatgactacatggagatccacaggcatttacccagtagaaaaaaaaccatacttttttcgcagggctaaaaaaaagggttttttcccctacattttggcaaaaatacgatagaaaaaaacaagggtgtttaactcgctacatcaggaaatttttcactacaaacaaaccagcactaggaaacacaatcatgggtgtttaactcgctggtacacaacacaagctccaaaaagtgtacactgatctacgcgctgatgatcaagaaacagtaaaaaaaaacatgaaaacaacacaactgtggtggagaaatattgatagcagcccgaatttcatagggattgaattgcaaacaaattttggaaaataaaatagggactcgattgtaaaatatcaacctcaaccagtcaaactctaccactagccgtcagatcagagatgtgcggtcgagattacgttgaccaccagtcaaccaacaaggaaaaactccactcgggactgggcccaccagtcagtgactatcatcaccaggttaatctgagaagtaaacgcggtaaaagtaactaaccccgcagccggtgtccagcgccgtcctgaccgcgccgccgccgcccagcgtgatgccggccgccgcggcgatgtcgtcgatgtaccggtcggcgccgtgcgggaacatggtcccgccgccggggaagcggagcacgtcgccgtcccgcctgatccagttctgcacgcccttctccgtcaccagctcctcgtgcggcgcgttcgcgtaccacgccgcgtcgcggctccgcggccaccggagcggcgcgcggtagccccgcggcgccgggacgaggcaccgccgccgctcggccggcggggggcagtgcctctccctgtacgcgaaccgccgccgcggctggcgcagcgaccaccgctgcccctcgcacggggtgtgctccgagtaccccgcgtcgcacgccggnacgcggcgcgatggcggcgcccccgcctcggccgcgtcctcctcggacgcgccgtggtggatcgagaagtcgagggcggtgtcgttctttgaggccgcgggcgccggtggctgccgcgtgttgcacgggacggcggcgagggagaagacggggagcggcggggcagggtgcgtccacacggcgaggaggtaggaggcggcgcagagcgccacgacggcggccatggcggggagcgggagcttcatggtacgcagcagcatggccgctgacttctcctcccctttgccagctactggaaatttgggaataatcactgaatcaatcaccgatcaagaactgaaatttgctatctcctcggtcagatagttcagattcgttcactgttgtgcaattcagatcgtgtggagaagggaggaagagagggtaggtggttgaaaggtgcttgcttgagatggaaggtggacacctgttgcaaactgcaagatgtcatactgtcatagtgtcatggatgctagtgcttggtgagctcaatagctgattgccattaccatgtgcaacaacacagtgtcactgtatcctgtcaagtgtcaagaatggtttattggcctggttttgttgctcttattcacgcaaatcttttgtgttctcgttgaaaaattgctgctcatgttcttgttgatttacagaatgacagaccacaggattgtacttgcacgaatggtgttttttattggatgggtgtgtgcgtttgtcaaagctaatacttttttttttcattcttttcagagatatctaaccaggtcagtgacaaacagggtaggcaacaaccggccaacaagttctgaaactaactacttctacatgacaccaccaaccatggtatgtatgtaagaatctatccttgcaacaacaaaaacagctattttcccaatctgacaaaggctggttcagatctgcaaaaagtctgaatattttcttctatgaatgcacaagaagactctggatatcgaaatgtttctggggatcagtccattgtgattgtttaatttgaggttaggctgtgtttagttcagcgcaaagtttggattttgattgaaattggagatgatgtgactgaaaagttgtgtatgtatgacaggttgatgtgatggaaaaggactgaaatttggattcaaactttggatctaaactcagccttagttaaagaagaatgccttttctggatctacatctcctctacctgtgtttcacaagtggacaggaggattactgtagttgttgttcaagcctaagcatttagctccctgtgacctgagctgattagtccaaactaagtctggttagatttgtttgtgccttttccagttgcctccatgtgtttttttatactaccaatgatattctgacttttctaatcctctccatcatgatagttttcactgagatacgccaacgagataccatacatcatgtgtcataaaaaaatcagtctgctgaattgaagtaaaaagaaaaaagaaaaagtgagaactcgaataacacttcttccctttcatattattatacaactattataagagagagagagagagagagagagagagagagagagagagagagagggagtgctataatgttaagagctaagcaatggagtttatatgcttaaatcgcttatttttctttatatatgggtacctaataacgcgaggttagtgggtttatgagatggcaagtgtaagaaacaattggtaactagtgacaacacttggaaaacgatatattgtctcatataccttgctagtggaaatagtaacaattttctttaaaaaactcacttaactctaatggagagaaacgtggaatttcactgaaaatttagacatactctcagtttcttctaaaatctcagcttccctcgcaaaatcttcactgagcctagctagagagatagctagccgcttcaatcaagtggccatcacggtacaaactaaaggtttagcttaatcagtcaggagttaagtagcccaagatatgcaaatgattagttcaatcaactggccagcagttgagatgtaatctctatatatatatatagcagagaccgaagtttaagttgaatcaattcgtttgttctgttttttttggtaaattttacgcatgataatgtgattgcatttcttgagttggaacttagaactcatcagtgatccactggttgagagcttgtttctgtgaaatcatatcaaatttatttctgtaaagatttacttttcactcgcgctgcagttaaccctcagtgttggctgctgatctgaagtataagtccacgattttatcctgggaaaaatcagtaaatatcccttgccgacggagaggccctcgccggcggcgagccgctccaccatgccctgcacctgctcggccccgaccctcaccgggtcgagcaggttgcaggcgacctccacgacgccgccgccgtgcgcgagccccatcgcctgcacggacgggagcccgccgccgcgctcgctgacggcgcgggcgatccgcctcgccgcctccagtcgccggtgtggacgggcacgttgtagttgtcgacccagctggtggcgccgacgaccaccacgcccttggatctcggcggcctctccggcccggcgtcaggggcgacgggcagggcgtccgtctccggcgctcaccgccattggtcgccgnnnnnnnnnnnnnnnnnnnnnnnnnnnnnnnnnnnnnnnnnatttgcatnctacaaggggcgcg

SEQ ID NO: 21742 - DNA, 9880 bp, Oryza sativa
  unsure (1)..(9880): unsure at all n locations
gccggttgaaattgatatnccactcggnacccagaagaggagtggagagcagcaccaaccttggagctcgtctccgatgtcggcggccacggctccggcgaggtcggcgacgtggcggagggaggcatgggcgagggggtggaagcagatgtggtcgacggcgccaaggcgcgggtgcgtgccggcgtgggcgccgaagtcgatggcctccagcgccgccctgaccatgccgagcacggcgtgccggagcggcggcggcgccggtgagggggtgagcggcgcgacgagcgtgtagcccacccggttgtaggcgtcgtcggtgaagcggttgacgacgacggcgccgccgccgccgccgcgcgccgcctgctcgatggcgcgcagggcggcgtcgttgcggctctcggagatgtagagcttgcagcacgccagcaacgtcgtgggcctcgccatcgtcgtcgacgtcatcatcgtcttcttctccggcgatgtggagatgacacgagaccagcgtttgttgtgtggacagaattcagcaaggcatgcagcctttggacttgacgaatttcggagaaattttacgaagattgaggccgtgtttagttccaaaggtttttcttcaaacttccaatttttttatcacatcaaaacttttctacacacacaaatttctaacttttccgtcacatcgttccaatttcaaccaaacttctaattttgatgtgaactaaacacagcctgaagtaattagtgagaaaatagtttaagatttcacaggatcatcatcgaaattagttcgattctcacaaaacaaacactgaaaattcatccattcattccaatgaaggttttattcagggccagtcctaacttcttggaagcccttgggtgaaataaagatagaggccctcataacttttttttttgcaatagtgaatataataattcattatattattgaacaaaaacatccgtaagtcatactaactgtcattccaatttccaatcgcctaataatacttttcataagttgaacacaacaaaaaaaacaatattttcttctcttgtaggccccatttccactaaaactagaaaatcatgcgcacctggcgcgcatgatttatagcccgtatatattatttttgtgttattaattagcacattgttcataaaagtttaaaaaaatcttagttgaatggaattttttgagttccagtttaacgtaatagatcatattgttgagaaaatcatcaaattttctccctttttccatccatgccattagttattcctttgttttttttaaattacaattaagttattaactcatgatagatttttttagtagtgtccattgaattggttcgaagagataaaatagttttttttttcatttaagatatgcagctcaatatttcgaaaatacttatagagatatatatgaatatgagtagttgtatatgcattctaacattttttgcaaatgtactatagaatactctatctttgaacatgtacatgtagagcaagtgagctccattgacagaggcatttgctccttcccctgatatatagatacttccagattatccttcctctgcgtgagaggactggagctgccacagccatgctcttccctcgtactcctagacacacagcgaacgtatacattttgagcaggtggccaccattggctccattgacagaggcatttgctgattgcctaatcgatccttttagattatcctttcatctgcaagggaggattggagccagcggcgaatctagaataaaaattacccggggtccactacattactcgaggtccactacatagtagttatctaattattcactagtatactaatcaaaatagcataaattagttagaatttaacaattttacccggtgtcctgtgacaccggtaagttatatgtgggcacgccattgattggacccacaaccctgttttttccttcgcactcgacgcacaactgcccaactcttggtatcattttttccccttttggtgttctccagatttatctaccatgtgagagaggacacgtggcccaatcactacagataaaagcaatatttatatatttaaactcatgctagcgtataacatcatctataatttatttaattctacaaatcaacatgtaagtatatctaatcatcatcgctcacattattttaataatattttaacaaatatacctattatttttataatatttaacatatacttatcaatattacgggtatcatttgtttgttttatgataagtgttgataaaacctcatgttttaatattttcttttctttttacctctcagctcgacaacctttggggaagacgacacttgcgagaacaaggattggcacgtcggtgctgggagaaaggcgacaaccgttggggaagatgtcgcttgcgagaacaaggccggattgccgcgtcggtgctgggagaaaggcatgagcaattgaggaagatgacgcttgcgagaataaggagaaaaagaggaagatgatggtagcagaggcaacatcgccctcgtcccttgatcctccaaatctgggtatcctcattgggcccttcttcatccctctctctttctcctggatgtggtcgagctcgaggtcgtggtcgttgctaccgtggatggcgtggacgtgttcgacctcgacgctcaccggctggttgatgcgtccacactcgcggaccatcacagctggtacggctcgacgcccttcgcttgatccgttgagtgagtggatcttgctcgttggaaatagcttccgtggatccggaaaatactgttgtagatgtcttcctcgtcgccggtttacgacagctaacatcggctcgctgtttatattttttggaaaaaaaaactttcaaatattactatagtatagttgcagtgtaactccaatatatagtatagtatagttgtagtttccagcgagttatgaaattagttttctcattcgtgtccgaaaaccctttccgacatccggtcaaacgtccgatgtgatacccaaaaattttcatttcaccaactaaaaaggaccttatatacaagttataatattgttatagtatagttatagtggaattatattacaattatattatagttagatttaaaaaaaattcctttaaaaaacttggggcacttttttagacacttttttttcttctccattgtttcctcggtatgcaatctttttcaccagttctttccgtgttttggtgtgattttcaaccgagtttggaatgctctggatttttcctttgttttatctagagtcttcacagtcgtgcggaatggaacgtgctcttctggacacatggcacattttaacgagatgtgagcttgcttttagctttggccacgtggcccaatgattcggtagagattgcaccctgaaatcggtatttagatatctcctgctttattatcaagattaccccaatttcttggatcaaaaattcaatagcaaaagttggttgttcatcaacacccacagaatttgtatcagccgaatcatgttaggtttcatgctcactcaagttattgacatcttcattctgattgatgctattgccttattggtattctctagaactgtcattaatttgctcgttgaaaacaactaaagccaattcatcgggatttctaaaggaatcagtattattcctaaagaacttctcgattgctcccattaagattcagttaactcatctactcgtttccttttttttttcctttttcacttctagataaatacttcctgactgacataataccaagaacagtagtacaaatgtacaatatagtagtaccttgatttgcaaattgcaaatcggctggaatctgaaaacgtgtcaacgaaacatgaagaaggcaagctctaatctcttaaaaaaacacctaaaaatatattatatagtctttagaaccttgcaaggcagcaaaaaaatatattaggccgagtttagttccaaactttttgttcaaactttaaactttttcatcacatcattccaatttcaatcaaactttcaattttggcgtgaaataaacacacccttagttgtattgtactcctatgtaataatcaagaaaatcataccatggttgtctgcaagaatcgccgatctgaaccctttctcttaaactctctcctagctctaaaacagatgtgttcatgtgtaggagaggccaacaggggaaaacgaatgctaaagtcagctgtcagcaagtctccaactcttggttctgttggacggttggttggagtcgccggcgcggcgctcgtttcgtctttcgggaaggattgaagggaaggggattggtgaacagaaacggaacaggcgacgcgcgtgcggctggagccaagcgatccataatccatttccccaacacaatctccttcgcttggaacatcttatgctcagagacatttcatcgaacgccctggttgcgcccccagaatggcatgagttctaataagcatttcgtcgaacacaccgcatacaggcaatgaccagttgatgtattgagaaactttttacttgattcattacaggagtacatgtcaaaccagaacaaataaaacaagaaaccatacgaacactttgggagaacatgtatttctactttaatactactatggcagtcgatgtgatcagaagtcctcgtcgatgctgaagacatggttgcaagaagcgccgccgttgaggctggacattacggacgccttctggtagtcgccgacgcgcttctcgaagaagttggtcttgccctgcagggagatgagctccatccagtcgaacgggttggcgacgttgtacatcttcttgcacccgagcgccatgagcagccggtcggcgacgaactcgatgtactggctcatgagctcgccgttcatcccgacgagcgcgacggggagcgcgtcgcagacgaactccctctcgatgtccacggcgtcggcgacgatctcctggacgcgtgactcgtcgagcttgccgcggaggaggtcgtagaggaggcaggcgaagtcgcagtggagaccctcgtcgcgggagatgagctcgttggagaaggtgaggcccggcatgagtccgcgcttcttgagccagaagatggcgcagaatgaacccgagaagaagatcccctcgacgcaggcgaaggcgacgagccgctcggcgaagcgctcgccgccgtcgatccatcgcatggcccagtcggccttgcggcgcacggcggggacggtgtcgatggcgcggaagaggcggtccttctcgacgtcgtcgcggatgtacgtctcgagcagaagcgagtacatctccgagtggatgttctcgatggcgatctggaagccgtagaaggcgcgagcctcggcgacctgcacgttggacatgaacctggaggcgaggttctcgagcacgatgccatcggaggccgcgaagaaggcgagcacgtgggagacgaagtggcgctcgtcgggcgacagcgcggcgtcccagtggcgcgcgtcggcggagaggtccacctnctccgccgtccagaacgacgccaccgccttcttgtagaactcccagatctgcgggtacctgatcgggaacatcgagaagcgatccgacgactccgccagcagcggttcctccatgtcgccgccgccgcgggctggcaccagcgtcttggccgccgccgccgcaggcatccttgtcttcctcctcgccttcgccgcggcaaccgcgattcgatctggtggtttggggattgaagttggctcggcgagtgggtgtggagaagaaggcatcccctcctcgcctttatagcggcgggcgcgcgcgaattttggatttcgcgccttggtgcggcggcggcgggggtggcttgcgagggaaggagcaggagggcgccgtgccgggaaagatttggggggaaattttggatttctcctcggctgctttgaaattttcgcggggaagatgacgcgtcaagccagccgccccgtgaattggggaaaaggaggttaaatgcgccgcgatccactctatatgggccggcacctgtcgcagatcaggcccaacatccagttgtgtagtgggcccaaattccaggttgggccgcgtggttagagctaagatttgagcgggccgggattgtgggccaacgtacgaccggcgataagaagacctgtaataaagcctgtaacggaataacggctattgctttggacctcacactttctccggttagctaggggtgtgtttagttcacgccaaaattgaaagtctggttaaaattggaacgatgtgacgaaaatgttaaaaatttgtgtgtgtagaaaaattttgataggatagaaaagttggaagtttgaaaaaaaaattggaactaaacacggcctaggtaaagcaaattagggtgtgctcggtaaaatggttggaaacttctcgctgcgcatgtcaaacagaaccattcattaatgcataataaattaagtattatataaaaaacttaaaactaaattaattttgttttttaatatttttctatagaaaacctttataaaaacatatcgttcaataattgaggaaatgcgtacatatgaaacgagagaggagaagttaaattcttattagtataaaacacacatttaggaaatgtgcctttaagatttcgatttgaagatttcaagctcgcgccaggaataacatccgattgaaacttcatttattgttaccataatgttcctggatggtactgctactatacgtcctgttagagaggtgctgtgtgtatgaaatacaaatggctctttggatatgaatttatgagtaactccagtagttagacgtggaccctatgaactgcagttgtggatttaatctcatgttttcttgccggttcacatacattgtttgaaaaaaaaacttgaaataaactactctgttaataagcaaaccaacgtttgtttatagcgcgaactacagtgtgaaatattacatgtagttaacctggtaattgaatttacgtccccgacgtctaatgttaacatttagacagcaaaatatcatgcaaatcaaccattacaggcgtatatgtacgagtggttcatagataggcaatactaatgttgccatttaggagtagaagctagggcaacgcataacggttgtactaaacagtcatttcaattgtaacggttattgtacagcttgatccgatgctactcatcaccgtcgcatttcttgtaatttcccacaaaatttcaagtaagaggaagaaacaaattaagactcaaaagtggtggcacaacacaatgatgcatttcaagatcaaaacaaacccaaaactcgagcttacttagtagccaaaacaaatataccagcagctaacccagctaatgacaatagctgtctgcaagtaaaacacccggtattttgtcacgtaccaaaatgacacttttttttctgacagcaatggcacatcattaactgagccccgcattgacgccaaaacacgggacacgcatgcgtgcgtacgtgtcccgatccgacggtggcaaacacacaaacatcatcatcaccagacacgcaggatacagccacgtagtacgtcgtacagcacaccgtaccccaccctgtacactagcctgtacgtacagctcagcgtccgttgccgcgctgacgtggccgcaccgcgtggcgtccggctcacgcgatctgggccgtcggttcggcgcgggggcccacgcgtcagacacgcgtgtcaggtggtgggagcccaacggtaacaaaagaacgggggcgtgctgcgtgaccgcgtccacgcgtgcgtgacagcgttagggggggtggtcacgtgcgtcgcacctgaccgcaacggtcacattgaccagagagggggggaggcaatcaggcaacggtcacatcccggaccaccccatctcgcaccgtccggtcgcgatccgacggcgtgggagccgcctcgagattcgcgcctcccgcactcttttcctccccttgggttgcccctcccggcctcttcttcccttcccttccaccacaccggagaggtgagtgagagtgagagagtgagagcagagaccaccaccaccggagaggttagtgagagaggagtggtaatggtgaggcaacaagagtaggttccatttcatatcatcactaggatagcgtagtttgtaggctgcatctccatctccatcgccattgattcgcattgcatccatcattttaggatgttctactagggttcttgatttttcttttggtttgttgttttgacgaatggaggtattgttgggattcgccgcctgctgctcgtcgtcgtcgtcgccgatgaggaggccgtgcgggctctgccccggcatgtccgatcgttcgtgatttgttttttctacatgttttagggcccatttgttcttgatcctattctttgattcttttgtactaagcattctaaggcgaagccacccattctttcctgcatatatacttacaaacacatagcccccatctgatctcacaaacattatttctctctctttttttctcagttttttctttgttgatttactgaccaaattctttggaagaacaacaagatcatctggtttttatctgctcattcttttgtacatcgaatcatatacatttccattccaccaaagccttagccagataccacagagagagtgtgagagaaatcagagtgagaaacagaggaggaagaagaagaagaagacgaggaggaggaggaggaggagcaggaggaggaggaggtctcttcttggcacgtcgcgttccggcgagtgacgtgtctccgggatgttggcgggttgctcgttctcgtcgtcgaggcatcagatgagcaccgcgcagcgtttcgacatcctcccctgcggcttctccaagcgcggcagccgcggcgacggcgccgccccgcgggtcgccggcgacgccaggagcggcgccaccacctgctccttccggacgcaccccgcgccgccggtcacccagtccgtgtcctggggcgccaagccggagcccggcggcaatggcaatggcgcccaccgcgccgttaagcgggcgcatgacgaggacgcggtcgaggagtatggccccattgttcgcgccaagcggacgcggatgggcggcgacggcgatgaggtatggttccatcaatccattgcagggacgatgcaagcgacggcggcgggagaaggagaggaggcggaggaggaaaaggtcttcttggtgccgagcgcggcggcgttcccgcacggcatggccgccgcggggccatcgctggccgcggccaagaaggaggagtacagcaagtcgccgtccgactcgtcgtcctcgtcgggcacggacggcggctcgtcggcgatgatgccgccgccgcagccgcccgagttcgacgcgaggaacggcgtgccggcgccggggcaggcggagcgggaagcgctggagctggtgcgcgcgctcaccgcgtgcgccgacttcctcttcgccggcaaccacgaggccgccaactactacctggcccggctcggcgagatggccctcgccggcggggcccacgccgatgcaccgcgtgggcggctacttcaacgaagcgcttgcgctccgggtcgtgcgcatgtggcccacaatgttcactttggcccgccgcggaacttcaccgacaacccctttggggcggggactaccaacccattggggctggggatctttaaggccataaaccccattccgagggttcttgaatttacaccttaaacaggccccttcctcccgaagttttaaggggcaccaaacccctccn

SEQ ID NO: 21743 - DNA, 3501 bp, Oryza sativa
agtagttctaatgggccagaggctatcttgtaatggtccttgaacaccaagcgggggctcaagtggctgcgtcactccaaagactgcccgcgaggttggttcctccacggccatgtgcgtatcaccagaatcggccaatcatgccagtaactcaagaaaacaggaagccggtctggcgagagttccacccgcgctcgggcctggcgttcgagttccaccccgtggtcgcccggctcgagaacgcccccctgtggatgctccacgtcaagcgcggcgagtgcgtggccgtgaactgcgtcctcgccatgcaccgcctgctccgcgacgacgccgcgctgaccgactttctggggctagcgcgcagcacgggcgccaccattctcctcctcggcgagcacgagggcggcggcctcaactcgggaaggtgggaggcgcggttcgcgcgcgcgctgcggtactacgccgcggcgttcgacgcggtggacgcggcggggctgccggaggcgagccccgcgagggccaaggcggaggagatgttcgcgcgggagatccgcaacgcggtggcgttcgagggccccgagcggttcgagcgccacgagagcttcgccgggtggcggcggcgcatggaggacggcggcgggttcaagaacgccggcatcggcgagcgcgaggcgatgcaggggcgcatgatcgcgaggatgttcgggccggacaagtacaccgtgcaggcgcacggcggcggcggcagcggcggcggcgaggcgctcacgctccggtggctggaccagccgctgtacaccgtgacggcgtggacgccggcgggcgacggcgcgggaggcagcaccgtgtcggcgtccacaacagcatcacattctcagcaaagctaagctgacgatgaatggtgattaggtgaagagaaagaaagaacaaagcctttttttacagtgcttcttttgttaatgatgattagttcatacagtatgacaattcttttatacattcagagaaaagaaagaagaaagaaaggtgtagttttttgttttatagattgataggtggaaagattcaattaaatcaaattcaattcaatttttagattgtaattctttataaatattcttttggctgttgagagagagtcccctgcaaaatgtagctgcatgtagaagaaagaaagcaaagaagcagtagatagattagcaggggcagcatctctcacagtcactattagtgtctccggctgttattatacaacattattattacaatcaaattctttcatcattcattctacatgtaatctctgttcagaatcagaatgaaatgaaacatgtgttatatttctccatgaatggtaaagtttgtgtcatctgaaagttaaacttccatctttcatctgttattttgctcttgttttgatggtatccaattcaaaactgaattgcattggttgatgtgtcgtccaaaaaagatgtaatagtttgcttcttcttcttcttctttttttggctctctctaaaaagcttcagttttggcgtccgctaatctgaattgtattccacggtcctattaggcctcccgaaatgcagcccatccagcccacccacatctctaaaaggccggcccggtcaggcccatcttcaagaacacgcggcaagccgcgtcaggcgccggcgacctcgtcggttgccgccgcgctccacacgcccccggccggagcggtcaccatccgcttcttctccaaacgcccacgcgcttctcacctctccagatcttgcgccgcgcgcaccccttgccctccgccggcagccgcctctggttcctaaaccctaggcgaagaccttcctccgctaaccggctctggctcctgttcgtccccggcggcgtgcggcctcgctcgctcgaggtgctcccaattcccaaagttacactggtggcgcggcgtcggtttcgctcacacggtgctcgtccaaatgcctacccggcttgctggcgcgtagcacgccctggatgatgccatcacgcactccaaatctccagtattccaccaggtgttgctcaaggcctcagagtacacctattgttgcgggagatggcaagtggtaagtatattcgggcaacagctccatgatttcccccttgctgtatttgttcctctctccgttccaaaataaaccaacctcgtaccggatgtcacacatgatgaatctgaatatctttgtatctagacttattgtactaggatgtgtcacatccagcactaagtttattttggatcggaaagagtacgtttgtagattcacccgtccattcacattctctgttattttcctagcgagaaccgtaagagtagtcatactgcactgaagctggtgcaatcgtggtgtgtgtgtgtgtgtgtgtattatagagttgagaaatcatggaatgccgatagtaggtgaacagcaccgcacttcccaccatattctagtagcatatgctagctcatgacgatgaatcagaactgtttatacttccaatgaaacaatatataatgcagtttatattatccatgtttcatacaggattacatgctgaccgtattgtttcattttccctcaaagcaaaagtaacatctgaatttcttactttttcctgcaaggttcttgtgatgattaaaggctaaggtgatcctgatgttacctttacaggtaagtggaatcatgttcagactttaactatttctatggacgatggctactgtctttcaattcagtgttggtttcagaaattcagttcatctattatcataatctgttttctgtcaccggcaacaatttagcatgcaccaaataactttacttatttttgtattcggtacaccttgtagtatcatcttccttgtaacatatggacattttctttttggtcttcattttgagttgtttaaagcctctctgcatggttctttgatctttgcatcctccttaagatgattgagataccattgccgccggtactgtggatgagaagaaacttggctatgcacttgccactggacacccctgtacagttataccttccgcaatggggcaagaagctaatggacaaccatccaaatcattaccccaccagttcaaactgattttctctagtcctaggcataaatatagcaagacagccatgaatgccaaaccagcatcaagggcacctgaaagtagataattgtgtctctcccaccagtcacgacggtacttatagaccacataacctgacaaaaatgctacaaatatccatgccgtgtagttgactgaagtggcaggaggcatctggctgattccggcgatcagcacaggcatgttgacaagtaggatccatttctgacctgggaatgccttgtgtgcaaaccagacgaggaggggagcaatggcaccccccaagaagaaccagttgacagcagaataagtgcctaaatcaccaaatatgggtaccgagtgagagttcaatcaatggggcata

SEQ ID NO: 21744 - DNA, 7610 bp, Oryza sativa
  unsure (1)..(7610): unsure at all n locations
cggtgattgcatttgaatccacttgtacccgccaccatgctgttccaaggtacacaaatgctgctatcaaagtgcccaccacctgctatttttgaattgctattagggacataatcaacactgaataaaatgataatctgcttatcctccttttttacaagcaatacacccatttattcatgtgactagtgaagctgacctgagccataaacatggtccttggtggaatcttcatgtagtgtcccagcttaaaatcttgtaggaatgctagggcttgctgtgggccaatgtaaccatataccttgaagcacatgtttgcgacaggtcgtccaggatacaagtaccccatgatgtattccgtgatgatattcaagcctggagtctgtcacatacagtataataagctgaagtgctacacttggatgtgtgcattagcatttgcctttatgcttttacttcttacctggtttgtcgttgctgtgacgattccaattggaagggtgaagaaaattgcaagggcacatgcaagtagtaccccccaccagggtaactgcaattgttctatgtaatactcacaagtgaacatggtgattgcaacactggctataaggatggagatgaaccaccattcaggaacctgtttgtacctcttcataagctttgtatgtatgtccatctttttatcttgaaaagctgatctgcttagctgccaaatttcactggacacaggtgtcacaaatttatctgtgtatctaattttacataatagacctagagggagaaggaaggggaggataccttccatggaaaagaagaacgtggacaactggtgcagtaagacatgcaaaaccaagaccatagctgatagaaaagaaggtgctgatgtataatggtccattcttctcataggcttttgtatcaaaatgaaactgtgagtctataatggtagagatgttgtacttctgtccagtcactgtgaaaaggccatctgaaaagatagggaagttttgtgccttgtagagattaatccagtagccgattggtgtgattacataaatgtagatgaagaagccggcagcaatgttggcagtggcaaaccatgggctagccagtgggcttccgagatatgacgagatggatgaccagtcgagtccaattgcaccaatgccaaggccatggagacctgatccaagctgttgtgcgagcacagatttgggaaagatccaacaaatccaggagagggaagtgagcatctggaataggtagcctgggaaaatgtagtaggcaaagctgcacacaaatgctaccaagaagaactgggtgcgtgtcatgccgcctttgctcctccgttccttttcatgaagtgccctgatgaacatgtgcagcaaatctgttattcacttttctatggtagtttttttttagccatcctttgactacggagaaagttattattttactgctaatttgattctgcatttgcaagtgtgtccagtatggctattaagctcacttttcagattgccactgaaagttttagatgaattcactcattggcagagcaacacagatttatgccttattatgatttataagtgtcatctcaacaaaatgctgaacctttttttttatttgcagacaaattgtatccatgtttttctgacaaatcattgaagcctctagggaagtaaacatcttgttttaaaatgtctagtcgggtttactcaaatgaatcttgatattgtataaggtttagttgatgcttgttgctggttgtaactgatcttgtttccttggtcgtaaatggaaaattgttatgccttggtttgggacgaaaaatcttgttatagttttaatagctgctcttcgtctataattgaagtgatatgatattttatatatcttgttttctttctttgaattttatctgtcaaaattgattgactgcttcttttattactcaggatatctccaaatacacggaattctggttttctgcagcagcatgcacttgcatagctgagtgtccaagtcgcctaaatctcctaattgttgcgtagaattcagatgaagatgatgctgggtgggttttattattgaattgactggtaaatgattcctgttcgcttgagtcattatgtcaatatctactttttagacaattcatgatgtgccaatatatctctgcttattatgaatgaaaatgacaaaaccatgatataggacagataatattttttatataattagcatattgctgaatagcagtgccatcgtattcagtgctgttcacacaacatacgacttgaacaccagcttaataaaaacccttatttgtccttcaaagttcaaagtatctttttttttgttgacgttggttttgagatttgggaaggtggttggttggttatctttgggtagtctagcacttagctgtaccttattaacacatcaattgcaagcaactggctgcacacatcatgcgacgcaaaaaaaatgtattctactggtggaaagattactttacaagtggcaattcaactccttttaaccaatcataggcaagctatatctgaataatcagatttatagcacatgtggagagtaaattattgtgaattactatttgcttattacctgaagagggagacctgcacgaggttggacggccaccacatcgccgccggctccaccagataccgccggaatattcccgcccacccgaatcccagcacctacaaaatgaagctcaagttcatgaacatgagtgtacatgacaccttgtactgttattactgcagcacgttgatgtcacctctacctggctggtgaggacgacgaggagggagacgaagaaggagatgcgcttcccgtagaagactcggacggcggtgatgacgttaatggcgaagacggaaccggcaccggcgttggcgaagatggtgatgagcacgtgctccttgacgttgaacgggccagggttgagggtgaattcccacggccggccacggaagaagacgcgctccgcaagcgcggcggccatgaggcggccgagcggcacgacggcgatctgcgccgagatggccgtgacggtgagcggctccttgcggtaccagaagaaggtgttgaggaaggacagcacgacgcaggacgccgtgcccagcacccatatccggaacgtcagcaccggcgtcgccgggtcgtcccccaccggcaccgtcagcgccacttgctccaccggcgagttctcctccggcgagccgagccgcattgaggatcgcactgcacgagaagaactcatcaggcaacagaacagtttgctttcttctagtggtgttccatggcgggaaaaagaaaacagctgagacgactaggctttgccgtgcttacacagtggagaggtgatttggctattatcttgttcctcttcctctccatctccatggccttgctcttgtacttcttggtgatgggaggacgccatggatggataatgggaggagttgggagctgtgccagtgtgccagagagccagagtgcctgcctttgtagctagtagccgtggagtagcttatgtggactcttgactttttgtgcaaaaatctgcctgcatctgcaaagttttggttcagtccatgtccaaggtgcggcaaattttactccggacctgtaggcatcagtgagaaaattgagacacaggtacctaaccttctgtttatagatagattgtagagtttctttttcagctaatggacgaatgaaacggcagatttgggagaattgcgtcgctgtgaggaggacaattcgttcgatccaatgctacaagccttacaatagaggcaagcgggccgtctctttcagcattttttatggctcgatggtatcttttatttatttattatgtacaggataacacggttgattgatgcgatcgtcctgctccatgctgttaggccctgtttagattctggcaaaattttaccttccgtcacattggcaaaattttaccttctgtcacgtcaaatgtttggacttatgcatgaagtattaatataaacgaaaaaaatcactacttacacagattgcgtgtaaattgcgagataaatcttttaagcttaattgcgccgtgatttgacaatgtggtgctacagtaaacatttgctaatgatgaattaattaggcttaataaatccatctcgcggtttacatgcggattttgtaatttgttttgttattagactgcgtttaatacttcaaatgtgtgtccgtacatccgatgtgacacgccaaaactttatacccctgaatctaaacaggcctaggccacatagcccacatcaagcaaaatagttcaaaggtattcatatctaaatttaccacataattttggaggggttttgtgggaattaaactagtttcagcaaaaaacatgtgaaatttctgagtcatggaagcagctgtaaaatttctacctttcgctccagaggaggcattttagaatctccgagaggattacaagtagcaaaacaatgtaagcatgccgagtcgtgcaaatcagaaaccagaacagactactaaatataacaccacgcggaagggagataatatgttgtacacaaatatgtgatgtgcaccaaaattctcccaacacgcattaatcggcaaaattgtctccagaagtatatatatatatcccaatataaccggccataagcatcacatctgcacgatgccacgaattgttttcagctttgatgtttaataactagttaatgtcagaaagcatctcacaaagcccacgcaccaaagttggaacttggaacaacagaaggttaccaatcctagcactatggagtaatatatctagagcgaccaacgaactatcatcatttcacttgaacattcgatgtgatcatgcctacaaggtaggaaaagcgattgactcatgttatctggtccaccgaagaacttgaggtcaagttgtttctaaaaaaacattgagcagccagagttgtcaaatcacctgataaaaggacgaacaacttaacgcctaacacgaccaccaccaggtcctgaacctcccctggggccagtaaaacgagcaaactggagccgtaaatggggtgaattgcgatcatgttcatcgaatttgtagcctgcaaaattaaccatgaattttcatgatttaaaacatggaaattaagcaatcaaacgaacggttcaatgaccagtcaactaccatgtaatttctcactcccaagacaccacagagaactaactcattgcaggtgcgaattactctattttcgtacatgaccttgaaaagttttagatggccactgacaggattactttgatcatgctacaaaaaataggcaatagatgcctgacatgatcatggaacagctattcctttttacaaacaagatctaacagctacctattaggaatcacagtaattagaatacattgacaagcatcataagtggatcataaccgtactgggaattaatatagcttgctaaagttgttgtcaagtgaaggggaaattaccatttgagaagcaccagcgagctactagtaatatagatagatggtgatatctatgccattttctgccagagtgtttccacaggcctagtccccagacaacgcaataacatcttgtgtgtgtgtgtgtgtgggggggggggggggggggcgcattataaaggcagtcacagctatggtaacaatgtgaagcaaaatgttcaggtgataaattaggaacagacaagattttcacagcccacttttagctgcttggccaataactccacaccaattttaaggacaaatacttcagtcgaatgagttctattcaaccataaagaaactgactgtcggcttttagcaaaataccccaaattaccaaccatcacaagcatctatcagatcttggtaaacaaagcatccaaattataagcatgcatgacaatgagataactaaaaacagggaaaaagatagagaagaaaacacacaagttcaatatcatgactcataagacactgataggagagatggatcaacagcttcacatggtgtacccacagctgtcagatttaattgggcattacgcagccaaaagaaatttgagatcaaaaggtgataaatggctcagtgtcaacaaactatagttcactgactcaccttgcaaagcatccatagcaatagcagcttgactagcagtttcaaaatcaacaaaacagagtagaattggatccccaccaggctgttaacagcaaagcacttagatggatgaacaagaacgaaacaagagaccaggcgtgacagcaccaaaaagctcacttacatgtcttgcttctttgcttacaagtctcacctcacgaaaaccaacaaatggtcggaagatatcttgggggaaggtgaaggaccagcagctaagagatggaggcatattatgaataatttacacccacaatttgtgcaaatgaaagattaaagatagacagaaaaaggcatgggatttaaggatacgagaaacttctcgacgtgcacaatcagtaggaattccttcaatgaataatgtatttgatgcatctggtggaaggggaggctctggcatcccaccaccaaagccaatatttctggcttccatgcccccaccagccatcattggacgatcctcaactgggtatccagcattgccacctgccgcaggcctaatagattcagcaccaggtccagctccagctccagctccataggattgaatttgctgtagtacaaaaagaagaaaaaagtgtcagctgacaatgtgtttaaggaattgaatatagtatgtgttaagaacaggttttgataccccagtgcgcagaaaacgttcataggaagcgttaagagcctcagtgtctcttgcaggacgataccctggcctttcttcatcacgagagtaatagccagccatttcaggagcaccaggtacatctatgcaagggaaaaaagtggtagtagtaaatatgggcctcagtcctcgagacactactgcatcctaaatcattgcacaactagctagtactaaaatataactgaaacagcataggacaagcagaattgttgataggtgtcatcctaaatcgactaaatcattccacaactagtactaaattataagtgaaaaatggtataggacaagcaggattgttgataggtgtcatcctaaatcgaaatcaagcacacgcaaaatccaacagtgtcctcagagcgacagtgctaccaaaaccgagagagcgtgcaattttcatggacagcttcagtgatagcgaacaaatgccactgcatcgtcgggagatccactacagtctagcgaagaaacagtaagtacgaaatgcatgatacgatatgcacacgcgatatcacgcaagtgagacaacccagagacgaccgaagaagaacagccgagcattgcaactgcgagaccctaaaaccctataaacagtgaacacccgcgccggcttcagagccgagacgagcagctgccagcgnnnnnnnnnnnnnnnnnnnnnnnnnnnnnnnnnnnnnnnnnnnnatgcaatttcaatgacaggcg

SEQ ID NO: 21745 - DNA, 1567 bp, Oryza sativa
ctcgttctagagggttttgatttcgcgccgagaagagagagagaaaggaagtttgcgtggcggttccgaatggcggagtggagaagaaaaggaaagaaaggaatgacgtgttgggggagaaagccaaaggaggaaggggggaattccggcttttcgggaccctggtggtgctgcactcagcgctcctctgcacgcaccaggcatgacggtccagattgcatctgtcttagggccctttgatttgtatgaaaagtagaaaagttggaggatttgaatcatatgaaaaatatttctatggaagcatttgaaataaatgattgaatcctatcttatctttttaaattcgtatgtaatgggtaatcctcagagattttggaggaaagttagcaagatgtttaacctcttaaaaaaatttctttgagtctatgtttctcatctcattcctgtgtttttcctgtggtgcaatcaaacgatcattcctgtgttttttctgtatttttcaatcatctactccctccgtcccaaaatataaacattattagcatagtgacaagtcaaacatttttaactttaacaattaatagcaaaaaagaagatcaaccatatttatcattaaataaactatcataatatgcaactctttttatttaaaacatcttacttttatagatattgttggtcaaagaagcatctcgaagaccgtgtcaggtccaaaaattcttatattttgggacggagagagtattttacacttgttttttcttattttttttagagaagggtattttttacccggcctctacatccaaccggatatatacggccattgaaatagggaacttagccccgcaaacaacccaatctgaaattcgctccataggagatttgaactcaggaccttagggtactacgcaggtccctgcacacttgtatttttgtcaaaatcctatgttttctctattcctccgtttttctattgctaagatgcaaatggaccctttaccttaccacgacatccgtgaacaattggatataaccaggagtaaattttataaaaatatattttatttttttagaatgcttgatatagttttcgggcacttgtagttaccgttctgcagcggcaagaccagtaaacgcgcaagggaaatcctggatcgtctcctaaggctgcgttctataccaccaatggttcacaactttcctccttttcaaactgctaaataatacttttttaaaaaaattctatacgaaagttattaaaaaaatcatattaatccatttttttaaaaaatagcaaaatataaattaatcacgtgctaatcgctgcttcggtagttcacaaccctaagagcccaagtaccttttggaacgtttaaaactcattttattccacaaattttctggtgaatttaataactgggggcagaaaaatccggactaggtcggccggcaacggcccttctctcccccttttttttattttgggaaggtacactcccccatctgtacttccagtcctcttattaaaacttacgtatctcctctctttaaggaccttagcgct

SEQ ID NO: 21746 - DNA, 17840 bp, Oryza sativa
  unsure (1)..(17840): unsure at all n locations
gtgtccttgaaattgattactaatctgctgcccgcagncgactctagaggatcccctataatcctttaaaaattatctcgagatacctatattttatattttttttacctcaaagtacatagtagctgtagtacctggatgcatcaaattttacattagaaagtatgatacttcctgacacattctcaatgatagtaaaattgtccttcaaaataaatcaatcatgatggtaatgggataaaacttaatacagcaaatctggatagattgatttgtttagaacgggagtataaaaccttccaaaaacaaaagtaacatgtgaaaaaaaataaaaaaaatgagtgataggaaagtcagatgcagtaggtcaacggcccaaaggccaaggccaacggatccattccacaacttacggtgtgttttttttttttcaaaaagtgatgaacaaactaatcctacccactaatcacacacatcagcatctcagctccatctaatcacatcacgtggcagccacaaccgaccgtgatcatctacttactccccaccgttgacattccagcgaagatcattcattacacacttactccgaggatctgacaggtggggcccactgcgtgttcacagacagctagaccagctaagcgccaggtggcgacagatgagtggtcaacgtacggtgtggtttcgtggctagcggagctgatgattgtacggatacctctgagctgttgtcgtctactctaccaaacgagaaatggtttgtttagagtacaaggtacaaactctttagttagagcattgcattcacatatcatttgccaaagttaaacctaggacaaactagtgtcatgaggttttggacagagaatttatagaaggagaataatcttgggtgtgtttagtttctgaaaaaagttggaagtttgaagaaagttaggagtttggaaaaaaagttggaattttatgtgtgtaggaaagtttttgttgtgatatgatgtgatggaaagttgagaatatggggaaaactaaacaatgcccttatcaaatacgctcgatccacacaccaacaaagtgtattaaaaaagaaaacatgttacctgctgaaatatatcctgcacgagatcgacatagtatttgcaaagtaaagcatatgataagttagcatgaatgtcgtcctaggtatcccaaacggtatatttcattttccattgatgaaacaatgtgtggtaaattttgtggtgaaattctcttttttttcacacttcaatactaaggatctattcggtttgtaggattttcatagaaattttggaggaattaaactgttttctctgaaaatcctataaaattcccgtattccgaagaagccctaagttgagttatgagtttttttttatgcaacaagtttctaaaaagagcataatcccattgaatacgccaaatcgatacggctttaacggaatgttatcaacaaaacacatgttaccgctcaaatatattatccgttgatttcaaacggatggtttagatagaaataatgtcacgtagtgacattgctacgtcaagccagaggatacgaatccatccatgagagcacgaagaaagatacacacattatccgatggagtagctttaacaaacgggcataaacaataactctctctcacacacacgcgtacccattactagcttttttttttttccgtgcacacggaaagcctccttgatttggagcaacaaagaatccgggctaaccttttgggcaaagctagctaccagctcgtgtgggaagcttcggctagtggttcacctagtgcaaaatgcaatgcaaattgcaaccacactggccatataattccagggtccagattccttgcattgcattgagcctctctatctttaatttcttaatcaaaaaacggtttaggagataatgatggtgttgctccactttggaccccgaccaacactcaccaacgtccaggatcttagagacaccatcatcctgcagcccaccaccagaattgttctccggcttgaaaacactagtgctacgttgaaactttgcatgattcctctcctttttgagtatgctatatatgccgtttctttcatgaataagacctagtgttgtcgctatcatttgtttgttccatatatgttctcttcttgcttgtattagtagccatgttgtggagttaatttggctaacggctcatatcccatccataaacgacacattcatcaaattcaacttttcatggttcttcctttgaactgtcgtatatactcacgcatatgtagatgcacttcaacattatccttgttaggttactctatccttgatcttaattgccttgtgttgggttttgtcgcggtagcttaagttagctatatattggtgtggtgttgcagttgtggtttttgctcactttctctaattaactgagcactaggttagtcccacttacctcttaaaatggggcaccttcttctttatataaaatatcagcaacgggtctgaccgttaaaaaaaatcttaattggttaagcatgattagcaacaaaaataatttatgcgtaaatctttaagatatgtgtacttagcaacttttaagaatcaactcaaatttaagtttcaaattttaatttttggctacggctagctggtctgactagggaatgtgctaattcatttttccacctccgaaatggacgcaagcaaacgaacccgttgaaaccagaaggaagcaaattaaatgcagtgcatctctctttcgccctcctgtcgctttcccactctggtaggccagccaaccacacaacattgcattagatctttctttcccctgatcaatcacttgcaaaacagaaagaacaaggacaaaaaataataagcaaaaaaaaaaataaaggcatgcaaatggcattgcttaagaacaattatttgtagccccactagaggcacaacttgtagtgctccttaaaccaatccagcaaagagggcaaccatcacacatcggcatgatcaccacattaactaaacaacaaatttttaggagattgggccctttttgtgtttactttctttctggtttttcttttgcttctgtcctactttgcatttgcagttttttgggactccttttgcgacatataattgggtcgacattggaaaaaacagaaggaattttttataaacataagattattttttttatagaatgaataactttgagtgatttgtaccaggatgcgctagctgcttgcatatccttactgatttgtgaaggttcacctatgtttttgcgtgagttgtagaaagagtgtcactacacttgagtgtatctcaaactaccgggtcaaattgcacatctcattttcttcagtctttaacaactttacatgcattgacatactagtaccttatactactcctatgtgctaatacggtcgcagggaaaaaaaatactcgaagtacagactgcatctgtattggtgtctaacggtctgtacccccccccccccaaaaaaaaaaaaaacaaatcccgaaacgcataatttgtacttcgaaaaaaagacaagaccttaccacaactgctgcacctaatttaaaccaaccaaacacattagaacaattcaaagtctcatacatcatcgttcatacctcttcctaactaaccagtctggcgaaaatcatttttttcttctagagtcaacaacaaatactattcactctgttagaacaatcatttaaccaaccaacataaaattgatgttattatatctacatttaaaagtatttgcttatgatcgtaatttgttactatataaacaaccaacatattagtagaacaattgtttatcaaaatcttatcctaataaatcgtcttactccatcctaagattattatgtccagattcgtagtctacaatttttatgcggagggatgagtagagtactactgctcagggttcgacttaccgccggtaaccgcgcggttaccgggcttaccgcgagggtacggtaatataaatactgcggtaacctccttaaattcaaataaatttaaaaaataaattaaaattttgataaattttgcatggttttgtacggtttttcacggttaccgcggtaaccgttgggaaaccctgctactgctccagttagtaacaaaagcaaacaagagcaacaagtctctaaggtaaactccaaagccaaacctagagcaatttaaaataaaacctagggttaagatgaacaatgatttaattaattaattaatggccttgttattggatgctcatttctttctcctaccacctatcaaaaagcaaaggcttccccctccccccaccaacgaataccctcacccctctctctctctctctcgccccacccggatgcctcgcgctgccggaggctgacctcgccgccggcgactccgctcggccgccggagcagccagcgcgcgcgggtaagtcgactctcccccctccgctacgtgctgtcggacgttttgtcgggcggttttggttttggcttctgcgtcgagcagcaagggtgggtgggtgctcgatctgcgcgggctcgagtcgcggggagacttgctcgtggggagcgctctctcaccggaggaggaggaggaggaggaggggttcctcctccggtgcggcggccgcgtggtctgcgggttctctccctggtgggaattttgaatttcgcggcgctccccccatctcctgaatccacgcggttttattcgttttgtttttttttccggggaatgatctcggtggggatttgtatggaaaagcccgcgattttggggtttcgagagcgctaaaaagctttggattttctctgctcggtttgtgttcgtgcccagattcagtggccgaaaaaccaaggatgatgcactaagtttggggggggggggggggaagtcggtgaaagatttcagcgaagaatctcgtctgattccagcgtgtgggacctccgggcgatggcccccgctggcggcggcggcgacgccaagtacaactcgtacaaggcggcggggctacgcggcgccatactggaggcggcgcacgtgtcgtgcctcgaggatcgctacgcgctggggccccagctcgggtggggccagttcggcgtgatccggtcgtgctccgacatggtcaccggcgaggcgctcgcctgcaagtccatcgccaaggaccgcctcgtgtcccccgacgacgtgaggggggtcaagctcgagatcgaggtcatggcgcgcctctcgggccaccccaacgtcgttgacctcaagcccgtgtacgaggacgaggcgtccgtgcacctggtcatggagctctgcgccggcggggagctcttccaccgcctcgaggagcgcggctgcttctccgagcacgaggccgccgcgctcttccgctacctcatggaggtcgtggcgcattgccatagcaaggggatcgtgcaccgggacctcaagcccgagaacatcctccttgtcagcaaatcgccttcttcgccgatcaagctcgccgatttcggcctcgcaacctacatccagcctggtataattgggaattcttgagcaatttcgtggctgctctctgtcaaggctggtgtttcgaagctgaattgggtttcggttttgtcaggtcggagcttgagtggcatggtgggtagtccattttacattgcgcccgaggtgctcgccggtgggtacaatgaggctgccgatgtatggagcgcgggtgtgatactttacatcctcctgagtggcatccccccattttgggggaaaaccaaatcaaagattttcgaatgtatcaggtcgactgagctgcggtttccttctgatccctgggacaaggtttccgattcagcgaaggagctaataaccgagatgctgcggcgcgatcctcgacagaggctcacagccaagcaggtcctaggtgagacacggcctcaatcttttcagaaaccacacactttcaatttcctgtccttgttctacatcactagcatcatattgagaacttggaactgcctttttttttttaagatggaaaatgctcactgactattaatacatgcatgtaactggaattgtaaatcgaaattgatcaaaattttcctgatgaggttagccttgtttactttacatattgaataaattaacaaaacttggctgctaagtactgagttagtgccagcttaagttggtggtctaatttaaacttgcacggctgggggaaaaagctgggttgcatcacagtttgttgtagggtcatgttctggtagatccactgtggtacagatgaactttaaaatttcttggcacttcatcaccttttgtctattgtagccattcctttagttgtgctggttcattctgtcatccttcgtggaatcttttgtttggttgtcattgcatcattcccggaccttactgtacagatcagctgctaatgattcctttccccatttttttgtaatgcttgccatgtggagtaatctaaacaactgttgttacacagagcattcctggatacaagatcatgccgaccaatcccaagattcttgtggacattgccatgagatcaatctcagaggagaggacgccggctcatgttcgttctcgacgccgctggcgtcatgcagccgcgatgtgagcttcaacaccggtggcccggtcgcctgccaaagcatgtctgaagaagcgtgctcccccacattcgcctgcagatcatcgttctctgcatttgtcgctgagaatgctccgtcgtgcgcgctctcggggttctccttcggtggcgtctgcgaaccctgcaacgccgtgttcccgtccccggtcgcttccatgccgagcttctccttcttctgcggccaagaacccggcgagcctgagtcgtcgcctgatggtgacgccttgggcgagaaagctcactgcgacgcgacggtggtggccctcgtctcgtcctcggctccgaggacagcggaggtcctgagggccgccgtaagggcgaacccgtcgcgcgccatcggcatgaacagcaggaggaaccacaccatcggcgccggcgagcgcgagcacctggatgtggcggtcgccgagtcggtgatacggtgggcgtcctgcaccaacctgtcgacgacgcactcgctccgggcttcgctggtgtgctagcattttgtttatctgtgcaattcaccatgtgtcctgtggctgtgagagtgcttcgctagtctcttgccttcctccttgcacctgcgatgcaagctgaaagataagagtgagatgagtgatgagatgagatgagagtgtgagtggtagaatgtaacgtggacctgatgatatataatgctatagtagattaccgagtagtgtgcttgctttctgtttgttgaatgtgttccttatttttggtctcctttgtgcacttgtcactacttatcactaataccatccatcaacatcagcttggtgccatgctctctcttgaatgcttgcagacaaacttaaaccgaagttgacccccatgtaattagctcaagaaacatttcaaatacctcattatgaaaagatgatcgaataatatagtgattattggatagagatgacgtatttgctactataaagcaaagaaaaaatatggctcaagagatgatatatttggatcaagtgattaccaatttatgatcaagtcccctcttccagtcttccagtatctacaaatttgtgatcctatgggcctttgggcctggtcgctgacccagcccacggcccagccaagtcgtcgtcttcctcgatgccgctccaccgcttcttccacttcgcccgcgccggcgccgcccgtcgaacaccatggctgccgccgccgccgcagcagcagtacccggcgacgccaagctagactccttcctccaatggctccaggttgctcctcgtccctcctgcacatccccttctactcgcgtgcacgccaaatccctaaacccctggctcctctccgcaggccaacggcgccgacctccgcggctgcacgatccgccgctgcggccgcgagggctacggcgtcttctccaccgccgccgaggccggcgccaccgacggtaacatttgctattccacctcttctctcggaggttttaggagctcgtcctccgcgctgactcgcgcgttggctgtgtctcgttgcagaggtggtgatggtggtgccgctcgatctcgccatcactccgatgcgggtgctgcaggacccgctcgtcgggccgcggtgccgcgcgctcttcgaggaaggtggcgtcgacgaccgcctcctcgtcatgctcttcctcatggtcgagcgactccgccctagctccctctggaagccgtatggtcgcaatccacatctctccatgttaaacaacttgatcagtgattgaattttggtaatttctctaggtatttggatatgcttccaagcaccttcggaagctccatttggttcaccgaagatgagcttgctgagttggaagggaccacacttcaccgggcaaccgtgatgcaggttcatcagtagtgcaaaccttttctttcagttccttggggatattttggggagccaagagcaaattcgtttaaacgaacatgctgcaattttgtttcagaggaagtcattgcaaaccttattcgataataaggttaaaggtctggttggggagctcttaaacgtcgatgaatcaggaaggtttgtactgatttcgcatcattttccagcgctgctgcaactttatcactatatttctgtatcaagcacacatgcatagtttcttttacattttagtatacacttctgtactggggttctgcgatacatggggattgcaccccaaagtatgatatgaagaatagcttctcatataaagtgatttggggtaacgcatgttccatatcttcatgtgtatgagtgcaccatttgttgtcatctgggatagcgcctatgtttttatttaattttatagaaatgagaatcaccaagatggcaatgctgcactatgagataaattgctacttttattttacagaacatttatgaattttgttgacatggcataggtttaacttataaatacgttagaaatcattttaatgcactgtatactgggctttgtgtacctttgaaatattttgatctgaatattcttttcagccaaccctattaaatgaatattttcttgtgaaggcttctagtgctaagtagagtgtatccagcatgatttttgtttattgattctgtgcgtacttaaaacccatgaatccacaagcaatatcactcaaatattgttctgttatacatctgtatgcccacctaccgagtttgtgatttttactgtctagtatggcaatgatataccaatatggctaattctcatgactccctatcatatgtttactgacaaagaaattcgttttatttaacagtaatactatcaaaatattgtttgcagctcaattgaagtgcggttcgaagacttcctttggtatgtataattatgctttgcatttgcagtgataatgtcatattataaggcttacatttttttggggggaataatataagccttactgatactgtagtttcatagtattgacatggcatatcatgttaatttcgtgtgcaaaagattcagtgtgctaatttttttttggacaaattaggcattagtttacaaaatggtggggatgtttttgtacctagcatcaactaacctttgctactattacaattttcaagccatcaaggtggaaattagctcattcataagaaaattgtacttaattgggtgatggctttgatttgcagctccttcaataaatatcttggaacaacagttttatgtcaacaaatgaaaaatgcaatatacacatatgatgcagggtccttcacatagttgctggttcagttccctgctttctttgttttatgtaactcagcagcacgactctatggcagggcaaactcaatattctggactcgagcattgaatataccattgcctcgtttttatgtttttccggaatcactagacgaaaagcgggccaacattggtgatgattgtggtgattctagtctcagtgcccctcaggttaattgcattttttctgaccgcagatcctagcttcagaggttcttctcaattgttttatttacttattgtgtgtggcttaattttttcccctcgattatatgtggtcatttaggtttcttttttgctcatgtacaacctatctgaaaagtgaaaaagaggttaaacattggttacatgactttttcttgtcatgaaagagtagcataggaccttgaatggaattttgttgtcaagagagaggaacatcgcataggacctttcttggccctgaaaatttttcataccaacagagaaattctgttactgaaggcatatagtggtctcaaggtatgtgccacaaaaaaaaaaaaagaaactgaatgggggcaagaatatgtttctgttgaacaaactagttgcataactggatattataacacggaaacagggaaatgacttttatattataagttgtggttttgttaattacagcagtaatctacaattatcttaaacaaaatatacttgtgacatgctacaatttgtcctcaaggaaacgccatatacttttgaggactcatcatatactttgccaatctcgtgaatatagatccaacttatctgacaaatcattgtttataattatgccaaattgtatttgtttttaacatctcaatacttcaattaatttgttcacccatatcttcttgttccaaattttaacatgctaactgtttgtttccagggaactgggactgccattacagctaagaatatcagtggcaatgataatcctaaatcaagtaatacagagtcaatttgggttgagggccttgtccctggaatcgacttttgtaatcatagtaagagttctaataaaagtttatgaattatgtagtatagacgaaatatctagttggcagatcattctatattcaacttttgacaaaaaaaaaactgtaggcgaatttgcaaggatttacataaaaaaaattgttgtactgaaaataaatactcattgaaaaaacatgttattttcagtcttacataggtatatcatatttttcagatgtaaaggcgctggcaacatgggaagttgattccatgggacatgttactggatgtccttcttcaatgtaccttgtactaggtacataagtagctccagtttccttttgataagagaacctcatgatctttcctttaatcaaatattttgatataagattatagttccaatttatgactgtttatttttgtatctccctctagctgataaaagctttgtgaaggctgaaacagagatctgcataaattatggcaacaaaggaaatgaggtattactcacatagttacatatgtgcagatctagtctgactagtttataagcaagtgtgttatttttctcaagttgttgctcttagttttatcgtacttgttattgtgtgacttggattgatgtcactgtttcatattttcgtgtatactcattctgacttctctgtcacgatttctctatatactgatacgggcattattgatatatagccaaaatagaactacccacaagaagattcttttgatttgtgcatttagatattggttgcacttcagacaaacaatccaggaaagcttcattagtgccgtcaccctggccattctttttttttaaaaaaaaaagaaaagaagaggaaggacatatgacggtgatgaacttcttggagctctatggccccctttgtttcatcactgggcctggtttgatttgatttcttcatggattcacatatcctttagttccttatggatttgcattaaacacacttgctaatgttctgaagtataaaataatcttactttggggcttctaactgatagatgactttgagactcaatagtcaacgaaaagaagctgcagcgctgcagtcttttgttccgagaaactacaaaatgattaaatgtcatcaaatattcataccgtttatgattactgaaatatagttgctgatgaaatgacatagttttgtttacttgcaggaactactatacctctatggatttgtaattgacaacaatcctgacgattatctcatggtaacactcagtaagagattacttttagcaacaggtgtttgtcaactcagttttctttgtttagcatattccctgccagatattctctttctgtcaaacattatagtggcaaagcacttgtctgtcttgaaacattgtaggtagccattacttaattgttctccagctaaatattgtaagtgtaactctatcggtgttctgggatacataaaggaccaaacttttagttaacattttaaaagataagaaaaccattattcactgagaatatctcctttcttttagttcaaattatgaaatcgtatgtacccaccctttttcattatcaaagttgctgattgtttgaagtgctccacatgttcatagtgataagatggcttatacttgatatttcctccgtttggcgtacttccttaagaaagtagctacttgtttgaaataaaaactagagctaacaaacgttccaaatgcagattcattatccagtagaagctcttcgacaggttcaatctgctgatattaagatgaagctactggagatacaggtagcaacatttcttagctctagtttttatttacgatatgaagaatgttgtgaaaaatttaggcccaacaagtatccttggacatcacgggtctcactttccatatcttctgtgtttacagaatgccgaattgcgatgtcttttacctcgtagtttgcttgaaaatggattttttggtagctgttctggtgaaaacaaggagaacaaaaataatacaagtcctttttctagttatagctggagtggtcaacgcaaggttccatcatatatcgagaaaattgttttctctcaggaatttataagtaccctgcgtacaattgctctgcaagaacatgagcttgagcataccgcttcattgcttggagaggttagtgtttttcacactctgtaccatgtgttcaaaggcatcagttgcatatgtgacattgccttgccctgtcctttttttttttcctttttcctttgggacattttagtaccccaaattttacatgacattgttcgtaaccatctaatctgttgagaagtggttaatatctttttcataaaggggactaatgcctggggatactggttaataagatattaaccacttctcaacagaccatagagttgtcttattaaccagtatcctcctgtacttgtactgtaagctggcaaacagtatttatgaaaattagcgcatttgctttcaaactaaaatattatccatgagtccaaaattttatcacacatggtactaattttggcagcatcatcaatcataatttcttggtgatataaaaaaggttgttttactcatctaaaaggattaagaaagcttctcaagaagcatttaggctatctagtttcacattttctgatatgaccttaatattcacatattatttattttccctagttttcagcattattctgtatgagcatatttatttcatggtaaattgattgtagaaatcctttgaatctgttcgtgtagattggatctaatgaagatagagatgatgagctccggagtgctatatgggaggtcagtggtgataatggagcactgagtttgcttgtggatcttcttagagtcaagtaacacacccacaacttgagaaattcgatgtcagtgtacctgtattttttctatggcgttgtcaataatttattgatcaagcccttctcttttgcaagaatgactgaacttgaagagggcactggaactgaagcatctgacagccaactacttgagaaattcgatctcagtgattcagaagacgcaacgaggtagggacgtagggccttttgacgttgcttaatggatacttttttctgcatattagcactatcatgcttgacatttccatctgtacacctcttgtttttgtgtttcaccattactctcattgtctttttcacagaagtgacgagagcaacgagaccaagtcaaaagtaaatattaggacgtgcatagtgtaccgcagaggccaaaagcagctgacaaagttgttcttgagggaggcagaacatcttctggagctgtcgtcaaaagaagagaactaaagaaagcaaggaatgaaggatctcatcgggtgcgcatttccctttcatgctctctaaattacagccgttagccatagccaatagttatgctaccaattcagctgttttcttctgtagtagtagcgtaacccttttcagtgattttactgaaaagaaaaggcgtgtgttactgtagccattatttcttggttttcagaagctaattcaattaagaaacagaaaattgctactactaataaaatgcttcatgtcttctgatgaactaattcagaatgtatggctgtacattgaagtacaaagcatagactttcagaggtgaacctcactataaaatactactacctccgtttttcaatagatgacgccgttgactttttttcacatgtttgaccattcgtcttatttaaaaattttatgcaaatgtataagatataaatcacacttaaagtactataagtgataaaacaactcataacaaaataaattataattacataaatttttttgaataagatgaatggtcaaatatgtgagaaaaagtcaacggcgtcatatattaaaaaacggagggagtactaaggttgtgtttagttcccttcaaactttcaacttttcggtcacatcaaatgtttggacacatgcatggagcattaaatatggacgaaaaaaacaattgcacagtttgcatgtaaattgcgagacaaatcttttgagcctaattacgccatgatttaataatgtggtgctacattaaacatttgctaatgacggattaattaggtttagtagattcgtctcgtagtttacatgcggaatctgtaatttgttttgttattagtttacatttaatacttcaaatgtgtgtctgtatacgccaacgtttttttgccaaaacaactaagggtgtgtttgcaagagcaagttctcaacactcccctctcgttttccgcgtgcacgcttttcaaactgctaaacggtgcgttttttttttgcaaaaagtttatatacaaaagttacttaaaaaatcatattgatctattttttaaaaaaaggctaatggttaataatcacgcgttaatgggccgctccgttttccgtgtatgggaatgggttcccagcacccacctccaaacacagcgtaagtccttttctcttaataactatgctgctgaagactaaaatttcgctactaactctattctaaactataataatctctgttttaaaatatactaacctattagggcagtcccaacccatagtgtccataagcggtatctatggtgttatgtcaataagacatcacaatagaaactacactctacaacctatggtttcttaaagtgggccattaataaatacatcatctctcttctctaccaaccatattaattcttcatctattatgaagacaatattctcttccaatacaaaaaacttgatagtgtctggtacataggttctcgtgttgaagctgtgtcttgcatgagacccagtttcttcctctcttcactctctctcttaattaatatagtgccacataagctaaaagtcccacatgtcaatgtagttaatgtcatagacatcatcctaggtggagggttgggactgcccttacagacacatcatttgtcccttgtatgccttgtttaaattcatagtgctaatactgggttgtttgagacggattgaaaataccactgttaagagtattctccggagtgacgtggcaaagttgacatggtcgctgccatttggccgtgacggtgactcaacatgagcgctagctggctggctggaccatatccgtatccagccgtccagcgacgtgcacaagattcacagaatcctactcctcctaactagctagcgccagcgccgacccccctaagaccttaacctttactctactgtctaatctattacaattaggattaccacctaaacaacaattctggtgtcaatcgtgcagagttgcttcctgcttcgtgacatcttgtcgtcgtcgtccgctgcgccgcccgcggaaacgcgtcttaattcagcgatcgattagggccggtgtgtgtgtgcgtgtgtgaccactaatctaatcgatggattacctactataattgataattaattagaccgtgcaatcatccgtcgtcacatgatgtaatcactcgcacggctccccgtaatgagtatcttaagctctcggcaacatgtgccctttactattagggttacattagtactcagcacgtgccattgccgagtactcgatcgtatgcacggacgtatatatacagccatatatataagcacggacgtatagatacgaggtgtttttgcaaagtactcgtatgatactagtacgaggaaaatatcatatacagtatatagtacttattctcgtaggcgtaggcatcgaaccaccatcaatctggtgcaactatctctgcttctccagctagtgcgaactgatccgaagcttaaaaaaaaggacgaagtgaccttcccaacgtcctgaatttaaatatatatagaagcgaattttagattgggttatttaagaaataagttttctgattgataggctaatttgctaatttaaaaaggttgcatatatgaggccgagtaaaaacacccttatctcaaaaaataaaaaaaaaggacgaagttttgatccagtaataactgagctgcgaactacagtttctaactaattgtagaccgatgatagcatgataaacaagtgctcaatctcacttaaaataaagtgaaaccaaattctagtacttacaagtactgctaaattttgtctgccaatagcatatatggtacacccattttcttaattattcttttataggatgatgaatgatctcatttattcagataagcagtagcactcactaatttatctggagctttcatttgtcttaacactccaaaaaaaagtgaaaatctgaccataagcagagctggcattttattccactccacacaaaagagagagagagagagagagagcatagcaattatacttcttttttgcatgctgtccctcgtagtagtattacaaatctcgtaatctttatttcctccttctagaactccctaccagctcagccattttatcttggaaaaaatataaaaaaaataaagaaggaaaaaatctccattaatttctcctacagtatttagctgtataggaggagcaaagctggttgagctcaaaactgctagctccaactcgcgatcatcagtagctccagagtgtgacgtcgccgccgccgtagccgccggcgccaccatcgtcgtcgccgtccatctgccagctctggtactcgccgccgccgcccatcccgtcgtagtagtaggacggctggtcgaagtccatgttgccgtagtacgcgtagtcgtagctggacggcgtcgccgccatgtcgtcctggtactgcatcatcatggacggcaccgtggtggaggaagcctccatgcggcggcggacttgctgcggccgctgncgccct

SEQ ID NO: 21747 - DNA, 2512 bp, Oryza sativa
  unsure (1)..(2512): unsure at all n locations
cccgcganggtaagtcacttgtttccgancattcatagaaaaggaaaagaaaaggagatttggaggaggggcggcgcgcacgtggcgggacaggggagggcggcgagagctgagctggaattggctggagatgtcgaagggggagatggaggtggaagaagaggcgtagtactacggcaataacgcgttttggcggggttgacgtcacgtgagctgagagcccagagcgtggcgtccgcgacggatggaacggtgggattcggattactacgagtacttcgctaggtgtcggggtggaaccgtggaagtggaaaactcaaaccgcgagagggtgaggtgacagcgttaagcaatagtatatgggggtggccacgtggagatggcgacaaaggcaagcttttgggcggcggctgaccacttctgtgtgtgtatgagatgcggatatttctaccccttcgttccgtatttatgagttacttcctctgttttataatgtaagtctttctagtattgtccatattcatatagatgttaatgaatctagatatatatgtgtgtctagattcattaacacatatatgaatataaccaatgtttgaagtcttacattatgaaacggagggagtactagaaaaaatatcgtgcgttgcaacgggtgaaatctattttaattatatagtttagttaagataaaattcactgtgggagttcacttggatatatatatttttagaaaatcatgagctaaagtttggaatccgatcgtctcaatttagcatgtgagttattttaaacagatttcttatatgattccttttgtatcatacaaaagtgaacgatcttacaaaccaactcaaatacggatatatattttcaaaagcaaacaaacttaaaaaccgactcatacacagatgatgtactagaataccggcaaaaacatcttcaattttataatagtagagatttttttaagtcaaactttaagcaaaatatagtaatgttttttaatataaaataaacattatattaaaatatatacaatgttaaatttaatgaaatttgatgttgtacatgtttctttttttctatatatttgatcaaacctaataaattttgactaagaaaaatatcaaacgatttataatataaaacggaaggagcactattttctatttttttttaaaaaaaagaaaaactattttccatttcctcccaatggagacgtggagtgtgcggctgcagtgctacagtacttatgccttcttccttaattggcaagtggcaactgattgtctctataattaattaattgattaatgtttatttaatccagccgcacgtgagggagtagctggttggtctctggcaagttcaatagtatagccaactaataactaccattcatctatagccaatataatagctcattcatataatagttacatattacactattaatatatggtcccatctgtcatacacactgtgtcttgaagtccgtgctacagctggctataaatctgtagcctgctaccattctctctccttatttatttttttaaaatatgtttgtagctggtttgtagcctgctatgctatggtacctgctctcaggcagcagcagtagcagaggcagacacaggcagtacggactacggagacggaggcagcgacggttgggttgggcggccgcggcgccgcccgcgcaaacgcgtcgcctctctacggagtaggagtagtggagtacgtgggccggtggccttgcgcttgcgccccggatcggagccgcgcggcgattcgccgatggattccttcccaagtcccaacgaacccatcaaacagcggtggatctctcgcggttttgggcataaaatcccatcgactcctttccactcgctgctgtgcctttttttgttttttttttttggtgattgacacgcgctcctacttcaaaccctagcacgtactactactgtacaagttctttcctgccacgtgaccatccagatgccaagggaagcggacaagcgggattttttttcccttttacctgttctagttaattttttttcttttaaagttttgagaaagtaattggcaagtgaggctttatatgggtagtgagattgtccacttacatccctacaagacaatatcttatggtctacgtgacacaatataccttgttgagtactaatcaactgaaaataattttacatggagatttttatactactattcttattaatgaattatacattgggctatattttattccagagcttcattttggaccatctattctagaaaatgtaacattccctagttttaaagtaaaaaccatgaattaagaggtgatctaaagtaaacctgcgataacaaaaaaaaagatactcagatcaaggtgcaattcactcttaacacaatttaactaaagcaacaaattaactgaggatatatggggatcctctagagtcgacctgcaggcagcagacttaagatatcaaacgcg

SEQ ID NO: 21748 - DNA, 8361 bp, Oryza sativa
  unsure (1)..(8361): unsure at all n locations
cccgctcttganatagcnnnnnnnnnnnnnnnnnnnnnnnnnnnnnnnnnnnnnnnnnnnnnnnntgagtactggtattacttcttctagtatgatactgatgcagcactctcttcgtattttaatatataacgccgttaactttacaacgctggaccattcgtcttattttatcatttattttattatgacttgatttatcttcaaatgtttttaaagcatgacataaatacttttatatttacacataaattttgaataagacgattgatcaaatgttaataaaaagtcgacggcatttttttgttcctagtaaataatatgaatagagtactactttaggtaaacacatactccctccatcccataatataagtgattttgactttttttacactgtttgaccactcttcttattcaaaaaatttgtgcaaatataaaaaataaaaaattatgcttaaagtactttggataataaagtaagatataaataaaataaataataatttcaaagtttcttgattaagacgaatggtcaaacaacataagaaaaaatcaaaatcaatattacggggcagagggagtacttaaacacatggagtgctgaaagtagtagtagtacgtggggcggtggccggtgtgcccacgcgccgccgctcgtcgctcctccggacggcctctccatttccttttgtgtttgtttctgctgacggcggcagcggcagctcacaggtgtacaacgccactgacacgtgtccgtggtccaggtgagacgccgtcgcctgccggtggccacgtggcgtatgctacggccgtcggtctctgacgactcttgttgtccttgtgattggttttgcgagagcaccagccaagcggtcgccgtatctgtcacgcccggaatttctatccaaaattccaaacgcttacatgtgtgtgaaccctcgtctaggaatcagccgaggcacacaataacaaattgataatagagtacaattattactttaattaataagcgaataaaatgtcattacagaggtagatagttcctctcaaacaataaagatctaagcagcggaaaaataagataaacggcgcagacggctccactccacaggcagcttgaccaaggttacacctaatcctccacaccatcagccttattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttaataaaacagttaagtattaaacaatattaatccaacgctatacaacataccttgttgtataggcccaaccattctgaacaaccatcccggctgcacagttctatctccaaaccaggaatgtaccattccaaaccaggagttaatcaaattattaccaattatagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttacataacacaatccaccgcagcgcaccttcctgaatcataatcacccccttataaacaatgcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccgaaagtgtgctaatgtttctaagcatggctaagcaatcatacctaatatctagttgaaccaatatatataaagctcaactagtccaattataataacccaaggtatcaaggaataaagtaatcaagaacaaaagggctataacaaacaataggttaattccacccaatgacattcgaaaataaatgcaatagttgaatagaaaccatagctttaaatgggatcaacatgctcaaagggttgtttgggatctgtgtgacttgccttgctggccttggaactcttcaaactcttctccggtgaaaacggactctccggaaacgacggaatctaaacagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttaaattgattttaattgaattatgacgcaataataaattatttttgaaaaggaaaaagggatttattgcgtcagcgggctagggtttcggtggaccgggcgcacggcgacggttcacgcgaacggacggccgagatcgacttgatccaaaacggatggccgagatcgaacggtccacgaccggttcacgggagagggcgatgatggcgtcagcggtgacgtcaccaccggcggcggcggctcggcggctcgggcttgcatgctcgccggcgaacgacggcacggcggcgcgaacggaaggcaccaacgggtagagcgcgacgcggcgaactcaccggtgaccaaaagagcggcggaagatcaacggacggcgacgacgacgaggaagaagcggcgacgctcttcgggttgacggcggcgacggtgctccggcgatcttcggcgacggcgaaggggcggacgaggacggagacgcgacggcgaccacgatgacgaccttcccgagcgacggcgacgactggaacggcggcggcgcacggctggagcgacggcggcgctaggtcccatgatgctagagcgtttccgacgacgagaggcgaaggcgagggtggcgacgggtaaaggagagctcggggaaccttttaaaggggctcggaggcgacggcgaaggcccacggcggctggcgacgagaaggaaggtttagggttcggaggaaagagacgaatccgattcgaactcgaatccaacgatttccaaaaagaattagccgatgattccaaaagagaaaaggtagagaagatcccggagattgtttcccctctatcaattcggccggagaaggaaaggatcgaccgaatttggaaaggaacggcggcggcgcgaaactagggtttcgggcggcggcggccggaggtagacgacgaccctgacaggtgggccccacctgtcagcgggcgaacgcgtgggcgcggcggctgcggactgggccgaactgggccgaggagagagagaagggttttgggccgactttcggcccaaagccaaaagaagacttttaaaacctttttcaatttaaattattccttaaatgcaattccatttattaaaaatacttccttagctcaaataaatcccagaaaaatctaggaattaaaggattaagcaaagtatttaatgaaattttatctggccccattttatattggaatttattaattaaaaaattagatcttctcttctaggcttttaaaattatttctaaaaattccaattaaacaacaatttatatattttgaatttttagggtgtgacagtatcgcttcataacatgtggacatatcccctaaaaaagaacatgtggacatacaataatgataatataatactctctccgtctctaaaatttaacgcgcgttgattctttttaacatgtttaattgttcatcttatttaaaaaatttaagtaattattaatttttttctaatcatttgattcatggtaaaatactgtacagtgcttacattacatatcaaagtggctgtttgcttgcttcgatcggccatggcttaactctcgctagcccgaccagctgacgcgcactcctcccccacataaaggttatcgatctatttgatctatggatggattcgtgagtcgatacacttaagggcgaagacagggaggggcgaagggaggcacagaaatattattttgtatggtcaaaatatattatatttgctatccatgtcaaatactttaattttacttaaaaaaatgcccgtgtgttgcaacgggtgaatgctattttaatcttattatagttcactgtgagaattcgcttggatatatatgtctagaaaatcatgttaagtttacgtgtgagtttttttaaatagatttcttatatgttatgtatttccaaaaataaatgaacttaaaacccgattcaaatacggatctgtatttctaaaagcaaacgagcttagaaaccgactcatacacggatgacgtactaaatgtgccggcaaaaacatcttcaatttttataatagtagagacatgtattgcgatgctttttttttttatggttagatctttttttcactcaataaatagcttgtcggcgacgacagtggacaaggaacgcaaacggaggcccacgagctagctatgccggcccacacaaactacggcccacagaaaaagccttcctccacgatgcaccgaaaccggacatccattgctttcacgctacacacgcaggaagcaagcacagcatatttaaccactcatcagtctcgaacaaggcacacaaacagatgttgatataatggcaatgttcttattagctagtcccaacactaaaccattggcaaacaatgcaacatttttcccatgctaagtttcttattttttgtcacaagtactgcaccttaaaattacagctgcagcaatccactagatcatcatattaaccataacccacaaaggattttcaagtccacatgagtcaatcaagcagctccacttttatttcttactggttgcaacattggaactgcccactgacaccccttcaggtggatcacttggatttggctggggctgggagcaactgcagaggaaataagcagatcaaaatgaaagtttcaggttttgcagttgctaactctaaacagacgatagtccacatgacaatatgtgagagttaaggtacctgatagcaagcaatgagtgagctagcaaatccaaacgcccctgtcacacgcggagtcactttcttgggagccagttgaagcagccctatagcaacaactatgtcgaggctcgatttgatgagagcgagacgcctctcgttgcacttctgcagtttcatctggtattgctcgttctgccaataccatcacacgccattatgtcatcaaaagcaagatgtgaaaattgtggttacattgagctatgatcatataagacggtacctttaacagctcctggtgtttaagctccttctctagtttcttcatcgacttggatagccgctgaagctcggctacctataatgaaatactagtcagatggtattctcttgattgtaataatatcaggggcaggattaaatagattctacagtctgaagtctcatacctcaataatactagtacatgtgttagaacccaggaagcaataaaatgctatcttgctgaggaattctgctcgctccttgttctgtacaaacaattagattacctaccattaatttctactgtcaacatctaggtatgataaaaccatatgctgtatggtgcttatgtatatcagtaatgatgtgaagagaaaatcaaaccttgtatattcctgtccttccagcccatacaatttggtccagaaagaggaaagttgatagcagtgcattcttcgactgtggatggcacaaagcaaaaagatacaatgagaagtgaaaaaacgtatctttaggttctcagagttcctacaaggcaatacaagcttcaacatacctttccaagtaagatcaggggtagtggagttcctttggcaggaggactaatcaaagcatgcagatcattaacaaactgcaaaataatgtggtgccacagatcatgtcaaggtatgaaaaaatagcttctcatttgcaatatctactgcggacaaggattaaaactttaccttaaaaagtcggaaaactttacgagctagactagtcgacttgtcaacattctgtgcaggccctggttgtccattactcacaaatttcgagccatattgtatagctctacagatcttatctcttgcttcagccttgtttaggtataaaataagcagagcaagatctgctcttgcactctccagtgaactcatactgtatagctggtgactgcatcggtgataagatgttgggtcacaattatagcagtgaatagatgagcattaccgtgacagaatcagggacacaattgaagcaggaaaagaaacaaattaattccaaaaataatataggctcagtcgtgatctctgttgcatagtgataacgaagaaattgccaaaaccgaaagcaatgtaacagggctaacagctaaaggtttaaagaatctcggaaaaattggcagtagcagaataaggtttgtcatcactcatcaggctacctataagactataatttaaacagcaggctctgctaaaaaaaaaggagctcatataacctttagcacatattcacaatttcataaactcggtaaaatttacagtggcctgtaaagtagcataaaggttaactcaatgacatgtgatttaaatttgattgcatggatacagtttaagaggcgtgccactataaaaggtggtgattttgagaacacctagacagtgaactacaccccgacaactcgacaagtcacttgactaagttgatgatagctaatccatggctgggagctcggccccttccaaaagctagactggaaaaggtcaccgtagctgatgaacggcggcatggacgcacaagaagaagaccaaaagggtaaaatcgaatctgtaccaaatttctccacctaaacaacccccgaactcgtacaaaattaggccgcagaagaggaacaagccgggcgcatcaaccggcgatcaattcgagaggaattcctctcctcctccccatcctcgctgctcgcgagaccaaggttggcaagaacgcgcgtggcgtggcgtggccgacgaagcgaaaagaaattagcaggggaggaggaagagggcgggtcgtacctgacagaggcgatccgctccgcgcgcaggagatcggcttcgacggcggcggcggcgtggtgcttggatgaaatcgctgctgccaaccgagaagcgaagttgtgatttattaggagaggagatcgggacagcgactccaccctctgcacgtctaataatttgctacgcgcacttgggaacgtacccgcacctgttttgcaagtccgtatgatttgtgtactccatgcaagttcaccgaacctaggtgggttaccgtcaccccacgctttagcggttactgtgataatcgtacgattaccgtgaaaaccgtacggttaccatgaggtatattgtggtttcaaaaactgagaaggtttatcttatatgacaactgcacgattttgaaaaccccgagtctccctatccaaataattatttttgttagtaatgtcacgtctcacaatagtaaaggtacattatcttattttgcgggattgtaaccattatgtttaatcaataaagcctaaccctttctttaaaaggtaactaaaatattgtgagaccattatgtttaatcaataaaaccactctacacgcactcgcttggcaagcaagactcggttaccgaggtcctttctatggatttgagagatcactttgctctccgcctgtcgtcgattatggctgaacaatttaactaccttcgtgttctcttgactgagcataccacggcaaatgacagacctgatgtgagaaactcgaaatattctagtgacattctgaagacgagccacctctatcttgtccaacgcagtgaactgcctccttgcctcaattggaagtttatctggaacaacaaagcaccgctcaaggtccagttcttcgcctggctccttgctaaagatcggctcccaatgaagaaaaacctttgtaagaagaacattgtgtccacccccgcctgtgatctttgcaactcggctaaagaaacggcttcgtatctnnnnnnnnnnnnnnnnnnnnnnnnnnnnnnnnnnnnnnnnnnnnnnnngcgg

SEQ ID NO: 21749 - DNA, 1055 bp, Oryza sativa
  unsure (1)..(1055): unsure at all n locations
cactgcttgaattgcagctctgtacctaatttttttttctaatgtagaagtatagtcagtgtcaaatgcttttctatgaagatgtgccaacttagcggcggcacatggccccaaaccggagagagaaaaacccattagcacaactttattataacattttttttagctatttatgtgcaaaagtaagttgacaaaaattcgatgatcggtatcatgtgtcaggtatgtgctttgatgattcatcttgttagtgcgtcgcatgcctcatgcccacgcacataaaaaaaaaagaagtatgcccaattcatgttcccttgattttttattcgacatagaatgaagtaaggattatacatgtagtttttaaaatttaaccctaaattacatttactctagactctaaatttctaaagacgaaactaagacaagtccttattgcttaactttagaaacaacttgttttcccaccgggaaaaacttgaaaagagtttgtttgaaaaaaaaaggttgtttttcttttatctgtttttttttgaaataacaggaaaaatcgtttttcgtgaggtggatggagtatccgggatccctgaacaaattgctgcttcacaaaaaaacaaaaaacaaaaaacgtagcaccagtagccgccttttccccatctccactggccgccgccggcgacatcgccggcgccgccgagctccaccgctccgatcccactccgaacagccgagctgcggtttccaaggaaccgcgggcgagccgagcccgacccgttatcagccccgtttttttaacggggcagtgtccaagtccaactccgcctcttccacgctttgggtttcatccaatcatattgcatcgtcgtcgccggcgagcgccatgaggccgacctcccgatactgggcgcgggccaacttcttcgggggttacgcttacgctacgaacccttgncgggtcgccggttgcgcgcccatatttcggcngggcgncgaccgtgccgaggcctctcccgaagcctttgtttcggaggctttgggccgaattggttgggttt

SEQ ID NO: 21750 - DNA, 7519 bp, Oryza sativa
  unsure (1)..(7519): unsure at all n locations
cggctgacttcnggagaatgtagaaatagtggaatntcttattatgaaaattttggttttntccacattcgttaatttataaagtggtntaannnnnccnnncacggtgattgcattcgaatccgacctgnacccgncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttagacccatgatataagaagagatacaaaatgtagaaactaaaagaaaaaatcattatgcagcagatagacaactatgtttgcacaggccccagggagctcttactactttctagcatactaaacatgtaaccaacaataattacatagctctgactggccataagacactaaaagaatgttgataatagggcagtcaaaatgtattgaattaagacagaacaatgaaatgcgagaaatatccttcagtaagattggtggagccaaaaatgtaccataccaaataattggtagtacgaaaacctaggcaggtttgggcactaccaaatttgatagggtatagtactgctaattagaacttagaactagtgtggcaaaatttggcaccaaaccaaacatcaagatgacacaatttaagttgccaaaactttggtagggcaaaatttggtactaatccagaccagcccatataactaagtctgcatctggcaacaggtggctgtttagtactactatactacatgtgatactccatgtattgctgcaggaatttgcatgtagaaatcaagaggcagacatggaggtgcaagatggagaaaattaaacagaatactgtcaatgccagatgaaaattattgattttattaccatgctcactgttatcttctctagactactttgtttggaaatcacggaaaagaagagaaaatgatgtgatcatgttggttttagttttgctaaagcttcatcctgatcagactccaaagactcaaaaaaaaacctgagatatatctcatccttggcagcgacgaaatggaaattatgcagccagtgccaaggccaaaaatgcccaaatagttggccttttcagcatgagcagcaggaggtgggctaaagcaatgcaaccaagtcgatgacttaacatgcacctaatcagcagtaggagcacagaagagtagcgtttaaaatgagctgggtttaatcagcatgagaggcaggagggaagttagaatgttaatggttcaaatattaattctgacagtttatgtgttcttgaagatgtcgcttcactttaccaaagggccaagtagttagtgcatgaaaagtatataagaaataggatgtaggtgataaggacagactaaccttggaattctcaagctatagtgtctaccgtactttgcatgcaggcatacagaacggtcagcacacaaaaatgcaagttttgagtaatcatcaccaaggacctacagaaagatgcaatatgtgttattagatagaaaatatacaaaaggaaagatacagaggttggcacctacaagcatagtagacaattttgagcagttaatctccaatggtttgtatcaatgtggaaatactttaaattacatcccacgacaaagcatgaactcatagcggaaagtataaaactctcataagcaaaataaattcaacagagatgtactacagtctaagttaacaatctaatttgttacacagctaatgaaaatgcaagtttctgatttgtggaaaattcaaatgtcttctccatagtaaaagaggaatgagcttcactagagcctagtcccacctggaaatctacaatttctgaaatcatgtgcctctcaaacttcattgataactccttcaattcatagactttaacttgtggggggtaaatacctgacatcatagacagaagaattccacttacatacagaggtgtaaacaatctgatgaaagtgacaatactgaaacacattaaaggtgaagattaaactaacaagtgatattacaaactaaagaaaaaaggtgtagagcatgaattacatggattgtttctgaaggcatgggattattcaaagttggactcacaataagcaaacataaacgcaagcttctccaagaaacgccttagtggtttaaatgttttgactctgacttcaaatgaagcacaagccaaggacatagtagggggacgatgaagcgcaagccaatgacatagtagggggacggcagcattccacgataattgtgtgatgctccaatgccaactcgcacccagaacatgagctttcatcttaacttcgctagactatgcgaactcatctgagtgaggcaaggatgaaagctcaattataggtgtggacatggacgcagaaagacactacagactaaagatattgttggacacctattccttcagcaacttatgcgaactgactcctgaaccaccattacgttatattgacgcactgccttttattccagggtatatgttagttatatgcctttctgagtatgcactgtggagtttaacctgatcaaagcaacgccggtgcagaaaatggtggattcagcgagctcgcatacctgaggcgatcacatactgctcatccggtgtcaccttgatcttggtggtggcggtctcgaacctcaggtcatggatcaaatccagcctccgctgatactctaaaaagacccccaaaaaaaaaggacagcaacacgacaataaatgagaaaatacatgtcatttgcacaagaaaaaagaacccaaaatagagagagcagatgagcgtgaggcgagttaggatgcctgcgtccttgcggagggcgcgcttcttcttcgagaggacccatggggcgacgtagcggttgccggtgatggagtagagcttgacgccgttgatggaggttgacctgagggtccccgcgccgttgttcgacgccatgctcccctcctcctctgaaaccctgtaccgccgcacttgccctagctctcgtcggcgaccgacgccggcgactcgtcgtcgagcggcgccgtcgggggcggcgggtgctagggttttagcaggttggagggaaaattcggcgggtggggtggagcgctcgccggctataaccggagggccgcctagaaagcagctgccgttggattaagcctctgggttcttcaccgttggatctagtctgatcaactcggtgggccacgttgccatgggcttatcagcccattggtttcccgcgctgggcctttcgtgaatatctgggcccgttaagtatgacttctatcttcttttcagattcttgtagaaaataataagtgaataaaaattcacaaaactatatatattttgatcaaactatcacaaaactatatatttaaggtgttgtatcgcataactacagatttagcactaaatttatcccaaaactatagatttaaggctaaatatcacaaaactaaacaattaatattaaagttatcacaaactatagctttagagtttaaatccttagcatagttgttatgttggagctatattttttttgactgggataatttagttattactaaatatgtagttttataacactttattttaaatatatagtttgtgataatttaatgttaaatatgtagttttgtgatacaccgagttaaatctgtagttttgtgatagtttgatcataatatttgtagttttgtgaaatttactcaaaataaattttgcaaaattatcaagaaagaaggaaacatgagaagggaaaaaaacccaccctcatcctacacatacaggtcttgttacaagaaaatacaaccaaaagcaatctcatccagtcaccctacacatctttattgaaagggtcaccctacacatttggctacttattcttgaaaattaggttattgggttgtgttttagtgggttctctagcctgtgtgtactggttatttaatagttggattagcctttttttaccgatatttataacatttatgtgtgtattataatcttgtaattatatcatactaatatatcacaacaacatagtataaaaccatataatcctaatataacattacaccctctccaatgctaatataacattagaaccaactctaatttttttttctaatgtagaagtatagtcagtgtcaaatgcttttctatgaagatgtgccaacttagcggcggcacatggccccaaaccggagagagaaaaacccattagcacaactttattataacattttttttagctatttatgtgcaaaagtaagttgacaaaaattcgatgatcggtatcatgtgtcaggtatgtgctttgatgattcatcttgttagtgcgtcgcatgcctcatgcccacgcacataaaaaaaaaagaagtatgcccaattcatgttcccttgattttttattcgacatagaatgaagtaaggattatacatgtagtttttaaaatttaaccctaaattacatttactctagactctaaatttctaaagacgaaactaagacaagtccttattgcttaactttagaaacaacttgttttcccaccgggaaaaacttgaaaagagtttgtttgaaaaaaaaaggttgtttttcttttatctgtttttttttgaaataacaggaaaaatcgtttttcgtgaggtggatggagtatccgggatccctgaacaaattgctgcttcacaaaaaaacaaaaaacaaaaaacgtagcaccagtagccgccttttccccatctccactggccgccgccggcgacatcgccggcgccgccgagctccaccgctccgatcccactccgaacagccgagctgcggtttccaaggaaccgcgggcgagccgagcccgacccgttatcagccccgtttttttaacggggcagtgtccaagtccaactccgcctcttccacgcttcggcttccatccaatcatctgcatcgtcgtcgccggcgagcgccatgaggccgacctcccgcatactggccgcgggccacctcctccgcggctcacgctcacgctacgacccctcgccggtcgccgctgccgcccccatattccggcggccgccgaccgtgccgaggcctctcccgagccctctgctcggaggcttcgggccgaattgttgggtttatcccggcgacgggaagtatgccccctttggtcgcctcagctgcttcatgtcggactccacctacccgccgcctccccgcgatgtggtaacttgtggttactggcttactgcattgtgcttattgcatttggtttagtttcgatttggggatggttagaggcagtagtggttgattatgtattttgtattgtatcaatacttcagtcaaacaagcgagtttcctagcaaaacagtcggctgtagactgtagtagatgtgattagttactagtttgaccgatacaggaacttaaaaaaggattattaagcattgtggatggcattgctgggcgcatttggttttgtttcagtgttattctcagtccttgcaaaaggataaatttatcagaaatttactatacccttgtttcctttgtcattgctgacattcgtgcgttcaagttgatatttgttatgcttctgatgattttttcagacttaatccatcagatcacaaaataaagtacaaacacgcttactcacattttttcatatatatgattacaagcaataatatttgctacgcttgtgatgattctgtcaagcaattttttggtatttaaaatgcattgttttcatctttattaaatgttcttcaagtatctcacggttgatttcaactctagtaatcaatatccaatacagaaaattgagtctgagtttggttacttggctctgttgttttcctttgtactatgaaaggactcatttgttgagtttgtttttttgtgattcttgccatgtttgcagagaggacatgcattttccacatctgccaatgctgtggcagttgggaaatcatctgatgacaaagtgaagaaagatatctccaaaaaggatgttgatgatcagatagcagatacacagatactgaaaaaccttgggaaatacttattgttgaatgatagcccggatttccgcttcaggcttatattgtcattgggcctcttagttggggcaaaggtaatgctacacctgaaagtggtaacccatatgagcagagtattttgtggctaagataaacctgcagcctaattctgttgttaagatatttcttttgttattaattagtcattaatgaataataacaaggtgcacattatggcaattccttataagctgccacttatctcatgatagagtaccattgaccattatgctggattgagatcaatactaatcttcctggctggagttctatacatattcacttcttattctgcagtgacattttttacttatagaaggaatcattttggcataatatgatgcaatctagtagctagatatggcctatctgttggatgtatatcctcaaaatatttttgccaagttccgcttgttagatacacaactattttcaagtactgttgtcaaatcaaaggaataattatgcaccttcatttagggcatataagaaatgataaccacagaagttggctgttattacagtttacatggaactttcaacttatttatctgaccgttttcatttataatgaacaccaggttataaatgttcaagtgcctttcttgtttaagcttgctgtcgattggcttgcagcccttgctggtgctgaaacttcacttgcatcattcacagaggctaatgctaccctattggctctctttgcaagcccagcagctgttctgattggatatggaattgcacgatcgggagtatcagcctgtacaggtaaactctttttggttagaaaaaaaagcatggttgtttctttccctgaaaaaatgagttcctttcgtgagcttggagcaacatgcattgccaggcccctctttgaaatatatactgattctactgatttattcgtcgatttctgttgccagaactgcgaaatgctgtcttttctaaagtgacattgagagccatccgttcagtctccagtacggtaactattgaaatttccttttttattccaatgttaccactcatttgtcatgtttttccaaccatctactaaattcctctattatctagatgttccagcacattatgatttatgaatcttttgtttatctcaagttttatttctttctacgcattgatgtacttgtcttatttatgtagtgttgctagtattgtaaacagnnnnnnnnnnnnnnnnnnnnnnnnnnnnnnnnnnnnnnnnnncaatcaaaanttcaaagnccagcg

SEQ ID NO: 21751 - DNA, 802 bp, Oryza sativa
  unsure (1)..(802): unsure at all n locations
ggagctgtttgacnttttagattcgagctcggtaccccttcacatcattactgatatacataagcaccatacagcatatggttttatcatacctagatgttgacagtagaaattaatggtaggtaatctaattgtttgtacaaaacaaggagcgagcagaattcctcaccaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 21752 - DNA, 996 bp, Oryza sativa
  unsure (1)..(996): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagcccttgtatgaagttaacatgtcatggtgatggtgtgccaaatggtcagagtgaaccctgctaaatctgaattatttcacactgttaacaaacactaattttgcaaaagatgagtttactgcattcctccctttgcttattttttttgttatctaatttataccagattgtgtgatgaagctacaagcgctcttgatagcaccaccgaagcgtcaattttaaattctctgaagactttgtccgttgaccgtacctctatctttattgcacatcgactgacaactgcaatgcaatgtgatgaggtatgcatgttcatgcaaatacattagaacaaaaaaacctgcaacttcattttgtgaaagtaatatgatttattgaactaaaaataggggattcagagtaatgtatcagttaacagcaacagattttcttttgcatcgattcaagaaatcgatagttaccatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21753 - DNA, 912 bp, Oryza sativa
  unsure (1)..(912): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcgggtatgtgtaaatagttgtacggactttgcttctattctagtccaacctatctgcaattgtcttctaatagctacttatgatctcaggttaattatatcgattgcttgggttgcacatatcgtcatatacttgttgattgaccctcctttgtcctccttcctgaatgaaatcttcgtaaaattggatggtgtttggggtatatttctgttcattacattgttctgaactcgtcctattgatgacagtagcttgaccaatattctgttttctgtattaggtctgcttgggactgctgcctttgcattcttctgtttctatctcctcatagcagtgattgctggggaaatgatgctgggtttgaaattagttttcatcaccattcacccaatgaagtatttgacatatcccatggcatttccttttctatgtagtatcttttttggaatcattgataacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21754 - DNA, 789 bp, Oryza sativa
  unsure (1)..(789): unsure at all n locations
cacgcttgatgactgactgnctcctggnacccctctctcggttttggtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcatagatgtacctggtgctcctgaaatggctggctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcggctgacactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaag

SEQ ID NO: 21755 - DNA, 762 bp, Oryza sativa
  unsure (1)..(762): unsure at all n locations
ctgcgcnagtagacaacttgttaggaacaacggccaattttattatattcaaagtgtcaataaatagaaattatcatttataattaagatatggcctacttaattgtttttttttttgaaataaataccaataatcagttgtgaataacatattgcctaattaattgtattcaaagtgtaaataaatggaagtaaccatttataaatattatatgggtgaaaaatagtaatacattacaaattaagcaggtgagaataatatattgatccaaattgttcgaccttcaatacaatacaaataatttacatcttccatcaaacaacctaggtcactgttttcctcacgtactttctactcactattgttccttcgctatgatcgttgcatgagtatggcgtgtccttcttgatagtatgagctcgggtccaacgtcacttgaaacggaaggttgccctcaaacagatcgtaattttcgtcagtcttatcctcgattccacgattttcctcctgccgtggagaccaacatggcgtcttggctcatggggccctttcccttctttgggttgctatccatgttcttcacgtaaaaaacttgtgttacatcattggctagaacgaatggttcatctgagtatcctaccttgtttaggtcatctcgctgtcatcctgctgtcatcaatcgttacgcctccaccggtcagcttaacccattggcaccgaaacagagggactttcaggggtccatactttattttccgggg

SEQ ID NO: 21756 - DNA, 3510 bp, Oryza sativa
  unsure (1)..(3510): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccatttacacatatacatatatactccatccgtcccataaaaaaacagcctagtaccgaatgtgacgcatcctaatactacgaatctagatatacatatgtttagattcatcgtactataatatatgcaaatatatatatgttgcctctggtttcgaatgtatgtaactgttggccagtacaacaaaaattttaactgtgaacatcaataaacattaaatggttatacgtcatgacatatggaagttttatggctattttgtttattttttttaaacaaaccaacgttatataaaaagaaaaaaggtatatttttttctttaatatatgtgtccatgagatgagacgatgacctcttcttccctctagctggatgctgatgtttccattgcgatgtgccctagctatgtgtgggggagggaagggagggcagttagtagctttgcaagctagctgatgggtggataggtcatggtaatggcaactgctttcattagaaatgaaatgaaagaaagaaatcaagaaagaaagaaatcgagaataaaaaatattgagataggccaagatgaggtgtgacaggtgcctctcttgttggtgccttgccatcctatcccatgttgacgactcatcatcgatctcgatcttgtgtccgctttgactttgtgttcctcctgttgctcctccttttgcatatgtataatccactgcaaaattaaaatatagctgtgtgtatatattagcatatgcgcacgtgacgtgacgacgtctggtttttctctattccttccttgatgttgttgtcacgttaattttaataatttaatggttcttggtgtacttcctgatacctctaaattcttttgttggtttttattatatctgcgtttgtgcggtaacttcttgaccgcaaaacaaaattgaagttatccaaaatctcgaaaatttttaaaacacaaccatacggatgaaaacatactgatactgattggaattgaacccgacagtaattctgaaaacattaaactatatataaaaaagcacgtatctaacttaatatgactatattatataatgatataaatttaaagttacactatgtaaattacaaaatattacccctttagccatatactcaaattagggatttggttgagtagttgatggaccactaaagtatgggccaaatagtaacatgaaccacagatactgggtatttagaaatacagtaactattgtattgtagaaatagtaatatccataaaaaagtaaagacaatgaaatggttggtagaacagttccgtttctatatttctttaccatttatattttcattctgtttggttaatattttcatataattcctttggcaagagttaattgaaatccaccacaattttgatagggtagctagggacggaatatatatatgttgctcgatttgataggaaaatttgtgttatgagcatatgaacattgattgatgttctttttttgttcagagaattaaactaaccctacatctgcatgcttcactagagaatattcttcgactctaaacttgaactttctcatttttcgttagtatatggttttttgcaaaagtttttttttctaaatagaagttgtttaaaaaacttaaataatttttttaagtttataattattaatacttgattaatgtgctaatgagttttctcgttttgcgtgcgctaaaattctatccccaaatgaggtgatcgaatggagctttcaaataaaatctctcatggtccctcaataaaaaaaaaggtgaaacttgccggtaaaacgaatttgaaaatctccagaaaaccactcacctcatcacctatctctgttaatttctgttttgtttggcttggctttccaatggagaaaaaaaactaaacgaaagacaaaattgtaggatcgaaagacaagaactaagccaaccagaggggggtgaatggttggtatacccaaaaaccgaaaacttttagcggaaataaaagttatcctcgaaatcgacggaagtcggtctgaccgagattgatctaccagtctgaccgaagcgtacccgccggtctgaccagtgttgatcttccggttggaccgccctggaatccctgtcgcgcctgttgtcaccgcgggtctgaccgcggttcacccgccggtctgcccgtcgcgatgccgccggtctgaccgtcggtgtgtcaccggttagaccgccgaaaccgggcgaaacacaaatcaaagaactctaaaagtggatgacgactttattgattctctcggtgttaacaaagtgcaccaatagccctccttagaaaattttcgactaaactcgaaaccctaactcaaaactcaactcaattgctctccaaagcgatagcggaaagaacacttggtacaaacgtacacatcgtgctcaaaaaatccaaaagaaaacttatccccctttttaaaagaaagaaattcccaattgaaccaaaaacatgctcttctcaacaactctccaaaaattcaccttgctcacattacttctcccccttttgacaatgatttcatcaagcataggaattatgttcattaatgttcaagagcttagtacacatatagcatatcaagtcatgtgttgcaataaaaagaagataaacccatctataatataacaagcatgcattaaagtataaccatgaaccaaagattttacaattaagcttgaatcaacaatcaaaattcatgatttcatatgatttataatgcaacatcttaacaagcacataggttgaagaataaacactaaacacatatacctattgcatttatcactctttctcaaataacctttagcacaaaataaccaagagaatttttttaaccttttcttttcttgagcctttttgctcatatttttctcttttattccaggtacgtccctgtcgtcaagactgtttccagggattcggctccaattattttgctcacatcgaatacgtccttgtcgtcaagaccgtttccaaggattcggtattcatttttttcatatttttttattctctttttcacaatgggtaccaaggtgnttntccattgcaagccgaattcaaaccatcg

SEQ ID NO: 21757 - DNA, 973 bp, Oryza sativa
  unsure (1)..(973): unsure at all n locations
ccgccatcggcaaggcaaggcaagncggcgtgagggtgttatcggtcaaagttgaaaggggtgacggccaaatcggccccctagcccagatctggccacccctgtcctagatgaaggtgcccggtgaccaaccatgggggtggccgctggcagagcagtggtaaaactggtgaaggtggagttgtagggctgccagtgcaggagttgtaaggacgggggaggtggagttatagttgaccggcgagttggggcccggtagaggtggaaataaagggggattgatgaggtggagaggtgctgctcgaggtagagttggccaacgagtgcagggctaacggaggtggaaatagagccttggcaggcaatgtgtaggtggccagaagaagtggagaagcagacacaggcccgccggtttaggaggtgcaagaggcaaggcacacaatttggcactggcaggaggaggctggcgaggtggtcggcggggtgtagtaggtgccggtaggtggagttgccacatggagaggctgttctttggctgatcgatcgttcgttgttgcaagtttgcttgtttggaaagctgcgggacacgatgaacaaatgtgtggtcagtgacctggtcgacggcaagggatccccataaccggctgaagttctcttctcctgttccttggaaccccttcccttctttgactagtctgtttctagactccagtcaaggggtgcccccatgataaggagagagacgcgggttctgttggagggtctgcttgtagagaatacgatgttgtcaatctgtttgggtttgaaagtttttgggcagcgagggtgttgtttttaagttggtggggcatgaaactcttggggacaacctttggttgtgatttcggagggagttggatctacttgaccaggtatgacaagcttgggataataaacccttatttttatattttggaagcgtcaagggggttgg

SEQ ID NO: 21758 - DNA, 2749 bp, Oryza sativa
  unsure (1)..(2749): unsure at all n locations
cacggctttgattgtctaaactcctnnnnnnnnnnnnnnnnnnnnnnnnnnnnnnnnnnnncacttctagatatagattatgagaggtgaaaataggaaagggaaatgaatgaatgaatggctatgattaaatgagatatgaaaaatggatggctatgataggtactctgttttcccaactctctcttctacggttttccgcgcgcacgcttttcaaactactaaacgatgcttttttttaaaaaagtttctatacgaaacttgcttaaaaaatcatattgatctatttttaaaaaaagctaatacttaattaatcacgcgctaatagaccgctccgttttccgtgcatgggagatgggttcccaacacccacctccgaacacagccttagagggtgggatataatttccctatcccatttgccaaacaaagccttaggtcgtaaaaggttggaacccttcctctccaacatgtaaaacaaaacacacattagcgtatgattaactaaaataaactttaaaaataaattaatatgatttttaaagcaatttttttagaaaatatatataaaaaacacatcgttgaatagtttggaaaacgtacgcaccgaaaacgagagaggttgaatagtttggaaaacatacgcaccgaaaacgagagaggtgagttaggaaaagaggggaagaacacatccttatatttggaagtaagtttatttttattttattttatgaacggaaggagtatctcgctgatccattcatatgcgcatgaaggcgtggtccaggacaacagtacacagacgttactatagtgatccaaatgcatggaggatcgatgtagccaaggtttttctttgatctgtggatttcagcggagaccttgctttcgatccgttgatcttgtctccgatcgcgcgagactctacagcgtgttttcgtcctatccgttttctgggcgatcccaagcaagcagggggtaagttcctttcaatattgttttataatgatttctactaaaggagaaatcaatttacagtatgcttttttatcttttctaatttaatacgtcatatctatttatactacttagtaaaataaattttctactagcggtaaaacttactatacatcatcgattgtgatcatttaatagtgataattaatatatgagatgtgcttctatacttcttaaaaaaagttgcacgaaaatcgaagcacatcagtggctgtgattaaaagtgggttaacagtttaatcctcattagtgaggggtattttcgtccatagaaatttcagcccacaacgatatcgttctctcctcgtcaggcagcgccactgcccgctggtttcctctgcaacgtaagcgccacccgcttcccctccctgccctgctagaccaccctaactagatcccatcgatggatcgatggatttgcggtgatttgagtcggtagttcactcgcaacatgatgagcgggagctccagtgaataatatgctgccccacaatgaagatcgtcgccgccatgctcaacatgatcagcctcgagcacgaggactatatatagcaacgtcgacgtcctcatcaagggccaccacctcgcgccgccgccactgccacattgagcacgccgccgtgccggcagtagtcaggccaccccagcgacagctgcagcagcttctccggtgccatgatctacacctcatttaaggccaagtcgcaattcgattgaaccaaagtttaaacagaagaaataacacaaaataagcttgtgcccttcgtgctttggcttgtttgatatttgtctgtctgcaatctgcaacggcaagttcgatgtgacttgtgatggtggtgagctgtaaatgaacggggtagacataatggcatgcagatacttgttttatgactactggctgtgagatggacaaaatggagcgtcgtgctgcaccgcgcgtcgagaggaagaagagggcggagcggcggcgctgtttgcaagaggaagccgggcaacgaggggaggaagagagaggggaggtggcgaggcaaggaaagcgcgggcggtgcttgcgaggctgaggagcggcgctacccaaggagagagcatcccggactagcggtcgtagtcgtggaggaatncgcgttcccattggtaatttggtatcgctccaaagtggaccggggctcaaaatttcatggatgaaaatacccctcgctaataagattagagtgtttatctctcttttaatctcagccacctatgtggtttgattttcgtgcaacctttttttagaagtatagaagcacatctcttaatatatttgttaaagaatattacaagtaaaaagaccaccgtaaattatactattttttaaaaatatatggtcactgcgtactcgtatgtaagaagccatgatcacttaattactagtacaagttttccaagggaaaccataaaatggacctgaaaaaatgcgtattcccgtgaagtccctttttcgagtaatggataaactggccgatgcatccgatctacgaagaaaaaccgagtaaaacccatcttaattgaacggtagtttctcggagaaatcattttagcagaattgtgagatcggaggaatcatgttagcagaattacgagatggatggattgtttatcgcattttttttactaggacttcaacactactacagaaatgatatttgcaaatggctaaaagccattttcacaagggtaccaagctagcata

SEQ ID NO: 21759 - DNA, 6393 bp, Oryza sativa
  unsure (1)..(6393): unsure at all n locations
atggctggtagtacactgctgcaagccngcangncgactntagaggatcccctctccaaagacttgaagaactaaggaagactattctaattctaactctactagcactttagcaaaatatgtaaactaaagagcttcttcacttgattccttcttgggggggctaaaagtaaagtagataagggccttttatagctgtttatgacagttgggagcgccaataccagtagtaaccgttattggaaggcggttaccacctaccttagcttgggcttgggccaaccgagctggtgctgggtcgaccgacccctggcaggcctccctggcccagtgattcctccagaatatctttagatggatcctcggcccagtggcatagtggttaggtccatttgcaggtgtttcaatgaatttgtgggcctatccatccatatgtccccacatgttgacctctgattggttgaacgattatgtttcatcatttctactccatttatatagtgatctcctataaacaaatggctttgccaagtacaagtggaactagattatttctaaataaatatgcatgcaagcattactggttctccattatttttgaaagtatccacggtcgaaattggtctataacgactgtcaacaaaaacagaggattgcaaagcacaagaaaaacacaagaatggccatttgattggaccgtaggaaaaccacaggaattagagaagagataaagacttaaaaggaaagttttcatgaggtagaacctcatgttagttttcctccaaaacttgtatggcattaggcattccatagtattcatttctttaattcaaagggctatataggaaaaaatcctacaggaatgaatcctctaaaatttctatgaatttcctttgaatcaaatggtgtcttagcaagagctcaaaactcttggaatttttttttgagactatctctcttatccgattcatgtgtttttactaagatccaatcaaacggtcattcttgtgttttgcaatactctattttacacttctattcttattagtattctgtgtttttcttattccttcgttttttttttcattcttgcgatccgaaggggcccaggatgttgcatgaacttccaatcaaattttagggctcctttgatttggaggaaaaacataggaattttggaggattccaatcctataggaaaatttcctatgaaaccctttaaaaatcatatcctatccttttaaattcttatggaatggataatcgtatagagattttggaggaaatatagcaagagctccaacctcttggaaacttttctttgagtctatctctctcatccgattcctacatttttcctgcggttcaatcaaacggtcattcctatgttttccttgcgttttgcaatcctctattttgtacttgcattactattagaattctccagtaggtggtgtttgaatctcttgaagatgaagatgaagattaaatgattcacgcaaaatgatatagtaataacatgtgattagttttaattattacaaactttaaaaatggattaatctgatattttaaaacaactttcatatagaaagttttcacacgaaacacatcgtttagcagtttgaaaagcgtgccacgataatccaaaattttatcctctcctagtaggagaaacgaacagggcctacgttttttctatttctctgtttttttcattcctatgattgaaaaggccctaagggtgatatagacattttccttattatattaattatagtacagtaatgcttagttgcacacgctatctgaatgaagcgtacaatactgtgtacgagtttaaagtcggtcggtagcagcgaaaacaccatgcgaataccacttgagtattcaacgcattgcctcacaagtcacgagggtgtagtatttaaaaggagagacagaattttcaaggaaggcatggcatccttttccttgccctttattcgctccctttgtttgtcccaactaactccattctaacacgatataattaagcaagctggatatatctttttttttccggggaaaacaagctggagttgatgtgcatgtgtccaagaaacgttagggaaatttgcaagtcaagatcaatggtactcttttataaaacgaccttgcggtaacctagcaaatggtcgtatcttatcttattttataattagggattgttttatctgtcaattgtgtagttttgggctaatttctcactcacctttgaactaaaacaagctggggttgtggtggtaaatatatggtggaaatcttaatttgggttaaatttgatgtaaaccctgataaaaagccgtctaaattcactaaaataatcacacgtacgcaagatgatgttacgctaccatgtaatttttttcaaactcaacttcatttgcaagctataaaaccaaaaaaaattgaacgaatcatcatgacaaattgttattttaatatctcataaacggaatcgagagtttgtacatgatttttttacatggtagtttaacatcatcttatctacatgcgtaatctttttaatttagatgacttcttaattatggtttacacgagttttcacatgagttaagtttccaacacatatttgtacagatgttagaataagaataataatatagccaacttattactattagcccatcttaaaaccaacatatataattgattagctataaggttggctacaattttcttctcctgtctctatctctcacttatacatttaatgtatttgtcttggagcttgtgataagttagctcttgcatgagagtcaacacccttaatttttcactacctctctcctccacttaagcttatagtaagcttatagctcactattatacttgctcttaggcaccggaagactgcagcttttacattcaggcaacacctaaaactggtagaggtgggcattcggtctgatcgaaaatttcggtctcggtcttcggtgtatgtcatttcggtctttgaaaagtgaagaccaaatttcaacaaaaaatgtcaagaccgacaaattcggtctcggtctcggtcctgactgaaattcagcaacattttcatatatgcaaagaaataatggaaattttcaataaaaaatcacaaaaaaattcgtaagcacgtataaaactcttattaggttgcatgtctagaagaagtagggatgtgaaaaattagagtttagtcctattgaacttagtggatcgtaggttgcatttagacttttttttaattcggtctattcggttaaccgagaagactaaccgaattgaccgaacaaaattcggtctttcacggtctaggaccgaatttttcggtctcggtcttttcggttcgacccacccctaaaacctggttccaaatagctacaaaattatttgcctttcaatccacagttggtcaatcggtagtgatggataggcataatcctaagaaatccatgcaagtgacagtgtgtgacaccagcaccaaagttgtggatagcagcatctttgatctttattctgataggttcatgtgggggccaaagggcatggacatacaattgccattgccatgcaacacagtcatggacaaaaggagagagataaataaagatgcatttatataattagacgacgcatataataaatagtttcagggtagattgaagggaggcgtcagtctgtcagatatgccttttcctttgttgttaaaaaaagcatagagaaatttaaggctgccccatggaggaggcaatgaaattatgcagcagcctgacacagctagtagattcctgtaccagtttttcatgcataggattgtttttatatgtattactagtagtattttattgtatactaggagtattctttgttgctgcaaaggcttgcatcagaagaaatgagcccttagtttcattgttgatgctcactgcatggtcccccaagggcccagcatgatatgatatgctcagcagtgggtgtatttagtttacgccaaaattggaagtttggttgaaattggaacgatgtgacagaaaagttagaattttatgtgtgtagtaaagttttgatgtgatgaaaaagttagaagtttgaaaaaaaagttgggaactaaactaggcccaagttcatagttcttcttctctcttttttccctctctcttgctgacaaaaaggttccatgctttttttttttacaatccagggtaagggtgtgtttagttctttgggtgtaaaagttttgaaatatatggacacacatttgaagtattaaacatagattaataacaaaacaaattacagattccgcccgtaaactgcgagacgaatttattaagtctaatttatccgtcattagcaaatatttattgaagcatcacattgtcaaatcatggcgtaattaggctcaaaagattcatctcgcaatttacatgcaaactgtgcgattggtttttccccacatttaatgctacatgcatttgtctaaacatttaatgtgatgtttttggccaaaattttttaggatccaaataaggcctaagaagtattcctactacagtagaatctagttttacaatttttcttttattatctttcacttgtccattcaaagtattcgacgccaaagatgtgcttggtttttgagatgttgtcatgataaccacttggggtgtgtttagttcaagtgtgtttagttctttgggcataaagtttttaaagtatacggacgcacatttgaagtattaaacgtagactaataacaaaacaaattacagaatccgcctgtaaaccgtgagatgaatttattaagcctaattaatccgttattagcaaatgtttaatgtagcaccacattgttaaatcatggtgcaattaggcttaaaagattcgtctcgcaatttacacgcaatctgtgtaattagttatttttttatatttaatactccatacatgtgtccaaatattcgatgtgatagggtgtaaaattttgccaggggatctaaacaggccctaggactctatgaggggtcacatccccttgtagattgagttttttttatgaacggatggagtatatatcatctgcctcttctctcctaaaataattttattttatatccatcttgtacataccaataaaaaataaaaagactaaattgttatggaagattactcacttgatgtaatggttgtattaaatttatttagtactagggtaattagactagtggaatatcagggcctgcttggaataattttaatcgcctgaaattgttgcatattgctaatccttgaaattgtaagtttagttcatttttgctgtagtttttctaatgtatatggatctactttatttttaaccaagtttcaatatttgtatctttagtttttacaaatgtttatcaagtataatttattttatgtcattgttcgacctttaattaagaaagaatttaaggttagttcaagtatagtttaagtgcctaacatatgtctagtctaggttagtgcaattcatttttcaacccttttatgtaagaaaaaatggatagtatttaagtagaaaatgaagggagtgtaagggtggttattttttcattcgaggaaagagaaaactcattaaaatttgatataattccaataacataaagcctagagtccataataaacaaatggtagagatgaactaactcggtcactccaaattacccttgaaatgttcaatatggaactagtgaattgtgatccatccaatcatctctatatctttttctataggcacatgtgcatctcctattggcattagattacattgaggggctatgagggagaagaccaataggagataggcatgtggcgattaggattaggtcccacaaggggtagggactctgttcggcttcgataatggttttgtagggccctagtgcacaaagaaaattcgctcattcaatgaaattgatgaggcatgttaaaaaggatggctagataatttgtggaggcgaactcctattgatattccccatggatttttgctagcatcttcatgttacttgcattgaggtattgataatgattaggcatgtaggacaactgcccttaataagccaccccctcctccaaggctggcccatgggtgacatgaaacaattttttacatcaaaagtgcctaagtttggtccacatgtcaacaactatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21760 - DNA, 2831 bp, Oryza sativa
  unsure (1)..(2831): unsure at all n locations
gcgattnnnnnnnnnnnnnnnnnnnnnnnnnnnnnnnnnnnnnnnnnnnnnnnatcttacaatcttaatatattactccatcgcacttgaggtatcgtggcaatagtccttacaaaatgtgataggagaagacaataatagaaatacacctgcctaggtcatataaactcacgcttggggattgacttggcttaggtttctaggctgtccgcttagaattttttctccttatccttcctttgtcgctattccaaaaaaaagtttggatgatattacatttatagatggatgaagtgggtaccattttgtcttaaggtccaaacattttccatgtctcacatcgacttggatttagcaaacacacaggccatgaaaaaataatgcacatgctgactaacttatctgaactataatggtaccagatacttttgacatcaacaatggttgaatttattattttttggtagtatgaaatcaaaggtggcaaataaaggaacagtgggttgtgctctccctccccctctccaacctaaaggcatggatataaatgagtagagttgggatgttatacttcttttggttctcacaaaagttggatcttgtaggcgcgtggtgtggtttgtagttttttttttcctagtcatggactcctatagctatgattttgtttttttttttgctatatcaatatgaaatctcgcaccgtcttgtacagttcagttcgaaaaaaaaaataaaggaatagagaactaacatgcatggctttggtggtgaccaatgtggccatggtgctgcatgaacttggaagcatatgcattacagtttttagaaagttggtagaaatcactggtaagcagctcttttactatacttcatgctcattttggaataccttgcagaagtcacaaaacttgtgcaccaagaagtagtagctagtatcagtaatttgtatttgaggtgatcaatgctgcacatatctatctttagctatgactttgacaaaacgtgctccaccaaacatatgttgtctgcctaaaaataaactactagaatttataggactatttccgattaaaatttgtaacttgagcaatttgagggaaataggccagcctacgcattgtttgtataacaatattgttaatgtttgctgcttataatcgcataaaaggctatttttctcattatctaaaattgatcgttttctcgtcgaaccgcctaatgtaatcaatgtgttgaaactgagcaaaagtgaaatcagtatctaagaaaagggcatgatgggcatctatctcaatcggacaaaggcggaggccgaggagggaaagaagaaaggttgtatctccacattcactaaaccaaatacggaactcatgtttgtaattccatacgagatgaaagtctcatgcacaattttgcatgagagaaagaagcgaagaatcctcttttcgacaggagccatgctttcactaaaaacacgaatatttctataaccgttacattaccaacatattagagctagttaacaaaagaagcaggtgcgactacgaactaaacccacatctaactcggttaaacttatgtaactcaaaactcatagtagtgcgcaaaagcataaccatgagccactagctaagggcgtgtttagttcacgccaaaattggaagcttgattgaaattggaacgatgtgacggaaaagttggaagtttatgtatgtaggaaagttttgatgtgattgaaaagttagaagtatgaagaaaaagtttgcaactaaacaagagctaaaagacacaccatatggtcaaatacatcgttctcagaacgtaattttatcatggtcaaatacaccgttttcagtaatttaatctctgctatagttagcaacataatttattacggcccatcaagaagaaaaaggaaaaaggagagagaaagaagcaacgtttgcatctttttcttagtttgagctgtcggtagtacaaaatccaaggccagcgatcaatcttaaacacaaacataaaaaaaatggtgtactcgccttaattaaacttattttgaaatcaacttgcaaaccccatccaatgaaaacgaattgacaaggcttagtttagattaaccagtaggagtactaccccaaaagtacttaaggatatgggtcaagactagagaaaatcacaaccaatcggagcaaacaagaaattgaaaaggaccttccctgcttactgtcagatggactactttgagaaaaaaagggggcaaaataactatatcaataaattaacctctgtcaaaacaggcaacaattaaaattaagagcagcttagaccattctttctaattttctagttataagatgcacattctacttcagttttcgttagcgcgtttttcaaactgctaaacgatatgttccgtgcgaaaactttctatataagtagcttaaaaatatcaaataaatccattattcaattttgtaataatcaaaaactcaattaatcatacgctaatgactttatattcccttactcaatcttcatctatcttaaattgggccatgtctctttttttaattaagatgcagattttacttcggttttcattagcacgatttttaaatcgctaaatggtgtgtttcatacggaggatctacttttgaaaatttttaatgatttaaactcaattatttatatattaatagctctctcattctgcgtgcccttacttaatcctcatcctcattacttacaaacactgcataacggagtaatagtattattattaatgttatgttaatcctgatgggtaccgangtctatctacttncacatcg

SEQ ID NO: 21761 - DNA, 756 bp, Oryza sativa
  unsure (1)..(756): unsure at all n locations
cgtggcannagtacgacgtacagccgccgccngcacgncgactctagaggatccccccaacagcgtccatgtgtaatagttgtcccggtgcattcgtcatcacagaaacaatttgatcttgtgaagaagcaaccatcttagcatgatgacatggggtacaaaccaaatgaagatctttcttaagtttaggcaaaccacgaacaagatccaaaccacttaacctagtgagatgatcaaaaccaacatgtgcaagtctacgatgccaaaacatcacatctttatcaaacttagcaaccaaacatgttatcacaggtgaaccaagattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaatctacattctttaattcaaatttttcatttaccttaaccaaacctatagcgagaacgacacttgtagaagcatcaccaaagataatcgattcagtcttggatgccttcttgagtgaggagaaccaatttttatcaccggtcatgtgccgcgaacaaccggaatccacgatccacacgttctcctttcttgccaccaaagcctacacacaagcagaagtcgaagccttagtactgggattagatgataataaaaatttaggatccagtc

SEQ ID NO: 21762 - DNA, 1931 bp, Oryza sativa
  unsure (1)..(1931): unsure at all n locations
nagcgaaggacggcgcttggccccgctcaaggacaaactgtggtttagcttccaggcgaaggcacgggtcgagttcaatcaagatagggtgggtccccaccgaaaaaaagagtaggtagaggcggtgcatgtggtatccccttgaggtataaaaagaggactttgcccaccgagagagaggacgactctcaaaaaacctgagcttgtggaggagggaagtaagagtgttctgccgagtttaggaacccttgtaactctcagtctaaatcccatacacaggagtagggtattacgcttgatagcggcccgatcctgtataatttggttgtgtgcgagctagctaggagccttggggatggatacgcgatttctagaggcgagcttcttccctcggccgaactcacgaaagggggggtctcacgatctcccgctagagaggatcacccctcgacaagcggaaataaaagttacccggttagaccgccgaaacacggtgaaacacaaatcgaagaactctaaaagtggatgacgactttattgattctctctgtgtttacaaagtgcaccaacagcactccttacataaatttcgactaaactcgaaaccctaactcaaaactcaactcaattgctctccaaagcgataccgggaagcctcacgctccccctctatttatacatgaggcagacagcctaaagccacgaaccaaactcatactaggagtcctaaacaccttatgaaaccctctagtacaagaaagaaactttacataaccaatcgtaccaaatttggactccttccaaattcaactccgtatcccatacgcacacaatacctncattgtatgccatatggaatctncatcaaccacgtgcatcaactctagtctaagtattccgcatgatctctgaccaccacggacgtcgtcttatccccaagccgattctcgatccatcaccgcaaatactctcccgaagcattgagtcatctacacatgaaataaacaaagaaaccatattccaagaccaagctatctccaacttgactcattagtagcaaacagtagtattacatacgtatagtatccatctagaagtcataatcatgaaataatcacggatatccaaacaaacaacccgaaaccgaaactgacacagcgtcggccggtcagaccgcgggctgcgccggtctgaccgcgcattacacgccggtctgaccggttaccaaagcccggtctgaccggtcacataaaatgacgaatcctgcgatcacctgtgaaatccaatcatatctaaaaccacttcatgaataaattctaaataacaaaaccaataatctccaatgtcaattgttcatcacagaataataaacaaaaacacctttgattttaaaaaatgtacacatggcgagtggcgctgtgtgaccattgtacgtatacgtaaggatgacgctcttgttgatgcaacgaccgcacgtatacgtaacgctaatgcatgaagcatgtcatcagagtagctaattaaaaaattgccacgtatcctcttaattaatcgcacctcttgaccactatacaattaattaactcagctaaatatactgcttaatgtcatccactactgttgctgctggaggcatatatatccatatgcatctatacttgtatgttactgtatcaattgctaaattaatgacgcatcatgatcaatattgtaacatagtgattaaccaccacgtgttagtccattcacaattagatcttgtttggaagattgccggagattcttaaaaacatctagaagagatgtgtttttcagcttttacttatctattggttaaataaatttggaccatttagagaacctcaggagattttggaaaaggggatcatctagagtcgacgtgcaggcatacaggatagttattcaaccgt

SEQ ID NO: 21763 - DNA, 764 bp, Oryza sativa
  unsure (1)..(764): unsure at all n locations
catactttacttttactttcaatacaagcacgaaaaaaccttttctaaaccgccggccgcaaattaaggccgaggcggttggaaaaggaagactcctcacccccacgaaacgtaaccgggggctccgggccgggtccggggatatggaaggggtaacgtcgagcgtgcaagcaaaaatgctttcttccccccaacgccgccatcgtacgcgctggtgaatgaccacctggcgggggtgaccaccatgacgggccaaccacacagggagaacatcgaggtgctccacctccggacgcggcggtggaacaccgtggtggcggtgtacgtccgccacctgaatgccaccaccacgttgctctactcccacggcaacgttgctgacctcgggcacttctaccagctcttcctccatctctctttcaacctccgtgtcaacgtcctcaggtcagtcaactcactcatgctcgctcacttccttgcttgcttccttccctctcctacttcatttgcttccttctcctcctgcgccacgcggcgcgtgcgttggggggggggggggtgggcgtgatctgtgtggtggggtttgggcgccccagtacgtggcttctggggctcctccatgactgcggctttctcgattcgttatgtccggatgggaaatttcatgttctactctgaaattttctgaaattttccctctttttagatggggatacctctagagtcgacgtgcaggcatacngaatgagttatatcaatctccg

SEQ ID NO: 21764 - DNA, 3600 bp, Oryza sativa
  unsure (1)..(3600): unsure at all n locations
agcaaatgcaacatccncggggncagnnnanngcacgncttcacttcggcaacggcaagcacttcaatcgggatcgagccatgaggggtgaagtagaaaagaaganagattgcgcgnntggccactttcgcgggccactccggcngtcggccacttgcgccgccttcttgngcgctncctcngcccttttgcgccgcccgcaccgccgcccatgccactcctccgantgcgccgcccctccgcccggctgctcctccgactgtgccaccctgccggtcagctctcgtcctccccatcctctcggcggtagaagagagagaaaggtggggagattattttttagagttgtgaagggtgagtataaatatgtggtagttgtaaaatattagtaaaatataggatgttggtatatggaggatgtaatatagatgatctgttgaaatgaaaagtaatatggagtatgaatctttttagatgactatctaaatgggagtatggaggatgaaatttagatgagctactagggatgctctaaggattggaaggtggcatggaagaatagagggttaaggatgtagaaggctctgccatatcatcctcccagtaggcatggaagagtgtggtacatggaattggaatctatgtaagtgttgatttcttttatattcattctatctcaagcatattttattttttttaaaaaaataatcatatttatagttttcatgcatccaagacttaaataaatatattatctttttgttttagtgttagattaaattgttgatggaacctgagaagttgttgtaatactcgatggtctcatgcatgatacaatttcttggtgtttatttacatgtgagattattttttccttagtcttgataataaaagaaatatatcttacactttcggatggagagatggagagagtacattgtaggcccctgtcatgctacatgtattgacatggtaatattttactcattgccaaattaaggactcattttttgcaaatagctaagtatcggtttgttcttaaccagaaaaaatgcccgtgcattgcaacgggtgaagtctattttaagataaaattcactgtgggagtttgcttaaatatatatatttttagaaaatcatgacctacagttaggagtccgattgtctcaagttagcatgcgagtttttttaaatatatttcttatatgattccttctgtattaccaaaagtgaatgatcttaaacgatcttagaaaccgactcaaatatggatatgtatttctaaaagcaaacaagcttaaaaaccgactaaaatacggacggcgtaccaaaaaaccagcaaaaacattttcaatttttaataattgtagagaaatattggtggagagaaaaaataaccttcttatgttttacgtggtactgtctccaacataagagataacatgtttttcttttatcatttctcgcctctagctaaattttttatgatgataccatgctaaatggcgacaaagatgtcatcaccaacataccctcaccctttactttgtagaccagagatcaggttcttctaaccttaaagtcactgtgattttattattaacatgcagatttaggtttttttggactcgtatgttagcgacaaaatcacgtaactttaaaattaggagatcctggtccctaaagtgatcataagtgatatactccgttaaaaccatgttgttataatatgtttaatttaaataaatatttttaatatccacatcagacagataaaatcagctgcgaattggggtttggggggggggggggtagtgtatgcagcacacatcaatatcatacttcctccgtttcacaattatctagattcattaacatcaatatgaacgtgaaaaatgctagaatgacttacattatgaaacggatggagtagatctagattcattaactgtaacaccccaggtaaccatgtacctagagtggcacaccaaaactacactcaaaaccactaactcccaaaattattacaaatttcggcaaagtctcccctaaaaaatacggacatccacgacaggcaattataagataacacaataacgatataaaccacacaatccaaaccatcctagctccataagttccacgcgaaaataaggaccagaactttaaataacctctacaagttctatgcaaaactttgctaagcagaatcatagtctaaaactaaattccaataatgtgcaataataatgtgtagtccagggtgctactcccgtcccatgccaatcaatgtcattaggtacctaaaaaccaaattaaacacaagagtgagtaaagaatactcagcaagtacaatattgaactagtaaaacatacacaggtttatgcaataagaaaaccaatatgaaacatttgacttcctttaatttaaaacgaaggaggcaaaagtagtagttccctcccgggcaggtgtgaatatcctcttagcattaccggtaagccgagcaaacgtaatcagcgcttctcaaggatcatgaataaagatccaaattgcactcccatgactacgcatggtacttgaataatgtaaacaaaaacttccggaagaatgaaacatgaataacgtcgtgaacttgaacatgaagtgaaatatgaatacgtagcataataccaacaccacacaattgataataggaagcttcgaataataattgggtaaatgaaaccaaacaaaataacatagtttatccatcacacaagtccgtcttgtacttgccttaactccttcgataatccgactcaactcctccaacgttggaaccctccacacccgtggagccaaaactacgtataaactactatatccaactaatgatagttacaaggatatttactaaaatcgaaacccagttcatacaaatttttaccgatttgtgttaaataacctatagctattccattactgttttgttttatatgtaactcacaaaccgtctaacggaacctagcaaataatacaacttcggacatccagacaaaattttctaccactttcatgttgagcacaaaatcagattatgcctatgaaatcccagattaaggaaaacgaattgctatcatgattttcggacccggtcagcagtactatttttttgttgtttctcccaaaccgtttatcggaatcgagcgaaaccagcgctattagaaagatatcaacgatggctacaaactttatttaggacaaataacctgaatcctaacggtttaataccagatttgaaaatacggtttcagcctataatcaataacctcaaaaattgcacaaacggctatctaataaatttctatttaaatattatacttctagggagtaaacaaaagtaccgttgcagcgaagatactagaatttgagaacaaacgcactagttacgaagtcactgaaatccccaaaattgcttggcctttctctcccccttcttcctcctgttctcctgttctcctgcacccttctcctctgaccacgcagcagcaggcagcaagaaatcatcagtagcagcagcagccaancaaaacaacggtcgacaagcagcaagccaggtt

SEQ ID NO: 21765 - DNA, 1115 bp, Oryza sativa
  unsure (1)..(1115): unsure at all n locations
ccgtgtagaagtacaacatcttgnacccgccaccacccacgggtacgccgcatctcagcagagtatcaaaagcgcgcggcggagacggcaaggaggtcgacgagcggcgaccggaagtcgtacacccgcgcgggcgggcctgggtgacgacacattcacgaacgacgcgtccccggcgcggaggtgcccacggagaggaatgtggacgggagcggattgctgggccgcgtcgaggccgacgggtgagggggacgaccgccgtggccattcgcgcgacagtagccatcggcggcggcgcccgtcacatcggccctccttttcggagcgctcctccctgccagccgccagccacgccagccctcttccccgtcgcgtggaagacgctgccgccatccacatcaaggcgaaaaatgagagaggaaggagagaggggaaagagagagagagagaggggtgacgtggacaccctgtcacatggggcccacgtgggtctcacgctgactcggctgccacgtcagacaaaaccagggtgaaaaccacctagggaactaaagtgaacggttttataagttgagggatgtgatatatctggttgtgtggttgagggacgaatgacaagttgagggaccttcggcgtactttttccttatcttaattaaagccataataagccgggccgagctcaccagcaggtttgatattcagccctaacaatggcgaccgcaggcttgatcggttggaggttttggttggctgggctaggccagttccgagtagaagctacaaggaataagttcaccggacgttcctcaacttaacagagagatttcctgagattcctcagccacaaaatcagaaacgttcacctctaaactcatttaaaccgtgcaaagaaggtattatggcagtatttacatccagttttgctcacgtgatatcctagtcagtaaaaaataaaaaaatgaatatctaaggcatacatgtaagtgagataaaatggagagagacggctggcgcgattgcgagctcnacngccgaaagtancggcgcgccgtgcggcaacgggggagaagaacngtaaaagagggggaacaccggccgtccttcatcgtgat

SEQ ID NO: 21766 - DNA, 1733 bp, Oryza sativa
  unsure (1)..(1733): unsure at all n locations
ctgtcatgatgatacgtcancttgtaccccaactcaattcaaacctaccctatcgaatcattcttttacattacttactttcagtcatgtcttttactttatcctagtttcatctatttttctcgattttcatcataaatcgcctgccttcgctacgagagtacgataacctttgtaggtttgtctcgtaaaccttccgattcacccatgagatgggtgattaactccatattgacctaaatcaacctagagaccggtttacatctctaaatcggctccggtagcaggtttaatcttcaaaacccatcttgctttagagttttctatcaagatggttggcgactccattaatgcctcaaatatttagatgagtccgtgttgatcagaaaaagcacctgcagtactatcgtataattatttctagagtgaattgtacattggaccacctattttgacctaagttgcatatctttctgttcaagcaagtacacatacattatctttatctttgattaatctacaatatacatataaattatcattttcaatgaaattcgatgcatataggaaatacatgataaaaacagtatgataacatgacatcatacttcatccacacaccacactgcagattaatttactgaaaaaagtggataaacttttggataaaagtggcacgcttttcaaactgctaaacggtgcatttcgtgcgaaaactttctatatgaaagttgttctaaaatatcatattaatccatttttcaagtttgtaataattaaaactcaattaatcacacgttattacctccttattttgcgtgaaatatttaatctttatattcatctttatgttaaggagatttaaacaccacctaaatgtaccatggtccctctaattttaatgctctgaaaagtataactcaaatttgtgcattcctatgtgatatacattccctaggtccatactccatccacgccacactgctgtgtgtactgtccactgcctacctaccctgtaccagtacatggaccatagctaggacagtatcacagacggtacaactgttttttcatggtgtccgtatgcccttgtccgtttacatacatgcttgtattcatcagggagaaaaaaaagatagaaatacggctaaaagaattgaaacaagaaatccatagacgagaggaatttgaaagagagaatctctgccagggcccacacatggacaacccttcaaagcccctggtctgacatgtacaaatccctggacggccttggggggccacagagagagagagagagagagtgcatatgactgatctgtggagctggagttgcttccaactttgagaattgagattgaaccaatgtgtgtgagagagaggaagaactagtaagtacagattttaatgcggactcttgaaaatatactggctttaactttatctcactggtaaataaaaggatccacacactaacactaactatctataaggtggagttttcacacttggttaattatgtaaaaaaaagctaatattatgatagcaacaaccagtagtccaccaccgtaataataaaaatgctatccattaagcggagtcgtcctccttccctccccttctctcacacacgtggcacgtcatacgctccgtgcacgtgagtaactaccgtatccaatattatattcttaatcatcttctaagctaattctaaatatataaccttgacctat

SEQ ID NO: 21767 - DNA, 2612 bp, Oryza sativa
  unsure (1)..(2612): unsure at all n locations
aggattgattgtgatttacttggaccatcctatagtgaccccatcgtcattttgggctggttccgcccctgtctccaagtttctctcaattggtcctattttctggtttcatgtcggttggctaacgaatatcaacctatagcaaaggaaacgtatgtcagttttggtgcgagaaactgataaatcagttctgcacttctgctaaaatcaatcataagatgtgctcagatgcaaactccataaacacacacctgccaactgtatatcgtttggcaaggtaagtaaggtgtgccagctccgctctactgcatgacatgcatatcacttgccttttatactggtagaaagcagtgttgtagcacaagagccctcaaagcaagattagctgccaaatgcgacgtctaatgccttatcagtgtggctatggataactcctagaacactgatgtatgggacaaatacattaaagtgtaattttaatgttcggtttgatagtatgtagtatcaatatgatcaataattcaagatgtgcatgtaaaatatatagagtaaaatgttatgcggaaggttgagtatgtccattcaaaccatagatcaggagggaaaacaaaaacatcccaaaaaggaaacacttcttggtgatcattttgtttaacattgtcaatatttcataagcaaatagacattaagggcctctttaaatcgcatgaatagaaaaactgagtaatagggaaaaaaaacaagattctaataggaatgcaagtgcaaaacagatgattatgaaacacatgaatgaccgtttgattgaatcgtaggaaaatcgcaggaatcagatgagatagattcaaagaaaaatttccaagaagttaaaactcttgctaaaattcctccaaaatctctataggattgtccatttcatagaaatttctaaaaatatgatatgatttaatcctttgtttcaaaggtattcatataggccatcttctgttgtcctgtgaggagaaggaacattaacattgatccttcctgattttgttctctttttgacgcaaaagattttgttctcttaagtagctcgatcgatctttgacatggctttgccccctacagggttttgatgtgtagataaatgtgatgagatgaatccacgttattgcagttctcatttctggttgattgctatgtgcggagttgatttctgtgcatcttttcccttgaagtgtgattttttccctgccggcttgagtgccttatgagttaattttgaacttaattattgcactctatatgggttttgattattggcattggcagatagtataggaagtggtaaggtttttactgttttccgtgataagaatcttgcttacccatagtgttgctgttgtcagttggccatcagctggcttaattgtggcttgtgagagttgggaattgtcttgcacggcaccccatctggctggattttgcattttgcaatataaaataggagataaaacttgcaggggtttcttgtgcttcaccgcagtgttatcatgttgtcacctgattcagatagcaaatgttatcctcacttgtcacaatgagaagagcttaagctcttttttaccattgtaacaacatatatatattgggctgcgtgcaaaggataaacaggctggttacactaaactgggaaggatgtttagtggcttgggattctgtctgcatgcctaagaacgtaagcgggctgggggtcaaaaacatcgaaaagcaaaatacagctctcctagtaagagattacaccacctccacgctgatcactcttcctgggcttcctggatatggggggaacatctaaactcgaacttagctgctcataattaacatgcttggaacgcattgggactccatgatgtccctgctgccaattcttcagaaacacacctcagtacgttcaggttggagatgatcaacgaacctcattttggcatgaccactggtgtggcgatgtgctggctgacaagttcaggcctctgtatactcactcgcttgaaaaaaatgcctcagtggcgcaggtccttgctgacgacctcagaacccactttgcccccaggctctccacagcggcggaagatcaatccaaccatctcagcagcctcttgatgcagtgcctagtgactcatcatcaagatgggaaaatatatagtgcaaaccccntatgttgggggaactctgaaactacccgttggatctataaataaactttcctaatgagggacctattaaactcaattaaaatcacctgccatttacattttaacatttgattgtgttctggatttagactttgtttaagggggttcctttttagtccgacctgtatgcattgcaactttagattttctttatgggcacctaaaatatctttgccgtaatcaatggttatacctgtttccttggtgaaaagtgttttccgctttaaaattcctacaatttaccgggctcggaggtattaaatttataagccgtggctcctaatttgggggcgcccactacatatatatgcgttgggcttaatggcccgctttctacatgggaaacctcttgggcgccatttttttattaatact

SEQ ID NO: 21768 - DNA, 2792 bp, Oryza sativa
  unsure (1)..(2792): unsure at all n locations
cgacgaaaaagataaaaaagaaggtgagactaatttgttaaaaacgggaaggagagaggtagaagtattttaattatagtaaaaaaagaagataggaactgcaggtggacaacctaggaggacaagagggggaccaagagaggtgggaaagaggagaggaagaggggcggcatcaacacagcggccacgtcgagagagcaacgatgaataagatttaaatgaactggatagaggggtaagaggagtaagatagggacgagttgggatataaggtaatggaggtgaattcntgnaagttgatgtaggaacggtggaggtatgaagtaggagagacgatangggggggcacttacatattttcccccataggatcctaaaaactagggatctttatcttgcagaatacgacgagatggagaagtgccccaactggaaatttgtgtgggagaataaagctcctatgaaagttcagttctttgcctggctcttgactaaagatcgtttcccaataaaacgcaacttgcacaagaaaaccatagtaccggctccgacctgtgaactttgcaactctgctgatgaaacagccctccacctatgcttccagtgccccttcgctgtgaccctctggagcgcgatgaatataccggtcaatgttgcgatgcttgttgagattgcctcaagttcccttgaagcactttagggtgttctacttgctatgcttttggaacatgtggaatcaccgccacggggttgtcttctgacacgaggcttcttctttgcgccgtttactagagcagtgtatcgaggatgccttcctctggggggaaagaatcaaagtagaggagacatgtaatttcgacctggaaagatctcttttcttcctccctccactctctcaatatgtaatgctctagactttgtaaaactgccctttgctccctttttaatgaattcaggtggggaagctctccccccagcgaattttctaaaaaaaaaatgggaaggatgggacatgcctgagtttatttccataaagctggacacaccctgatccaagagtgtcaggaaactcattttagccttggatgctctgcatcaccttcttcaactcgggagttctcaagaaaaattaaagttaggttgtgtttagttcagcgcaaagtttggattttggttgaaattggagatgatgtgactgaaaagttgtgtgtgtatgacacgttgatgtgatggaaaaggactgaagtttggatccaaactttggatctaaacacagccttattgtaattcatcagcgatgttccttaatccgacgtgtcgacaccattgtcaacaaatcttgaaagagaaaattgacatttagccatcctcgggttggggtttcgctagaatgccatccccgaatgtggcttcgttataatgccatcttcaaacgtcaccatcttgccatattgccattcatccaatttcagttatttgcaaatgttaatccgctttgatctgacttttttgcccctattgctatttcgttgacttgctgggagggacagatcgatctccatccagtcgtcttcttcctctagtagtcgcagccggacggcaagcatagctcggacgtgctcccggtcccagcgctatcgcagcagagctatagcagtcggctgcgcatcttctccggcacggcgaacccgacgctggcgcaggaggtggcgttctatctgggcatgaagctgggtagggtgaagatcaagcggttcacggacgggggaagcgtgcgtggttgtgacatgttcctaaggcaggccacctgcccaccacccaacgagaacctgatggagctcctcatcatgattgatggacggcccccgcgcatcttgcggtttggggggcagcagcagcactagtatggctatcgatctcgccagccatggcggagctcgccattgaagagggacttcaaaatccacaacagaattaagccgatttgagtgggatttgtggggggaattgttgaggaggacgagaggaactgatttttgcattcaatttggggcgagagcaaccgaggagggagatcaagagagggcattgttgcatgagttcaccggagggagaaggatggtggcgggcggaggtggaaaacgctcctggcgagtgggccccacggcggaaggatcttggccggtgcgtggagtggctaaagcaagggcattttggtcaaaccaaataagcaaaacaatgaaaaatatttgcaaataactgaaattggctaaaatggcagtgtggcagaatgggggcgtttgaagatggcattataacgaaaccacatccggggatggcattctggcgaaaccctaatccgagaatggctaaatgtcaattttctcatcttgaaatggtttggtgatatgacatacaagcagttgagattataggcatataatgatttaatctatttcataaataaatcatgacattacagatgaaaactagcatgaacgcatcattagatctacacatgtaaactacacagtataacatgaacagatcaaacatgcgcaacatattgaacacgtaccgaggtggcggaaagaccggctgctcggtcgaaacttttcgcaggcgtctatgaaggcacgcagcacgcgagcgaagaggaagacgagccgtcccggacgaacagggaccagtcgtgcaaagcgcttcccaaaattcttattaccgccttctcccggtgcaggggggatcctctagagtcgccctgcnggcagcaggcatagaatctcaacgcg

SEQ ID NO: 21769 - DNA, 1252 bp, Oryza sativa
  unsure (1)..(1252): unsure at all n locations
gattatataagtaaagcactgaaccgatatatataaaaaaagacaccgcctattttatatttaaaaatccacccgttattatataagagacgaactaaacgatattttaaaaaagacgagagcgagaggagactgaaaaatgttataaaagtcaaaacgcatatgatattaaaaaaaccacggtcgcgtgactaattgaaaggcaggaggtgattatattttgaataaagagggaagtgactcaattacaaaagggcgcccatccttttttatttaaaagacggaatgaacgttttataataaaaacgagaagcctagaacgaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagtgctaaacagtgggctcctcggggcaaaaactacatttctgtccaaccaattgttgcaacgcaatgcaaactctgctttcgcatgatgaactgattgagctatatatggccgtgtgggggccattgaaaccaaaactagagtttactcacccctgtggtgtgatggaagtggcaacccaccaaaaactgaattgattcggtggttaccatgtccctcgaagctttctctgtattggcagtccttgatatcgaacacggctttcggttccttcctagcgcacggcatttaggatttcaaatttgcaatgttcgaataaaatgggtcagtttgatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21770 - DNA, 2537 bp, Oryza sativa
  unsure (1)..(2537): unsure at all n locations
cccctctacggcgtcgggggggttggtcctccttgccggcggcgttcgtcgtcgtcgtcgtcgcattgaggggggagaggtgatccgcccgtagtccattccagctcggggaagggggggggcatgggggcaactggtccgcgtggtggtgccgccgctctcgaattcgtgcggggattttggttttgaagagggaggtgacccgcacgcgccgatctggtgaggccttgctcgttttgtgctgttttttgtgcctagctttggtcggaggtgtttgaattgttggggaattttgagcttttgctgtgatctgagcttcaaatttcggtgggggttaacttggcctgggcacctcggaatttctgtttaatttttggtggggtttctttgatcacaagatacttgcttgcttggagctttgggagcccgaggcgcattaaattccacatcttctgcgctgttttatcgggaaattaaacatttcgtgctcaagtctgtgggggggtttttccctcggatttgtcaaatctggcggctcttgttcgaaaattttcatcttgggagcttacgaacgcaaaattcttcacatttcttttgcttcctggcttggaagctgtggaatccaaatttttatgtgctgaattgacatggttagccatgttttttttccacagaaccacatgattttagcaaaatttcgccatttctactttgatccggtggaatctagttgccagatgtgtcgactggtaccttgtctaactagctccatggctatgcgcttgcaggatgccatctcaggtcatggatcagaggcatcacatgtcccagtacagccaccccaccttggctgcatcctccttctcggaggagcttcgtctccccacagaggtactccataattgcgataattttggtccaaatcttccttctggaagtcttttctatgtgatggctaatggtgatctgtctggaaattttatttgtttagcctttcctggtgacctggttatgattcatatctacaaatctttaccaattattctcaccatgtttatatattcattatgatgaatatctataatttgtactaatttttctctcaccatgttcatctcttcttctatctttgcagaggcaagttggattttggaagcaggagtcattacctcatcacatgggttagtgctgagtttgatttaacttatactgggttttgttctacatttgtctattagtatgccttgcggttgcagctttaaattttcacgctgttgggggcatgtacttagtcgtttctttatgcatggatagcaaaactttggggacatctattggctcttttttctgcatgaattacaaaccatctataggagggctttctttgaaaggtttacctggccttgacagccatctagcctgcctaaattgagttaacactaggtgctggccttgccacctgattagtgccttggtgaacattggttttaagtattttcccctctatttatgttagattaatttgcaataaataaataaataaataaataaataaataaacatgcatgttcttcttatatatgcaattggttgttgtgttttttcttgttatggttactttctttgttctattgtactactctttgagtctttgataatgtgatggttcataaatatgtgggtttcccatgatattttctcataactaggtgggtttccaatattgacaggaagcaagtctgttgcatcttcaccaattgaaaaacctcaacctattgggacaaggatggctggtcgactagaacttctacaaccatataaactaagagaccagggagctgcatttagccttgagcacaagctattcggtcaagagaggcatgctaacttgccaccatctccttggagacctgatcaagaaactggccgccaaactgattcatctttgaagtcggcagctttattttctgatgggaggattaatccgaatggtgcctataacgagaatgggcttttctcaagctctgtatcagatatttttgacaagaaatgtgagtggtttttctttatcatttgcatttgcttcatcaaaatgcttgattctatgaaacacagactcgagaaatttccattccattgatagtaaatgtgctgaaatataccatcacatgacatatgtattggcaactacaacgcttccttacgatcttacattctatacttaatgcttctcatgaatgaatagaaatgtacaaaagtaaacaaaaaatacagctgaaatgaaagggtagtaaaatgaaatgactttcattcccttcccctttttccataagaatcttgcctcctttatctcctgtcttacatccctacatgctctgaagatatctatctcattatgctcttagtaccttgtaattattattcgctggagctcccgctcatcatgttgcgagtgaactaccgactcaaatcaccgcaaatccatcgatccatcgatgggntctggttagggaacagagtgtctatcaaaggacgcg

SEQ ID NO: 21771 - DNA, 1857 bp, Oryza sativa
  unsure (1)..(1857): unsure at all n locations
taaacaaaaaatnccactgaaaatgaaaggggtagtanaatgaaatgactttcattcccttcncccttttccataaagaatcttgcctccttantctcctgtttctttctagtggctaaaagaatcaatccactttagtttggtatcgtagtccgtctgttattcttgtacattcttttgccaaaaaaaagtctgcactctggttcaacctttattctattgtaatatgttatctccaatttccaatcattgaccactgtctgattttatttgtaacctgtgcagtgagattaacatccaagaatggtcttgtcggtcagtcaattgaaaaggttgacctaaaccatgttgatgatgagccctttgagttgaccgaggaaattgaggcccaaataattggaaatcttcttcctgatgatgatgacctgttatcaggtgttgttgatgaagttgggtatccaaccaacgctaacaaccgggatgatgctgatgatgatatattctacactggaggcgggatggaactcgaaactgatgaaaataaaaaactgcaagaatttaatggcagtgctaatgatggaattggtttgttaaatggtgtgttgaatggtgaacatctataccgggaacagccttcgagaactctttttgttcgaaacattaatagtaatgttgaggactctgaattgaagctcctatttgaggttagttacttatttcttcttctttgaatcactcttctgttacaacagatttgacatctgagaagccatctgttcttctatgcagcatttcggagatatccgtgccctttatactgcctgtaaacatcgtggttttgtgatgatatcttactatgatataaggtcagcgctgaatgccaagatggagcttcaaaacaaggcactgaggcgtaggaaacttgacatacattattccattccgaaggtaaccatcaaatcatcaattgccacttaactgaaaatgcttatctgcattttctgttgcctgtgcttgtgcttagaatgttattattctagatattcactaaaattgagcacatttgcttttctttgcccacaggacaatccttcatagaaagatattccccactgaactattgccctttgtgacgctgacctatctttaacaaatgatgatctacataagatctttggtgactatggtgaaataaaggaggtacgatatttcatttgctgactactattatagctagaaagtatgactcactagttctatttgcagattcgtgacactccacagaagggtcatcacaaaataatacaattttatgatgtcagagcagctgaagctgcacttcgtgcattaaacaggaatgatattgcaggcaagaaaatcaaattggagaccagccgtctgggtgctgctaggctgtaagtcatttgggtcttgtcaacagtgataatactctgtttgctgttttctttttagttcttactactactttcttcatcacttttataacatacatattcaccattttaacatttttgacatactagctgaatgcccatacattgcaatgggaattaattattagagaaccacactgcacactctaaagcctcaaaaattaatataaaactatcctcaatgtaaatcttagggtcatattttttgtcggtcattttcacctccaatttgttttccctgttagacggcttgaggttaggaaagggacaaaagtccaccaaccacactgtttgggggactcacataccagtgttggtgggtggtgggtggtgccagtggtagagggggatcctctagagtcgncgtgcnggcntgcaagtagaagatgttcatcctncacag

SEQ ID NO: 21772 - DNA, 2273 bp, Oryza sativa
  unsure (1)..(2273): unsure at all n locations
aaatgcatttctctgagtattttaattgtagctattgctttgactgatttcaatgctctctatcacagcttgtcgcagcatatgtcttcagaattgtgtcaggaagagtttggtgtatgcaaactgggaggtccaagcacaagtagccctccaattgcttcgtttggtatgctgttttcctttttcatctcaatgtatgttttgctgataggtgcattttctgacacggatggttatattgcaaggttctactaatttggcaacaataacttcaactggtcatgaaaatggaagtatccagggtatgcattctggacttcagacatcaataagccagttcagagaaacatcttttccaggcctatcttctaccataccacaaagtttgtccactccaattggaatttcatccggtgcaactcatagtaaccaggctgcccttggtgagatcagccaatctctaggtcggatgaatgggcatatgaactatagttttcagggtatgagtgctcttcatcctcattctctgcctgaagtccacaatggagtgaacaatggtgtcccttacaacttaaacagcatggcacaagttgtcaatggaaccaactcgaggacagctgaagctgtggacaacagacatctccataaagtgggttccggcaacctcaatggacattcatttgatcgtgcggaaggaggtaatttgtatatcctaatctcctttggttgaaaaatctgttatgttaagaggaactgaactatcctaggatatgttggttccatcatgggtcatgccatgattttggtgggatgaaatcctcgttttctataataacatgcttttgtgggatgaggtggtgatcgaccaaacacattttgtttctcaaaccaatgaaagttgtgtaatgtttggatgaaagaaaatacatttggatcaatctacaggccttatatgttatctaatcattccttgaatgtgtattttttttttcacttgcagctcttggattttcaagaagtggaagttcttctgtccgtggtcaccagttaatgtggaataattcaagtaacttccatcatcacccaaattctcctgttctatggccaagccctggatcatttgtaaacaatgttccatctcgctcccctgcacaaatgcatggagttccaagagcaccatcgtcgcacatgattgacaatgtgcttcccatgcaccatctccatgtaggatcggcaccagcgatcaacccatcactttgggataggcggcatggctatgcaggggaattgacagaagcaccaaatttccatcctggtagtgtgggaagcatgggatttcctggtagtcctcagcttcactcgatggagcttaataacatataccctcaaactggagggaattgcatggacccaactgtgtctcctgcacagattggtggtccatctcctcagcagagaggttcgatgttccatggaaggaatcctatggttccccttccatcctttgattcacctggtgaacggatgaggagccgaagaaatgattcaaatggtaatcagtcttgataataaaaagcaatatgagcttgatgttgaccgcattgttcgtggtgatgactcccggactacgctgatgataaagaatatcccaaacaagaatgtgtaacaactggtaatttaggttcatttttttttcttgcctttgccttcttttctgtcattttcatggatttctaaatgacttgggattccaggtacaccttaaagatgcttctagctgctattgatgaaaatcataaagggacttatgattttatttacctaccaattgacttcaaggtgatctagatttatttagtatgcaactaatacatcatatttgttcagatagtcttgcctaatcgaattactgaatgggatgtgtcctacttttcagaacaagtgcaatgtaggctatgctttcatcaatatgaccaatcctcagcatatcattccattttatcaggtgagagatactatctatagggcctgcccagctgagctggctgcaactgcatcacagccagctgctgcccgaagcagcaatgccagtggcttgctcctgcagccagctcagccaagagaaaccattatcaagtgctagtcgcatgaaggcaatagcttacgttctgcatgcggcttgtcaactttggacattgtacattatnnnnnnnnnnnnnnnnnnnnnnnnnnnnnnnnnnnnnnnnnnnnnnntcaaaggtcatcaaatcgcg

SEQ ID NO: 21773 - DNA, 3151 bp, Oryza sativa
  unsure (1)..(3151): unsure at all n locations
ctgtcaggtgacaacttctccaccaacanggagttaaagcagcagatgacacttggacacagtttgctgttttatggcaagttcttttttgttagcaggccttttctgctgtatttgaatgtattttatcacaaatagacctatattttgtggttgtttctgttctgcagttccaaatttcatgccacattgtgggttccttctcactctcttttttcttttgcatgccatgtcatggtctctttcctatatattacagttgcaagcaccattccttctcatttctttgggaactagaagataatagtatctgttacttattattctctcctaatggcactgagtttgctccataatcactagtcattcttgtttggtctttcagaaccttttatgttagctctgaaaggtttattgttccatgcagattgctattcctttaactatatgattaacaccttttgtccttttgttgtccattaggaaccattccctatgggtacaaacatccgagccaggtcagggagatcgcgagcttcctctggcgaagaaagccaccaggacatctcaatcacctcggttaattgtgacacttctaccaatggagttgatactacagggcctgccaaggactgagtaacacaactgctctggatcactaacccccaaatcccaaatcataacttttgcgacgcggtttccatttcccagttttccgccctttttcccccaactttggtttttttggtatgacccccaatctgtatttattaacttccatgaatgcgggttaccgaagacttggctagattgctgcaacattttgtccctgatggaaacatggatagagagacagagagggtgcttccagtttcccctgaacctaccattatcatattaacctgaaggccgagaaaggtgaaaggcgcagcgagagcttccagattttggtcactttttaagaatgtattaaccccatgttgtatagcagtttccagtaactgtgctgaggggagagagagaaagagaggagagcaaggagacaatttacatgagtttttagtggtggtgtggagaggaagtctttccctgcattttcttttggaaccttttctggcgtcttcatctatgttccattttgagttgaggtctcctcttttaagttgtgtgcagaggagttccgattttgtcttcagggaactttgaccgtatctatcgaccttcatatgtaaatcaacatctctatatagtttgtgtgccctctgttgtatgcctgcggccccttgcaccaaacgaattgtctctctaactcgtgagattgctgtcctcgtttggtcgtattacatctgaatctaagcatttgatgttacgcaaatacatgccaatggctgcattgcgacatgtagcagacggccaatgttcaaacaaaaatcttaacttatgaagtatactagtacctccatcctaaaatataacaatttgggactgatgtgtatatcctagtccaatgaatctggcccttgtctaaattcattggactggatatgtctcatccactttcaaatagctatattttgggacgacactttcaaataactatattttagaacggagggagtaaataattataaatactagtactatcaatttggcacatggtgtcaagtccacttggtgcatggtcatctaggcttccctttggtgcctctcttaagaaccttctaagcgtttaacacaaattaaaatcgaagtaagaatctgacacgaattgaattcgaaatttgctctcacaatgagacaaaaacaaaagaatttggcgaatacagcagtaacgccgtggacgaagacaataataatagtctcggactcgggagttgttcagtcagtgtccgtcactgggggcccgtgggccgagcccgaagaggaggtgaagggtccagcagtggaggcccagctgctggaacgtggcgtcgccccggcgaatccccccccacgccgcgccggcgaaccgcaccagccggaacgcccgcctcccgccgccggccgccgaaaccgagtggcggtgtcagtatcgaaagagcgcctccaccgaccgtgccgcaccgaactccttctgcaccacccgcccgtcggggaacctgacgcgcacactggacgcctcctccccctcagtcgccttgcgtagtccgacgccgcgtcgccgtcttcctcctccaccacgttgctgttgccgagcacgggcctgagatacccggcgtcttggaagaagctctccgtgcgcgcaaggacccgcattggcgggcggaccacgggcaccgccggggcgnccggtgncggtggcgtgcccgtnaaatgcccgtggtcgtcgtcgtcgtcgtcgccgtagagcctctcggtgcgggtcgggatgggcgggcggatggggggctcgtcgtcggcggcggcgaagtagagggcgagggcgtcgtcgaggctgccgcggcatgatctgatgtggttagctgcggcgtctcgactgtcgcgcatggtgatgtccatgaaccgcgcgacgaggtcgtccatgtcgcttcccgccatcggtgatggatggatcgttcgatgtcgctggttgatgagttggttttgcagcgcgggcaaagatgaaaagttgacactgacacacacacagagagaaacttgctgatcgtggaagtggcgggcaaggggtgtaggctatttataaggattgaagagccctgatatattgattccgacttggattggaggctgcacgagtgcacggtcttctctccgactccgactcggatttgaggctccgcttcgtcatctaactgttgacgaggacaccagacgaattctgacacgatacagtccgacactatgacatgccctttctggtcttaataatccaataagcttgtattggctgcaagcctctgcaaatgtaccttgccttggccttgtgcacgtggttattagctgaaatttaagcaagaatcttggagaatatttgccattctgtacctagtatcgacttcgaggcttgtgttggaantaatgaatgggccctagcccactcgaagattacttctttgaaaaatcacaaaagcccacctcatgggatgacatgcctatggagtttagtataccn

SEQ ID NO: 21774 - DNA, 881 bp, Oryza sativa
  unsure (1)..(881): unsure at all n locations
cgcgattgaatagccttaccnnnnnnnnnnnnnnnnnnnnnnnnnnnnnnnnnnnnacttggtccagccaagccatgcgcgtcctcgtcgtgtctgcttccccaaccaccaccgtataaaggccgcgccaccgtgaccgcgtcggcgtcgccgccgccaccgccgcccgccacctcgccgccgaccagacgagccgccgtttgacccaacaccgagctcccgcgcggagttgatgtccatctccccttccgaatccaccagaggatcccagccgctcgcgccgcgcccttccaaccctagccccggaccccgccatggcaacagctccgccccaccgcgccgccgcggccgacgctcccctacggctcccgtctcaccgccctcagccgccggcgggagcggcggcccgagctccggtgagttctcgcttcccgcgagctccctccctcttcccccttccacggctaaacgtcgattgaaacgataggggattatcggcggggcttgcagatctactgatctagatagctggactgggttggttggggggacgaggattgtgggaagctttttacctgttaattttgcaggttgtagagttgagcccaagctttgtgtagaaactctaatacctttttggtaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21775 - DNA, 780 bp, Oryza sativa
  unsure (1)..(780): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgccgccaccgccgcccgccacctagccgccgaccagacgagccgccgtttgacccaacaccgagctcccgcgcgaagttgatgtccatctccccttccgaatccaccagaggatcccagccgctcgcgccgcgcccttccaaccctagccccggaccccgccatggcaacagctcggccccaccgcgccgccgcggcggacgctcccctacggctccggtctcaccgccctcagccgccggcgggagcggcggcccgagctccggtgagttctcgcttcccgcgagctccctccctcttcccccttccacggctaaacgtcgattgaaacgataggggattatcggcggggcttgcagatctactgatctagatagctggactgggttggttgggggaaccaggattgtgggaagctttttacctgttaattttgcaggttgtagagttgagcccaagctttgtgtagaaactctaatacctttttggtaaattnnnnnnnnnnnnnnnnnnnnnnnnnnnnnnnnnnnnagaagttagttcctacctngcgcgc

SEQ ID NO: 21776 - DNA, 5120 bp, Oryza sativa
  unsure (1)..(5120): unsure at all n locations
aaatgtgagtacggtttaaccngatagtacacnatcnnnnnnnnnnnnnnnnnnnnnnnnnnnnnnnnnnnnatgttttgatttttttgaaaaaaaccgacacctataattgcttaaaggtgccggttttttgcgatttcaaccagcggaagtgtggaaaggcctatagatgccgattttagcacttccggcacctatagtgctgacacctatttgatgttttgtagtagtgcccggctccggccttagccccgtagagtcatccaaatggaaaacggggacccgacaggtgagcgaggcctcgcatcgggcggcaacatggagaacatggtgacatcattggatggcaacaagcacttgtttgcatggctggttgtcgacgaagggatggaggcacgcccggcaacccttccttggctgggaacgaagcaagtgacgggaaaaaggagaggacatgcggagacatccagcaaggggaacaagaagtcgatgacctggcatggagggatggaggccggaggagaggacagtagacgacgaggagggagagcgcttctcgctccaacggtgtgaccgcttctcactccaccgcttttggctcatgaatctgatgatgacttgcggcacatgtgttggggagaaatttcgggataggataaggggagagttccttcttaagcctgatgggccttattttcataacgggttatcactattgttgaatagtcccacattgcttgtggaagggcaaaggatcttttttataagtaggggagcccctcacctcataatctagctttttggggtgggaaaggccctttaccatcctataattggtatcagaacccggctagttcaacatttctggcccgagggacaaaaggtgtaaaggcctgatgaaccgggggtgcctgcggggcccgtatacctgagggaccatggggaaatggtgaaggggcggtgaacggctaagggacaccaatgtgtgaagggggagattattaagtagtcccacataagttgagaaagggcaaaggacgtaaaatataagtgggcgagcccctcacctgataggctagcttttggggtggaaaagccctttatgatcctacaactatattttcactctataatgtaatcctaaggcccccgcggttggagatgtttccctgcccccggctccgcatgatgtcggtttcctgcccccgtatcacctgcgagtagcatttcgcccccgtccctggcccggtaggggcgggtacccgcgccccccacccccaaacggggaaattgccacccctagtcaaaaaggagagctaacgactattgacggtcataatagaccaatttcgactgtcaatacatccggaaataaaagagaattagcaatatttgtatgcatatttgtttaagaataatttatttccacttgtacttggcaacgtatttgtatataggcgatcttcatataaatggaggagaaacgatggaaaataatcgttcaaacaatcaaagctcgacgtgtggcagacttaatggatggatgggcccacaaacccattagaacacctgtaatttggcccaaccatcatgccactaagctaaggatccatcaagcgaagtccaggagaaaggatgtgccagcccaaggttcagccgaaaccgccaccagcgccgttcatcctggccttccacgtggacatcctaaattgcttcccaatgatgtttgcagggtgtttaggacattttcaactatcataaccatcattgagcctataaaaggatcactacatctccatttcaacacacaccaagaaggatcaatcaagaaactctctagttatttactttgttctaatgctagtggagtagaattagaatagttttcttagttcttcaagtcttctagagatttcaggtatcgctctactagctcctctctctctcttgtaagacttaattcaataatgaaatattcttctttatatagttttgttcctttacttcatttatataattattcgagtaccgactttagttcatacttgtctcgtaataattatgtagctagcttactagagatatgcaatggtattggtttggtaatcaattatttgattgttctatgtcatctgcagagatatagagtagtatgtagtaatgtaagcacaatgcttagattattagataccagtaaatggtgctatatgtacggatctatagaggtaggctgctgatggtgacatcttagtacatgtattcctccacgtgcgtatatagggctaagagattttcctagtgtgggtactcctccgtatctattaccaattggatggccatgacggataaggaactcggcaattaggcgtgatttctcgatattacaggagggcatagttaggggtattggctgcataattgtataatagaaagtgttaattaaaatgactatatactataagtacaggaattatgcttttctatttctttctccaattagcttagactattatttcagtgagagtattttggttaattctttttgtgtgtcaatcaacccttgtccttaaattgattaacccctgtattagattttgatcaacataagtgatataattgttattataatactctcttctcatatctttccttaggactaaataaaatacgatcccttggaaatacttccggatgaaatgctacagcagtatattcgagcgtttgcagattatgtctgtaactataaagaataataagtaatatttcgggcataattgtttggaattatatttctagtaattttttaagaaatattaagaacgacaaacaagaaactccttcacctgtgatttttgttgtgtgctgagctggagggaaatgatacttactaataagaaatcaacttattttaagatggaaggtgcatattaataccatgatcatatccacaaagaattgtgaactataatgaaaaaggaaggatctttcgatcttagcaattagattcacttgttaggtataggcctataatccaaaataaaaacagacaaacatgcccttagtatctcataatatctttgtgtttttttaaagaaagacacagacaagctggttttcttaaacaataagctgttgcttatgtgttctacccacgtgctcttaattatatggtgagcatggacactcttgattgtcttaggaggagtgttaaggctgtgtccgggaggtggaatttggaactccatctccccacactgaaaatgtggtggtttattaatgtataattaattaagtatcagctaaaaataacttaaaatagattaatataatttttgagacaaatttggtataaaactttttttaaaatgtaccgtttagtaatttgaaaagtgtgtacgtggaaaatgagaaagattagttgggaaatagaagaaaagaacttagagcaactccaacagtccccttatcccaatctccaagttaaattttagcaagtttgaagaaaaaaaaacactccaatagcttctctatttgactggccaagccatctagctggccaaaatggctccttggctggccaaacttggccagtttgcctgcctagccaaacttggttgctagctgtgggacccacgttgctccccacctcaatatctctttcccctctctttcaccgcacagatcgatcgtcgccgccatcatcgtcctacagcgccatcgtcatcctgcgatgtcgctggctcgcacctgcacagtcgtcgccgtctgatttcctccgtcgccgagggagctccgcgatgacgaggcaagagcgaggaaggtgtgttggcgacggcgacgagggaggagcgatgatggggaaaaagcggccggatccatcatcgctgtcgatggcctcctcctccggcaccactgtcgtcgtagaggtcgccgtcaccatcccctctgcatccgtcgtcttaagggctccgctgtctcctaccccgccggattcggccggcggcgtgtaatcgccggggggtgggggtggggggcacgtgtggactccgctgcctcctcccctacgcggatggcggcgtggattcgccgggacgacaatgtgtggactctcgctgcctcctcccccgccggattcggccggcggcgtggattcgcgaggggggggacctctgccgtcgtctggccgccaacctccgcgcatccgccgtcggaccaccggccgctgaggttgccatcgccatctgccgcaccgtgctcgtcgagccattcaccgctgttgccatctagaaaaatggtgagaaaagagaaaggggaaaagtaggggttaggaatagcataggctgacatgtgggtcccatttgtcatagatttataatggagatggtagataaagagactgatggagcaagcaacgagtttaactagtcaaatcagatggagagttggctatatgggtatttggagagtgggatttggagaagctgttggagatgctcttagcctaattagcaatgctactaatgctatttaacactccctcccctctctatctccctctatcgctctctctcgtatggagtgttttggtgttgcatgctgtccctgctgtgcataggctttgttagctagcaaggcagctgcagttgtaggtggtgcagctcagctgggggctgggcatacagccccaaaacactgtccttggcccccctcctgcacagattcccccttctgccaaacccagcaaaaggttcccttgtctagctcctctcatcacacacactctctctccctctccaatgcacaagtaggagatgagtaccacatgcatcatgaccactttattcctcccttcccagagacacagatgagaacaacgctgtctcacctttcctgctctctcacctcctttaccacctccccctttgtctttttcttatcgaaaaagaaccggtactatatagggcgatatattagtataacaagaaaattataagattacaatcagtattagaaaaaacaatacccattaattaaattttaactttaaaaaannnnnnnnnnnnnnnnnnnnnnnnnnnnnnnnnnnnnnnnnnnnnnnnnnnnnnnnnnnnnnnnnnnct

SEQ ID NO: 21777 - DNA, 5500 bp, Oryza sativa
  unsure (1)..(5500): unsure at all n locations
gagccttgattgccnnttgganaancgaccttgtaccccaatcagtattagaaaaaacaatacagattaattaaattttaactattaaaaacttgaaaaacctagacttatctgatattttaaggtaacctttatatataaaaaagttttcatacgaaatatgttatttaacagtttaaaagaatactaatgaaaattaagataaaagaaaagaacggagtctaagcgtgagggtcggggggggggggacctccccttcgtcctttcttgagttgcttcctcccttgtcatggcagctcttgcaaggaggtgagcaagcaagcagccccctgttgtttgtgaattctggtcacaaatcttttagttgcatgtcttgcgcatcttctctcttgctgtagctagcttccaatgtgcgtgtgtgtgtggtacgaacgggtacgtcccctctctactctgggtgtttctcacatcgatgtgtcacttttgtaggatatgtgtgtgccactgtgtggttcccctcgacttttgtttcccttggcacaaagaaacaaatgggataaaattagcggacaagaggcattttgtaagcttgtatcaaaatcggaagatatatgtagcacacgagcttaattatactcctccatgccctattcacgagaaaaaatatctaataattttaacatacatctaaacaaaattagaggtttggccttacgtggtacagatatacaaccatcgaccgtatactcacgtgcgcatgtacttctactctggatcgatatcggtcctgaggaaaatgcgagcctaacaatatattagtttctaatatgctttcgcaacattcttcccattcaaaactatataaatatatatttatatctcattatgtgtttgtccaaaggtgaaaagagaatgacaggatgcaattaataacttggggatggggaagacacgggaccggctgagtatatatagaacgatggcggatggatctcctctctatctcctgcctacgagctgctttgtttgcttgcaggatttttagctgtactttgctaggggatgccacaggcttctaaaaagtatgcccattttgttcccatgcgtttgttgcattccttggctgcattttttttttgtatggtttcaggcttgtccgcgagtgatttcagctactatgctgagtttgctgccttgctatacgtgggctttgtccgtttgctccaggtcttaaaaacagtgaaaaatccacggctctgttggttattacctctgcttctgtggcgtattaatcctctagctagctacctcaagctttgaccattcttaccctcgagtgtgcatggcctggcctggctggcaggccagtcatccttgaaagttgaaagttcttctcttttttttttcagaaacttaatttgaaagttgaaagttgaaacttgcccctctgatcacaatacaaaccttcgttttaacggtattcatgcactgatgcgatttctatgtttcaatgcatgtaaatttaatcagatgcttggaaagaaaatctaattaattcaaaattaaaaaattgacaattaaagtaagaattttttgacctaatattattgtttgctaaataacccaaaaatccttatatttcagaacgaagtgggtatattttaggacttttgatgtagtcttcgatattgtaggagtgatgttaagaatttatttttaaatacaaatctacgatacattctttcacagcgtgcttttataaagacttcctcgatcagaccttaacctctacgattttaacaaatccaatactagaactagcattaatgaagatatttatatttaaaatcaggccttaacctctgcgattttaataaatctattactagctagcattaaaaaatatttgtatttgaagtttttcgaattttacatgaaccatacatgttcaaaatggcatgtttttgttactgaaggagtatgtttttagccaatgtcctatgtgaaaagaatttggctatattggtttttgaattggctttccccttcagaaaacttccgaggaagcaaactaattaaacatcttctgaaaattgcgaaatgatgtccaatcgactgtttttaagaaatcatggtataattctggcctataacaccaactatgatgtacaattacatcggcatttgctaaatgtaaattaagacaaggagcaaaagaccaaagtaacaatttggagcaacattgtttggactcgatgatgatgataaaagttgtttatacttctttcgttaacgagggcacggctaagatatttcaccatcgcagatcaaaagtttctccaaagcaaattcttcaaacaaaaaaaggccgcttaatacggtgcggtggaggcctcgtgctgcaagtgtggtggtttttgagtggatgggcgacgaacttcaagaaaggttgcaggggttccaggcgaaagccatgtctagtagttcaccgggccggcaatggctacgccttcgggtgttgtaaccccctctagggcactgtcgaggattcatctcttccttggcgagtttctcgaggtgatggcggcgtctttgatgtcgtgatctctgtgggggcatcgttttagagtctcgtctttgttgttttgtcgtaggcctagtggcgatcggccacgtatagccgaggtcttttggtgctaggttcctctctcggtgggttgtgtttgtgtggttagcacgtggttcttagtcatgcactttggtgcacttctgacttcgatagtgtctgtcgattgttgtaatttttttcctttttaatatattcggatggtctccttcggtctttcccggtgaaaaaaagccgcttaagtcgatgccgtcgatggatctaattaactggtgtaggtcattgagagttttcacctaagttgcttgttctccaaaatgaccaaaaccatgccacaaattctgttggattgaactagaaaaggctagattttctaaagtctatagctcagtacacatattcgactattaaaattaagattattgtaggttataccgatcaaacagagacgtcagttgcggagacagggacggctagtagcatggcctcctcgaacaatacttctatatctatatttatattacctaattaaaaaatacgtaaggtttcgtaaaaaaaaatccgtccgtcttttttttctttttcgtccttttttgcaaatttttttcgtccgttttcctttatccggcggaaaaaaaaagcgtgcaaaataaccacatgcaaaaaaaaactggggaagaaaaccgcgtgcgaataaaccaatcggataaaaaaaccgatcggacggaaaaaaaccagcaagaaaacagcctattggacttttttttctcagtcctttttcaccctttttcttttttcttttttctgtttttaagtctttttttggcggtctttttttctgctcttttttcatgtgctttttaattttttttgtgggccttttttccggttattttcatatgtttttcttcgtggctgttttttagttgtatttttccgcacgcggtaaggatttgtgccatgtttttttcatcacggggcgaacactaacgtcgccgccatgttgatctatcttcccatgcgttccctcctccaattgattgccaaacatcaatcccccctactccctcaccattttcctcatgattttcccttttaactccgctgtaattcactgaatttaatctctatttaaaaatcaccggcttttttttctttccgtcctttttcaccctttttcttttttctttttttttctgtttttttcgtctttttttgtccgtcttttttctgctctttttccatcggctttttactttttttctaggccttttttccgggttttttcatatgtttttcttcattgctgtttttttagttgtatttttccacacgcgataaggatttgtgccatgtttttttcgtcgcggggccgaacactaacgtcgccgccatgtcaatctacctccccatgcgttctctcctccaattgattgccaaacatcaatccccctactccttcaccattttcctcatgatttttccttttaactccgctttaatttactgaatttaatctctatttaaaaatcacctttttatctcgagttttgtcgcttcgatttcaataaaaatggaaagaggagaactagtgtatcaaaaactctctaccaatttggaagatcgagaaagattcgactggatttgatgtgggggatttgaccagatttgatggggagaatcggggacctacagctccacttgacaaggaaggaaagaaatgagtttttgtccaaaaccaaataggaaaatatatagcaatctaaaaatgtttttacccgttgcaacgcacgggcattttttctagtatattgttaaaatacgtaaggtttctgtttttttgtccgtcactttttttttattttcatctttttttttccttttaaccgttcctccattttttttcttcgcttcttttttccttttttttcacccgttgtttttttctcttttaacgttctgtttttttttctttttcgccgtttgttctcgtcatctccaccgccatgtcgatcggtctccgcattctctcctttaattgatagtaaaaatcgattcctcactactctcttattattttctccataatttttcctttcaatgccgctttaatttaccggactccctcattatttttcccataatttttcctttcaattccgctttaatttaccagatctaatctctatttaagagttttatggattcgctcagattttgataaaaacagaagagtagaataagtgcatcacaaacccttaaccaattttagaagatcaataaagattcgatgcgatttgataggagatcagttctagcatcacactcttccgggctttgatggggaggatcagttctagcatcacactctttcgagctttgacgacagcagtcggctatatgagttgctataatgtatagtgatcgaaaatgtttttatctattgttaaagacgacagtcggctatgcgagccgggcctacanccttagttcccccccccccganaaannaanagaaanaaannaaaccnaacgcaccgcctaaccacaaaccacacccccccanagccgcacccccccaaccacaaaaacccaaacaaccccaacacanaaggctagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccttaagaggggaagtcaactcacaattatttggggtggggttaactggccgcttttcaagtggggaaaaactggttgcgccaactggatt

SEQ ID NO: 21778 - DNA, 2751 bp, Oryza sativa
  unsure (1)..(2751): unsure at all n locations
acggcaggtangaccntcgtcgngcncgcctgcaggncgactctagaggatcccctgcgtgccaccgtatcattctagcttgggatttgttcctgaaaaaccgcttcagccttggtattataggaaaataccacatcaccttagcaggaattcttttcttcaaaggttgtccgtcaacttcacctggatcatctcgtcttatcttgtatcggagtgctttgcaaacagggcatgcttctaggttttcgtactcaccgcgatacaagatatagtcgttcggacacgcgtaaatcttctgtacttccagacctagagggcagactgtcttcttagcttcgtatgtactttcgggcaattcgttcccctccggaagaatgttctttacgagtttcaataactcgccgaatgccttgtcactcacaccatttttaaccttccattgcaagaattctaggatggtactcaactttttgtagcccttctcgcaacctgggtacaacgctgttctgtggtccgctaacatgcgctttagtttctgcacctccttttcactttcgcagtcctcctgtaagtcccgcaatatttgaccaagttcatcagcaccgtcattcccttaacatccagctccgcctcgcccattgtgttttcttcaaatcccccatactgagcccagtcccgaatgttctcatcttcaactttatcttcttccattgcaaccccaacctctctgtgcgaggtccaacaattgtagctacgcatgaacccccactaaaacaggtgggcatgaatagttcgtggggtggaaaactctttctggtttttgcacttgtcgcatggacagcttataaaaccgtaacgcttgttatcattggccacacccaaaaaataatgcacgccgtcaataaactctttcgaccgccgatccgcgtacatccattgccgatccatctatatgaaatacatataaatcataattatacaaaatccaagatttacaaggtaattacataataatacaataattgaatataattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacacacactttttctctcatcagcttccatcacattttttagagggaaaaatatgtaaaaaaaatagctccaaatgtagatgctaagcaaaacaaagagtaggatgaagttactaaccttttgaagacctcaaatttgtatattaccaccaaaaaaatttgcttaaaattttgacagcacctccctccctcaaagcttaattttgaagcaatggctcgggctagaggaggaagaaggggtatataaagctgtgcaactttagtcccggttggtaacaccaacccggcataaagatctcaaatcactttagtcccggtttgtattaccaaccgggactaaagatatgatctttagtccccggtggtaacacgaaccgggactaaagatcccaagccccccgacagaggtctgacatgccctgtcaggagacgaaccgtctttaatcccggttggtatcgtcccgttgagtaataaacccgggactaataagccactttagtcccggttcgttttggaaccgggactattgtggaaatcggccgaccctctaaagacctcttttccagtagtgatatatctcaaggatctgtttccaataaaaaagaaatctcctctctctatacatacgtactcctccctctgtggtaagtacgtgaatttcctactttattgctagcaaccccatataaaatcttaagttactaaattatactcactctgtttctaaatattcgacacgttgacttttttaaacatgtttgaccgttcgtcttattcaaaaaattttataaaatatgtaaaactatatatatacatataattcaaatgataggaaaagaattaataattacttaaatttttttgaataaaacgaacggtcaaagatgactaaaaaaagtcaacggcgtcaaatattttggaatggagggagtataataaaccacaaagatgcagagaaatcaaaacattgaatatgttttcaacgtgcgtgctgcttgctttaatgtggttatccaaatagactaacctattcttgctagggattatcaatgcagttagcattaggtctgctacaaatgagggtgtgcacgtgttttcatcctgctaagctctactagatttatcttaatcatcaaatttgcgaacacatttaaatttagatccatggtgtctttaaaatacttaatgattcaaccgtggtaaacttctatggaaaagaataatttctagggcatgtcatcctaattaccattttaaaattaaaaaaaattatatactaaaggtatacaaacactcctatactaccacgtggtacgcctataaacactactaaaccgccacgtggaattataataaatcggtaaaccatcaattttcgactattagatttatcttttttttcttaaaaaaaaccacaatccacatccatcgcctgtctcccaccggcataactctcctttccccactggcccacccttccgannnnnnnnnnnnnnnnnnnnnnnnnnnnnnnnnnngctatggatctacatccgt

SEQ ID NO: 21779 - DNA, 2862 bp, Oryza sativa
  unsure (1)..(2862): unsure at all n locations
ccgcgnnnnnnnnnnnnnnnnnnnnnnnnnnnnnnnnnnnnnnnnnnnnnnnnnnnnnatcgaatctatcttaagaatgcaacattcagcaagtcacagcagggatccttatgtggttgattattaccaccaagcttgcatcgcgaaaaggggtgccaattctaggccaaaggccaattttgccccaacgtcaatgaaagacttgccttccaagtcccgatccagtggtgaccatcatgcatatcttcaggttgatgctgtaggaagagtttccttctcttccatacgtaggcctcgttctcttcttgaagttgaccttccttcatcaagtgatggttctcatgatcagaagtcttctctgagaccattggagaaagaaccaatgctggccgctagagtcactgttgaagatgccctctgccttcttcttgaggtggatgatattgaccgtctgttgcagtctagtcaggcacaggataacagtttccaactgaggcgaagacggcaggtcctccttgaaggtttagctgcatcacttcagcttgttgaccctctcgggccgagcacatcaagccattcatctggattggctgctaaggatgatcttgtttttcttcgcattgtttctcttcctaaaggacgcaagtttttgtcacgttaccttcgacttcttacccctggaagtgagttgacccgtatagtatgcatggctatttttcgacatctgaggtacttgttcgggggtttaccatcagattctagtgcagcagaaacaacagttactcttgcaaagactctttcatcttgtgtgcgccatatggaactaggtgctcttagtgcttgccttgctgctgtggtctgttcacctgagcagccacctctgcgtcctctagctagctctgctggtgatggggcttctcttattattaaatcagtactggatcgagcaactgagttactgactgaccagcatgccgcagccagctatacagtgtcaaaccggactctctggcaggcatcatttgatgctttctttggacttctgacaaaatactgtctcagcaagtatgaaagtattaggcagatgtttaccatgcagtcaccaggctctgtaattggatctgaggtctccaaagcaaccagcagggagatgccggttgagttgctacgtgcaagcctccctcatacaaatgatcatcaacgccagctgctgtttgattttgctcagcgaaccatgccagtgactggttttaatgccagcggtgcaaatggtgggcacatcacctccgagtctgttcctggttgatttagctcaagatgccaaaaagtgtagattgtcaatgcttaaaggacttaaatgtgcttgtctttggatgataattcttttatatctggagacatgcataaccccttcataaggtaaggttgtgtgagcttggagaaagttccatttgctcaggaaaaaatagccttcagattgtgactttaggcttcagattaatctcatagaccaacaatctcctttctgtgggtcatttatatagcacccacctgatatgcatatgtacatgcactgttgtaacactatcgttggggcgaattttagcttttaacataacattcatatgctcccagtgaagaagacatccaagactagtgggtttagcagcagtggttgtacaggctctggtactttgaggttactataaatgttggcttattctttgctcaaaaacaattttttaggggggaactctggtggaatcatatattttttaccaggataaaggctgcctgcctttgttgtaagtttgtgtacagtagttattagttgcagccttaaactggatcatttgaatgaagtagtcgcagttaacctcgagtgatcatttaaatggagaaattcgtgggatttttatggaatttaggctatatcatgtgattctggcattcgaaagaagccaatatcatttttcagggcagcattttgaattttgagtattaacagtctataacagcgatcccatttgcaatgcaaatgactactcctatttgattttcagtaggatgaaagtgggccccgtcaattctctactagatccattccaaaatatagttgcatggcatgttgaaaaccaatcgtctggacaagcaaaacggtgtggtttattagtggcaagcaaaatgaagtactcattagcacgtgattaattaaatattagctcgaaaattttaaaaatatctactaatacactttttaaagaaacttttacttaaaaaacatcgtttaatagatcaagagatgtacacatgaaaaatgagatagtgaaagttgagaaaaagatatagaatggaaccttacttcacctacaaccatccgtaatttaatttctccatctattcctcaactaattataacatctcttatttaattttcttacctactattttatcttaattgattagtcacctaatcatttaattttaccttatctttaatctccatgaaagactcaagtttttatcttttttaatggagtcaaggagagagtatttgttactttgaccggttctcctacagccaaatgaccacaccagcttactttccttttctttgtttagcgaaagatttgcatcgaaatatgtgtaatccttttcttattttgattttccagaaggcccaaatactagatccaccaaatttaagacgatggataaaaaataaacgattttaaaagttaggggataccaatcaaacagttctacagttgagggacggaatggttttgagaccataagagcattctcaccaaatactccatcccatcatcctgaaaatggcatattggaaatgaaagtcag

SEQ ID NO: 21780 - DNA, 1901 bp, Oryza sativa
  unsure (1)..(1901): unsure at all n locations
ccccttgagtttcttaaaaacaataaatttgttttttcagctaggtttacaaatatggttataaaaaataatacaaatatatggatggtcagaagatattaacaacatatagaaaattgtgatatgaaggtatatggatgatctgttggagtgaaaaggaatatgtagagagaatcgttttctataataatccatatagggatatgaagatttaaatttggatgagctgctggatgctgtaagagagacaacatagactcctttcgaattgagttgcccatgggatggtggcacaaactttgctttcaccctgtagtgtatctcgtgggctgcagtgtagatcgaagccagatccaccgaaaacaaagcccagcagtaacaaggctgtgcatcaagtttttgggctgataccataggaaacaagagccttctacactgaatttttttcatttttaaatttttattttttaatatttacaaaaatattataccgacgaaaatatttatatagacccggccgcccaagtagagggcatcaaggtgacgtggcacatggcgccgtgtgcatattttgcgttgaggtcccttgccggcaagggggtaaatgtaattttcgccgcatgcaaaattcgcatgtccgctcagtggcctctagcatctggtcacacaagtcaccctgcccgagggcgacagtgtctattttttaaatatttttgccggtataatatttctataaatattaaaaatataaatttgaaaatgaaaaaaattccctacaccgggtccagtccagtcgtgaggacaaaagatttgggctatttgaaaaaaaacatagaaataggaataacttctattccggggagggcggcagagtctattttttaaatatttttgccggtataatatttctatatgtattaaaaaatataaatttaaaaatgaaaaaattccctacactgggtccagtccaattgtgcagacaaaagatttggactctgtgaaaaaaaaaacagataaataggaataacttctactccctccaaaatagacccagaaaatatcccattatattttagaacaaaaatagaactagtttggaaaatgtgttcacagagaacgatgaaatagctgttgtgaaaagctatatagaatgcacccttactacttctagagttcttaatttataccgaaaatattatgacatatagcattcaaaatttattttaaaatataataacttgttcacctatattctattctcaaccaatcataaccttcgaccatttaaattcttcacctatactactctttcgaaaacataatcttttttatgtttaatttcacttacttttttaacactacgatctaattcttaaaacttcttactccttgtatattttaggagggaggtatttgtttgatcatttttacgttttacaaatcatatttttcataagcagcgggtgggaaggatttcggctaagggtgaaaatggtataaaaattttccgaccgtaccgatacccgttccgtaaaattaatagtgataatatatttaccgacggttcttgttgtcaaaatttagtttttttcaattcatatcaccgtgataccgaagtgatactatatagttcaattcattaatatgaaaattttcccaccatttccacccgcttttttttaaaaaaaacaaaaaaaacaaaattaaggtatcgtttccgaccgttttcatccgtaccggctattcggtaattccggccggaggggctctgaaaaccgatgaaacagcacgtacggtgcgaggccctgacttttgagcaaggctttttgtagccttgcgcttgtgcacacgccaccccttctcccttcatttaataatgcccacaccaaaggagcgggana

SEQ ID NO: 21781 - DNA, 1915 bp, Oryza sativa
  unsure (1)..(1915): unsure at all n locations
gcggacacatctttctccgaaaagtaacgtgacgaacagctgatctgagctggaagtatcgtaacactactaaccaatcagcgactattcttcttttttcacaggcacgtcgaaagacaagcagcgggagcagcaggccgcatcgagaggcacgccaccgccgccgccgcngangacgcagcagcagcagggtggcaagaagcggcggcgagccgacgacgacgaggaggaggaggacgacggccgccgcggcggcgagctgcagagcaagctggtggagatcctggatcggagcagccggatggtggcggcgcagctggaggcgcagaacgccaacagccggctcgaccgggagcagcggcgagaccaggcggccagcctcgccgtcgtgctcggccggctcgccgacgcgctcggccggatcgccgacaagctatagccaggcatatacagtatatgaataagatactagtactcctatatgtaacgctaattaagcgtaggaattcaggttgttcggagtcacgtagagtgtgaaataatttacagcaggggagagagaggagaaggtgacatttttatggggatattgtacagattggcttagggatcattaattggcaattcgattcttttgtaaacccccggttctgaagttcggtcagaaaccgttattgatttgagatgttgcctttgttttgtactgtaatttatagggaggaaaggtaaggttgttactggcatcttgacgatctgaatcgtagcaatgtttatctgctttagtgaagttgcattaccaacgcaaaagttattttataaaagtatttcaggcaaacgtttccagatgaaagtttttcggacgaatgttttcagatgaatgttttttaggaaaagaaaatgtgcactgcgaacgcaaatgtgctaaataagaatcgccgtttaactttgggatatttttctcatcttgtatgagtcttttttcctgtttgatgtaagaaatggaattggttcattcgtttttacttgaatttatgaaaatgggccaaatgtcctagcaaaggcctagcttaacacgtcctccactctccaccgggatctattctagcaaggaagaagtctgttctgactccctcatctcttggtctttccccaaaaccggatatagcgccttccccatcttcgaaaactattacaaatcgactccctggatgtttttgtagatggttttatcctacatggtgcttaggtggcattttaaacagaaaaaaaaatgacagtgggtcccacatgtcggatcatcctccttcctcctcttcttctacactccttagccaacgactccggcgagcttgcaccaccatggtcatgccacagccgccaccaggcatcacccttgctgccacccaattcctttggcactgtagccgtggctacttttgaccacaacgcctcttcgtcgtctctttcctcaatcgtctgctttcaaccctagtgccacctcgatgagctctccgcggacgacgcagcggtggcacttacctccgcccaacgtgttgtggcacgggccaccctcgccacgccccttgccgttgccgccgaggtcgccaccctcgccctcctcgccgccatcgaggaattcctctggttcgcggaatcgagggaggtggagagaaaagggagtggtggtgcttgcttgcgagcctattggcgaggtggacgcgactgtcgctagcggagtagagggtggcctcgtcgctgtagtagagcatcccgaccttctcgggtggcggcgaggcaagtgaggtggtcttctcggtagcatcaactagcgcccgcggcaccatggatgcaccaagatgcattggcgccgcacatgcacaacattccttgggagggagnagtcgatctacaccgc

SEQ ID NO: 21782 - DNA, 2780 bp, Oryza sativa
  unsure (1)..(2780): unsure at all n locations
cctggactgaaatgacattcgacttggcacccanncntgtatccgtgcttaggagagctttggcttggttaattgtaatccaattggaccaattctcgtgtggattcatgtggatcaatgtttttaagcttataattggtcaggtactatcgagtgctgccgatgcggattaatggttacgtctcatggaatttagattcattactttgctgtagagcatgcatttctttgtaaagacattttggtctcaggtaggcactaccatattggacaattgatgccttacaacttacttagctatccttcaaaagtggggaaggctcaattaaagcgagcgggggattatgttttttcaggagttagtgattccatatgaacgttatgctatctagtataaatagtggaaataacaatggggtcatgaagatagtgaccccatttgacatagcatgttgcagtctcaaccaagttctgttcccttagaagccattttgtgttcttcattagttcaattgattctcaaattcactgttgagtgttgacaatgtctgctatgagcatgctcattgattacatcattttgctaataaaaatatccattgattggtatttttttttcataaatattattgaagtgttgccttactagtttccaatatacccatttggaaagtaatttttacaacgcaactcatactttgcagtctcggtggttccagctatcagagaatatgttgatacttcccaaaaggtaaaatgtttacataacgtaattcaaatcagatttcagtttttcgataaacatttgtgtatgttgctcttgattttttatgaaacttacattcaattttcttatgaatctggaatatgtccaggtagttggattcagaatctctagagaagagaatgatgattcatatacccaagaagttggcaatttttctgaatgccactcttctgaacatgggaattcaggtttttcagccaataatggcacctcaggccaggcaactcctcaaagacctgaattgatggaatccctgaagattgatcaatccactacaaattctagtgggaatggtactcaggtgactgctagaaagaatcagtctgtaaatgccaattatctgctgaatttccactatgatccaatttctcggccacagcctagaggccccagaacatatcctacaagaagacagaggaagatcagaccatacaacaaagatttgttcctacaagcaaattttaagtttgttgtgttggatactggaagctatgaaatagaattaatggatccagataagatgctccagtgggaagatattgtatgtgtaagatattatagcccttgtgaggtgcaatgccctatttgcttggagagcccattgtgcccacagattacatcatgtggtcatatatattgctttccatgcattttacgttatttacttatgggaaaagaagattacaaaggtgaaagctggaagaagtgcccactgtgtttcatgatgatctcaacaaaggagttgtatacaatctatattactcaagtccagcattttcatgttggtgacaatgtgacatttacacttttgagccgctcaaaaaattcactcactccttctattaagaacctcactgatgaatctactatagacgaagatccttgcagtgcattctccaagttcattttgacgtctgatgtggaactttctgttagagaggcaaaaacagatcttgttaattggttgcatatggcagatttaggccttgtggatgacttggagaaacttccatacgtttctaccgctttggagcagctagaagaacggatgaaatattggagtgagtacagaaattttagtgtcagccctcccctaaaagacagcttctcacctgtaactagttccaaatcaaggaaccctaataatgcacaatcttcacgccagaacagtgaacacaagctatctcctctatcagatgaagatatgattgctggtgtttcggagctctgtatttcacctgaatcaaataaaatctttaataaaggaatgccatcgaaaacagaagagagatgtatggctcccatagattcaaatgagaatgatacttataatttttaccaggtctgaagtatgtctggctgtgattgtttaccttgtgcacatggtttttcattctcagagttttgatatgtcaaatcttgttgcaggtatctgatggccaacacctaattcttcatccgctaaacatgaaatgccttataaaccattatggaagttctgatatgctcccaccaaggtatagtgtttgtttacaccttaaaagtcatcgctctcatattgacacattattttgtgtattgtattagtattgggtagattgcatcctgattatgattatggaaaattggatttttcactatgtaagcagagataatttgtttagtttgatctgataaccaattttactcaatttgctcgagcaatgtatttcttgtgtgcatgagatactacattctggttggagtgcttatctcttctcctttttttttgtatctggttgttgctcgtggtgtttgcttgatacttatccagcttacttgcacgcagaatacatggaaaaatcttggagctagaaactgtaacacaatccgaagctacaagaaagcgctatcgttatctaagtcacttctcattgacaacaacgttccaggtaaaccagttgtggataactaacttttacttncgggtaccgaggtagcntaacttcagcat

SEQ ID NO: 21783 - DNA, 1986 bp, Oryza sativa
aggaggaatcaaaattaatggtcaatgtgggcctctagggttcttctaagtgaagctaaggttcacatcagtagtgtccggaaagtggttatgttggaattgtttttgtgcttcaattataggcagatcgatgtgtgttgaatacgggtgtttatcagttgtttataagctaaaaggttccattcaacggtagaatttcatgagacacggatgaaagcggaatctgtgctgcgaccatcctgttggaacatgtagagttgaaaatcactagaacagtgcatgcttcttttgataattgatagtgactatgaatgtttcatcagaatatgacagtgaaatcgataatgttcaaggtagccttttggctgcttcgtcaaaagcctattctttgcttgtttaagtccaattataattccttttgatagttcatcaagctatagctgtatagcttctggctatggaatctttggtttggttagttttctagcacacttttccttgtgttgcttggcccaatgctcatttgctctggaactcaaagagaactattactgcattttgggatcaatagcataattgggcaaaaaccatataatctagttcgttacaaaatgctgcactgcttcaactgttggctgtattgccatttcttaaatgcttgagttgctctcgcattctctgctgcattgttgatagattgcattgccaatgattactatttagcagacttaaaattttcttgaggatcaaatgatggtttttattgtccatgtcatgtcatgtaagcctaagcttacaggttaacacttctagctttgagcaattgcaatttataacttttatatttttgttggttggattaaaaggtttttggggggttgaattgaaatagttaatgtgcttgtctaaatagccaattggagtttattgtgatgggcaaaatttatgtttaatattacattgcaattggccatcaatctttgaactgctcaggctctacaaggagttatggatgcatgcatgtttgagcaccctgcattctatacatgcccttttttttttaattttgtagcactttcaatttctacttccctccttagattatagatttactatcattttcagtgttgtggagttattctgattcaatttactatgttctgcagattgataatctgagtaacttgtccgatattgatgatcttgcgagcacttttgcaaaggtttgtttcacaagctccactgttttaaattgaggttccattattaaaaaaaaatgcttttgcagtaacccttggaagtattagatatgttaaggatacttatgctttaccattgttggctaagtggttactctaattcttccgtaatccattctcgtatcaagaaatgttttccccagaaaggttgcatcttcaggctgcatgtcactaatccccccaccttccaccccacaaggctaagctaacttaaacatcaagtgcacattttattcatttgtagttgtagctatctgcctatttccactacaactagtcctgcctgctgccaagcatgtacgggataaatgacacatggttagtcaagtcctttggctgaatctagcttcttctggcattgcaataatctgttttgcaatctgcaagtattttgccgcatctaaggcccaattgtacatagaagatctagatacatctgtaatgtctgaagttgttttggattgattagcttggctgttgttctttttctaaggatattttatatcatattgcttagttgaagcccatgcaaccaatggattaggaattcaggataatcactaatgaggcctcaacttttatctatacctgacaaattgcttgcatatggaaccgtaacttcataatattttgttctagccttaaaaacttatgtttttgtggatgccgtccgtcttgttgccgccacctgattaatttatatctttttttgtcacgtgaaccggac

SEQ ID NO: 21784 - DNA, 1462 bp, Oryza sativa
  unsure (1)..(1462): unsure at all n locations
naaaaatatgccagcttttgtatgcatctttgttgaaagctatatataatctcacttatgaaatgcttccattctgcattactgcacatgtttccaaaactttaatgccatcaatatcgaccagaagaaggctattttgtgtctattacacccttttgttgaaaaacaactattcttttggaactctgggatgtagccaaagtcaaattaatgcctgaaggctcaacttgttactgaactatgtaaatgcccttttcaggttctctaactgttgattgggctgaagatgtagaatttcctaactgggtagatcaagacattttagaggatgaggaatttcaggaaagtaaaagatggtggtcacagtcacacactctggtgcagcaaggggatgccaaaccattgagccgaacatcttcctatcctcagcaaccactgcagcaccgggcaagtgaacctatcattccaccaaaatctccttcatttacgtcctttccaccgccaggtggtagatcaccttatacttctcaaggccttacacgccatgggagcattccatcacttggtgctggcctgcaaatgggttctccaagcatgtcccttccaagttctccatatcatatagctggactatctcatggactaccgtatggagggagcatgtccttcggcacttcaaatctgcctgtaaacaatccaatgcaaaatgattggccaagccaagccaatctttatgctggggagcaatttaatctactgccgaacatgttacagaaacaaatatcacttccaaatagcccgatgtcatcactgttattttctcaacagcagcagagattggcacaagttcaagtccaaccatcccatcagaattacctaaatttaccacctcacatattttaccaacatcactccccagaattaacaggaagatttgattctgttagcagtgttccttcatcaagagacaagagatcaaggtcaggaagaggaaaacacaacatacgtttttctcaaccattgcctgatactggtaatcaaaatggtgatagtggaggaataaaattcagatctaagtacatgtcatctgaagagatcgaatctatcttaagaatgcaacattcagcaagtcacagcagtgatccttatgtggttgattattaccaccaagcttgcatcgcgaaaaggggtgccaattttaggccaaaggccaattttgccccaacgtcaatgaaagacttgccttccaagtcccgatccagtggtgaccatcatgcatatcttcaggttgatgctgtaggaagagtttccttctttttcatacgtaggcctcgttctcttcttgaagttgaccttccttcatcaagtgatggttctcatgatcagaagtcttctctgagaccattggagaaagaaccaatgctggccgctagagtcactgttgaagatgccctctgccttn

SEQ ID NO: 21785 - DNA, 837 bp, Oryza sativa
  unsure (1)..(837): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatccaggtgaagttgacggacaacctttgaagaagagaattcctgctaaggtgatgtggtattttcctataataccaaggctgaagcggtttttcaggaacaaatcacaagctagaatgatacggtggcacgcagaagaacgtaaacaggatgggatgctgagacaccccgctgacgggtcgcagtggcgaaatatcgacagaacatttaaagacttcggcgaggatgcacaaaacatgaggtttggtttaagcactgatggaatgaatccgtttggagagatgagcagtggccatagcacctggccagtcaccatgtgcatctacaatcttcccccttggctatgcatgaagcggaagtacatcatgatgccgattattattcaaggcccgaagcaacctggtaacgacattgatgtgtacctaagaccattggttgaagatctgaaagtgctgtggaggaaagagggcgtccccgtgtgggatgaggacaagcaggagcaatttaacatacgagcgttgctattcgttacaattaacgattggcctgcacttagtaacctatccagacaatcaaacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21786 - DNA, 2133 bp, Oryza sativa
  unsure (1)..(2133): unsure at all n locations
agcatgcaacgagggcgcgggctatccgccatcgtccgagaggcccgcgccgcccgcagccccatgatgtgcggcggcctcgccgtggcgcacgggctcggggcggtctccacggggaggcgagcgttgttcgtgncggcgtccgcggtgcaccgcgccgacgcgatggaggcgtgccgctacgtcatcgacgagtcaaggcgtccgtgcccatctggaagaaggaggtgtacgacgacggtgaggtctggaaggagaaccgcgagctcctcaaccgcaccaccaccgacggcgctgccgcggcgccggcgaggggcgcgcttgctgcggcagcaaggtgagagtcaacgagagctgatgcccaacctcccccaaaatactgtagattgtcaatgcttaaatgtgcttgtctgcggatggtaattcttttatatcttggagacatgcataaccccttcaatagagcaagtttaatagcccactactagtttcaattcatctatagccgatctaatagccaattcatacaatagttgcttactatactattaatatatggtcccacctgtcatacacacattgtgttttaaagtccatgctgcaggtggctatagatctgtagtccgcgactcttctctcttattttttatctcattaaaatatgtttatagctggttaatagcttgctattgtatctgctctaagtccattgtaatctatcttccactgccattgacaacgagggatcctaggtaaacgaagattcctagtttgtaaacttaaaaagaagaatggacaactacatagcatcctggtctaattagaatttagcatgtgtgacttatgataactatgtgcgtatgtttactatcaccttgctagtttagtaagagtggaaccgacatattagaattcatcccttcaaccatatgactcccgggttgatccttttatacgaagcgatgatggaagtataagtgaggtggtatgtgtaagtgggtccacctgtcaaatagactggttacgcagttctgaagggaaggctattacaatctattcagcataattgtactaatataggccaaagagaaaaatggtcatagacctaaaggacccagagcaggggaaagggaatttaaaccagtgtggtagcttcttctagaatcggctgtctcattaaaatgcaatgtccaatttgcagtatccaatttgcaagtggtccttgttgttttagcaactaaactgaagcacatgctgcctccaaccccagagcaatgcatggggtggcaactggcaactatctctaccaagagacaaaaaagaagtatgattaagtgtgggtaactagagacataaaccacaggaataggataaacaacaccaagacaaacattccagtcccagtagtgcttatagctaggctagaatggtgctaagcacaaactgcatcacgtgaacctaactaggaaaatactatatgctcatactatcatagtagtaagaaagcaagaggaatttaattctctcttggaagaacaagaatccaactaccaaatctctctctcccttatcccctttaacctcttcacaaggatttcttctttctttcttttctttttctcttttgttcttgtgggaacatgcatgacaggtgcaggcgtcagaatacggatgggcacaatggggaaggaggatgctaaacaacaaaaccagcgtcaggccagccagcatagaccacggtttgtatacacacacacacacacacacacacacacacacacacacacacacacatatatatatatatatatatatatatatatatatatatatctatatatatctatctactatatctctctatctagagccacataaagtacacacacctacacagagccacatatatatagcatatacataaatatacatccctctacataccaactaaatattcttcctatatatataggttggagatacacttaagtacttatagatacccagcggcctccctctagatgcatattttggatctcatttgttaccccctttgtccttttccaggttcctagtcagttttattcttaataaaagctggccctatataaatttgtacgttcttattatgct

SEQ ID NO: 21787 - DNA, 2016 bp, Oryza sativa
  unsure (1)..(2016): unsure at all n locations
tcttgttgttcccgtccggccgttgaaaccgaaccgtacccatactccgttaaccggtaccggaanccgtaaccggtgcccgttcttttgttcgaagggccaaggcngcngcgcggcggttgaccgcgcccacggacgacaaggaggtgtaccccgacgacgtggtggtcgacaccgcggcggcggagccgcctccgccgccgcggccccgcgcgcgcgagcagcggcgggaggaggacgacgcggaccgcgacgccggcgacggcgagtacgccgacgacgagcgcggatcgatggtcgtccgggtgccgtcctcccagttgatgtagtaaacttgccccgtctgcatcagcaaagccaatcacaaagcacatttcacacaaattcacatgaagtcatgaactacacatcaaaattcatctaaaaataataccaataaaggaaatgcgcttgaactagacagctagtggtacagattaagttaatcttgcaaatggcgaaatgctgtttcaagaatgtggtgagtaaatgtgcatgatgcatggagaagtttgggtggggaaaatctacaagtacattttggtgacagtctgcaagaacaattaatgcggtggcattcagttgcttccgtgaaacaaggttgagaacctattaataactgatgcccataacaaagtacagcagaacaggggaaagaaaaaaaatctggatcaaatggtgtaatgaatgctgctctctttgtcctcttgtttgtttgcaaatcacagggcaaggttggcaatgaagaacaccaccaccaaattctcatttcatcctttgtaaaaaaaaaaaactctaatctgcaggaaagctgttctacttaaaaagcacataaatgtattgcagtagtatcttcagaaaaggctactgaaataaccataagaagagcatttttgtctactctgttgctggagacaaggtggagatgaacactccattttggtgattaatacgcatgaatcttcattggggtaggcattcattcgtctgttcaaagtactagcagggatgaaaaagaaagggagacactttgtcacaatggaactgaagatttcccagaggtgagaatcatctggtgtttaacaaagctctgcgattagattagaacccaggaccaaaaaaacagagcattgtggtccagaagaaatctatagcgaaatctagagtttcagatagagacagagcaaaaaggaatggatctacagggatgtgtcagaaatttagaatgcaacacagatctgaatgcgcgcttagatcagagaccagagaaggtgtggagatttgaagagccttgatatcatcaacaaaaaaaaagaaaaaaatagtaccatcttttccgaggtttcttttctgaacttttgtcatccctgtgttaaaaagaacggcctgaatctctctgaagatgatcgaatccccaaccaaacgaagataagaaccgaagaaaaaaaacagagataaataaaaaaaatatttgcatagacgaagagaggaatcgcagatgaagcaaggatccaagaacaagaacaagaagagagaagggagacgaggagcagaaagagaagaggaggaagaagaaaaaaaaaatcagcgcggacgggtcgtctcgtctcgtctctctctccagttcgagcgcccgctttcgccattaatgatcaaatgattgatcccaatcgagcccaaaccaaaccacacccacctacctcggaaactgctatccatttatgtcttcaaatgattggacaaagggcggngcgccggcggccaccgncgncggcgccgaaagaatcgatcggggaagaaaaaggaaacgcggcgtatgcatgtatggatgcatgtgtggaaaaagagantggcgagtagtaatagacgtacccggatgtcgaggcactggtcccagtggtanggcanggcgaccctcgaagtgagctcgacggtgaccccctcgttgtggcgttcccttcggcggccgcgggcgct

SEQ ID NO: 21788 - DNA, 4838 bp, Oryza sativa
  unsure (1)..(4838): unsure at all n locations
cgcagaacgaccagagcacagcgacaaggcgaccaccacaaagancgggccatcaacaagacacaaanaaananannannnnaccccccacccctccccctttccaacaagaaccaaacggacggcgaggaagaagaagaagaagaagaagaagaaggaggaggaggagaaggaggaggagaaaggaatttgcttttgctgttgctgccgcagcggctgccgatgccgcggtggtggtggtggtgcgcgtggccccccgggggtagcgtaggcagcgtatgacgcgtgaggctacagtggtgaaggtgaaggtggtggtggtgcctggttggagccactgttatatatactgccattgttgctcctgctgctgccaatcttgggtgtttttggggtggttttttggttttggttttggtttatagggttctttggtttggtttaggagggggtggagggaattggaggaacagtctgtctggacgagtgccaactgtgtgccgacatagtatgcgctgggattaacggacggacgccgatgcctgcccagggtatcgggcggtttctggttcacttcctacgtcttgtatgcctgcccaaggtatcgggtggtttctggtgcacttcctacggctgatatggtgctggcgggtgggggtgggagcgtcgtgatatgcgccgatggtttttccggcgcctatgtaaatctgggggccgtgagagaggttttgttttcgtgcgctggattcactggcgtgtaagtatgcgtattaggctatgagtaattgacggcttgtccgcttccttcttagtgaagtaatgatactgtaataatgagatatgcttccaaaacaacgagaggtcgagagcgatcaaggtgaaagttttaattaaccatgcctagcttcctggtattcatgaatggtattctatgctacgatagtccaaaggcctatggaacctgtttcacatgtgtataccgagtctatataagtaattgtgtgttccttatcaatgttgcattgaggatgctatagaagacaataatatttttttaatgaatgaaccagccttgatcttctttttgtttaagataaaagaagaaggaaacctgtgataatgtggtgtacgcccaaaggaagaaaagtataagcatgaaggggttgaaaggtgcaaatgatgaaagctttctgctgcagccaagggggagagagagagggggatcgatgaatgatgctagggggaaaggtaacatcaacctactaccatggccactctctctctctctctctacatatcgctctctctcgtatggtgtgttttggtgttgcatgttgtccctgctggctgatgcagctagcggagctcaaaccaaaccactggcccggcccggctcttgggccaccatctcctgcgcagattcctcttctgccaaaccgaggaaaggttccccccttgtccctccctcctcctctctctttctctctctccttccttgaatcaacctgaccatttcaaaaactccatcacaactagctgaatttgtctcttggaaaatggcattagcttagcagcaaaatgtggcaataaaattatagaaaacatgcagtgttatgtacagtgtaactgtgtagagagagagagagagagagagtgtgtgtgtgtgtgtgtggaggaagaagaagctgagagcctgagagcaagcacggtcagtggcctctgatgtctttgacctactagcatgcatgcatgtacaccactgttgcaacatcagacgagatggatggatcgagctgggacgcatgcgagttaatacttttttttattctatattgatcatcatatatataagttttttcatgaaaaccaatgtgagttgagaacatttgaaacgttgtagagagttttagcaaaatttgttaagtcttctgaatgtgtaacacatctggtcgtcgccttcatataatttgacaggcacatatcaagctgaagttgactggatatgtgagattgtctcacatgttcactactcgatatcacatattttatttaatgtaattaagttgtgatggaaaaaatgaaagcttaacaacctctaaatgcgtgcatgcatacatgcatgcttaatttgcatgcatgcataaatcgcatcacttaacattgggtgagtatgaattatcccaagatctgaaatcagacatctttcatgctcaattattaatatcggatgaagaacctctaacttaatccggagtggttatgatcttagttggtagtcaagtcagcattttatttaaaaacaatatgcggaatccacctatcagattctctccgtttcacccctctctaacagatggatcccaccgatttcttaaaaaatgctacctagactgtcatgtaggaccaaaaccactctagattaagttaggagagttcttcacttgatattaatagttgagggtaaaaaatatctagttttcagatctaggtgtaattcgtactcacctaatagtttagaggtgtaatttagactttctcctaaatacaatactgttgcacgtcaaaccaaagggcactggttatataatgatcaatttaaattttttagtattatatgatgatcaatatgtgaagggatcgatgatgtcacactacgtattatgttagtttattttagaaagaaaggagcatggagaatctcttattaccatgtagcttgtctctgtcctctcctctccggcatgcatgcacgcgcttgcgttgcttcgtttcgcttggttgcttgcacgcttgtccatgcatgcatgcacgcgtggtgtaccgcgaaaatcttttggatggctgcgcctagctcgtgttcgtgcatctatctatctatctatctatctatctgtctatcttgcatcatcatcacgtactctatctgcctatcttgcatcatcatcacgtactggatcgatgtatgtatctctttcctcctcctcctcctttttttgatctagcatatagcttaatttgttctcgttctcgttgttgcggtgtacgctctgctagattccaatgcagatgcgtggtagtactcctacgtgggtaacatgggacatggccgttgttgcttgctcgctttgctgatctctggtggtttctctcacgcccaatgacgacgacgaccatgatgatgattgatggaactccggaaagggggagattgttttgtagggccgtagctgtctctggaacagatatgctgcatcgatctcggaccaaccctgctactagtagtggtagtggtggtagcggagatcggtcgatttttttgggccctgttgattcaagtggacgggcaaatgcgaccctccccacacggttgtgcatgggatcgacgttttcctcctcccacgtactacctccttccctaaatgtttgacgtcattgatttttttaaatatgtttgaccattcgtcttattaaaaaacttttgtgaaatatgtaaaactatatgtatacataaaagtatatttaacaataaatcaaatgataggaaaagaattaataaatacttgatttttttaaataaaataaacggtcaaacatatttaaaaaagtcaacggtgtcaaatattttgggatggagggagtacgtacgtactacctccatatatttcgatagaatcgactaaggcagtgtttgtttctatggaaggaagataaagttagtgcacagaaaacacgaaaaggacccgtaaaaaaacacgaaaagtcattattaactcataatttattaataagttttcattattacaaaaaaattgtgcaacaactttcatttatcaccgctacataacaggtttttccatacggtccaatcccaattttcacggatggcagggcgatccacatgcaccaaatggtctgtgaaaatcgttcacgcgaaaatccgactttttacgtgcgggtgcttatgtcgcccgctcgcaaaaataaaaatccaaaaaaattaaaacccaaaaatggcgaaacctaacctgccctcctcgtcgtcgttgtgggggcataggggcctagcggcggctgggtccgcccgctcccgtcgccggagccagagccagatccaccgccactgtgcctcccactgccgccgcgcggggtagggcagccgctgcccctccccaccgttgtatccgccgccgccgcgcctcactgttggtatttattatgaccacggaataatctataagcgcacaaataccgttgtagccttcacccaagagtattccagtgtatcgtatccacagtaaacgtgtgtgtataatctaagaacgaaattcttcgaaggacaacaactaaatgataggcttgggatagagtggactcctgtgggttagttatcttaattaagttaacgtaaaactctatcacatgggcaagataacttgtcaaaaaaccaaatcagtgccaggtccattggtgaaagactatcttagcacaattttccatttgaaaaaataatagtaaaaggacctcgacaatcctttgctagccaataattcacatacctattcatgtaaacaaatcacaactacgaaaaggattttttcgtgcggtggaaaagggttttcacgtgcgagtgggcgaaccgcacgcacccagttgtctgcgaaaatcgctattttttgcgtgcgggtggcgcaccctcatgcgaaaatctgattttcacgtgcgggtgcttatatcgnccgcnnacgcaaaataaaaancaaaaaaaaaaaaaaaaaaccgaaccctaaccttgcaccaataccgtcgttctcgtcagatccgncatcngcacgcctctn

SEQ ID NO: 21789 - DNA, 768 bp, Oryza sativa
  unsure (1)..(768): unsure at all n locations
tcctcgtcgtcgcngttgtcctcgtcagatcagccaccgtnangcctcttcccacnnggcggcgggcngcngcacaaccaaataagtggcttcaagcaaagcatgctctgctgttcctcagaagtctcaaccaccgtattaatcagaagagtgcccaaaataccacgaacttccaagcgaactctatatggcaactctccattgaggggctcaataactgtgtactatggagcttcaatgtaaccggcaacaaatgtcatatttgcaagctccgcaacaaatccttccatgccttcaccatggtgagtacagggagaatcggccatctaaagaaaagatagaaggaacaaaactgactccgatcagaaacgagatgctggcattaaaactggaaacaaaaagaaagaaaaggcactaaactgaaatcaaaaatactgaagcaatataaatattttttaaaaaaatactatttttggcccaaatttttttttaaaaaacgaaactctccctttctttttaaaccgaaacccttccctttttttctgccaaaaccttttccttttttttgccaagaatttttttccgaaaatattatttttcttttgaaatgccgaaaacatttttttaaaaaaaaaatcaaaaggcacaaagaaaaatattttttttttgatgaaattcagaaacttgaaaacaaactcatttatttggactnnnnnnnnnnnnnnnnnnnnnnnnnnnnnnnnnnnnnagaggtcaacaacaatacac

SEQ ID NO: 21790 - DNA, 4917 bp, Oryza sativa
  unsure (1)..(4917): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacatagtctaataacaaaacaaattacagatttcacacgtaaactgcgagacgaatttattaagcttaattaatccatcattaggaaatatttactatagcgccacattgtcaaatcatgacgcaattaggcttaaaagatttgtctcacaatttacacgcaatatgtataattggtttttttttctacatttaatactccgtgcatgtgtcaaacatttgatgtgacagtataaaagttttcgcatgaaaactaaacagggccttaggctttaagagtatgtgatgattaaccaagctccttggaacatattcctcccagccatccccatgacaaagaatattctgtccaccaataattctataaaagtctcgtatgcatggtagctaaaaaggaaaccaaacaattaactgccccatcagttctaaaatataacaacttcttcaattaattttttatccaaaatatagcaacctagtaaatgtaatagttgatttttaacatcttttcttaatacttgtgccgaatgctaaaaattgatagattttaagatgggaggagtatctagtttgtgcagcaaacacccatcaacaatcaaacataattttacatccttaagtatcaaaaactggtaagaagaaaaaaaaaccctagtgcaatacaacctcacttatactaagtggttttcatgatttgacatccaaatatacgtgttttacttgcatttaactactcatcaattgtaaaaagaacaccttttgaatttcagaatcataaaaagcacgatatgaaacaagtttgtattctatattatattatctacttgtattagaatgtatataaacgcattagtgatttatatgcttcattttatagctatataaataatgtgaaaacttagttagaaccacatgctacataggatcctgccctcaaatatcctcgagtattcacatcattccatatgattgtcaagggacgtaaaatatctagttttatagttgataaatttttttaataaatagagaggtgtaatagggatttatcccacacgaagaaatacaaaagtggtcctgcaaagcgctcttttaaacgaagggtgttttttacttcacgccaaaattgaaagtttgattgaaattagaacaatgtgacgaaaaagttggaattttggccgtgtttagttcccccaaattcccaactttccattccatcacatcatatcgaaaactttcctacacacataaactaccaattttttcttcaaactaccaactttctcctaacttcccaactttttcaccatctaaacacaacctttgtatgtgtaggaaagttttgatgtgatgaaaatgttaaaagtttttaaaaaaaagttaggaactaaagcaggacgaaagcaaacggaaccgaatacttctatccgcacaatgcagcttttgatcctttcagaaaaaaaatgcgtgttccttttgacatgtttggtaccggccagtgacagcttcttctagacggcgtttcagcacaggaagcttttgagaaaattaaaaaaaaattagagaaggctgaacaattggagaagggcaagaggccagtggcatatttatttgtttggagggaaaaaaaaggaaaggaaaagttcatgaacaaatgaaatgtcttcagaaacaaaaacaatgaacaactgaaatgatcaactgggctgtttgcctgttggtaggttatggcgtttggtgtgagacgctgatggctaacaacgtcaaaccccaaatggaccgatgaaacagtagtgaacaaggttccccactcgcgtcttctgttgaaaacgatgttcttctctgttgtagctgcacttttttttttaccctatgtgagtgactggaaatattgcatgagaagattccaaatattggttttgtgtggaattacaggggtgtatctgcaggctgcgatattttactggaaaaaaaatatctaaagccattttttttgatatttcgaaccatttaattgactgaaacaaaatgtacatttagtcatatgctctctactaaacgtgcattaggatgctagggatgttctttttttaaacggtgggagtaaaatgtatatataggttgactttaactgattgaccttaaacatagagttgccataggctgtgttcggcattccctcttcccaacccctatccctcgttttccacgcacacgcttttaaaacggctaaacggtgcatttttttaaaaaagtttctatacgagagttgcttaaaaaatcaaattaattaattttttaaaaaatagctaatacttaattaatcacgcgctaatggaacgctccgtttttcgtacagacggttctagctgggaaccaggaatagcgaacacatccatagtctctaaatctccacgtagccctttctgaataaaataaagaccacaaaacgatcatcaaattttacgcttgttatctacttgtattagaatggatatagatgcattagtgatttatatgcttcattttatagctatataaataatgtgaaaacttagttagaaccacatactacataggatcctgcccccaaatatcctcgagtacattggaaacctaccaccaccactggcaattaacaattcctctattcaccactaaccaattgctaaccgagtgccaaaatccaccccaagaccttcttcagtgcaacagataatcatagaagagagagaagaaagataaggattagcagtaacactagaataaatttaagcatcagggcctaaaaaatgcaccatgaaaagagagaaaaggtgggaaagaaagcaagcacaaaaagaaaataaatatagattgagtaacaaacaagccaaagctaaagtctttcttctctctcctatgcctacccccttgctaatcccctctctctctccttatttgtgtgccttccaagtgcaaccctaacaagtctcctacttaaaaaaagaaaaaaatatatcgttttgctaatttacttttgtcattcttatttttgggattgctaaattctcctcctctaggagtacactagtacagtacttggatatcccaaaaacttttttttatatttatttgtagttggatatcccaaaaactatttttttaatatatatttatttaaggcaggggaggggaggagaaaaggaaaagagggagaagtaattaagcaacagtgaggccggagctatctatctatccatctatctatcatctactatccttcctctctttcctcctcctcgcgcagccgcgctcagatccaaagccgcgcgcgggggagggagggaggaatcgcggtgccaagaaacgaagccctagccccccctagatgcgcgccgccgcttgctgctgctgctgctgctagggttcttgtacggagatgcggggcgtcgagtcggatggcggcggcggcgcgcctttctcctcctcctcctccgcggccgctccaggtgaggcttttttttttttcttgaggcttcttgatctggtagctgctgctgctgcgagtagtttggggtgctgtgttggcgttgaatttggtttgcgggaaaagtcggcgccttgatctgttttgctgtctcttcccgatgcgaatcgttgggttatcgacggagaattgctcgaattccaactaggaaaggatgtctgttggttttctttttttgttggcttgattggtgtttcgtgatgttcttgctgttgttctttgttctcggttgtaattttgggggtaaaagatgtgggtttttactgcgtacgattagtatgatctgcgccatctgacgcttttttctcgatgcagataatttcgatgccgcgcagtactccttcttcgggaaggagccactggaggggctcgagctcagttgcttgaagaatggcggcgccgccggtggtgatgccaatggcggtggattcagtggaggagcagaagaagggctgtaccggctctcctctgttggagaagaggtgcgaggattcaggagccttcatgcccatagattgccgtctttgttgtgaactatcgtcgtgctattcgtttgtgttcttgggttcacatgcatgctttagctctttttctcgataacacagtcctttcggcatggcggcaagcgatagtggaggcttagtgctaggaggaatcaagaataaatgtccatgtgggcctctagggtcttactagtggagctgaggttcacatcagtagtgtccgggaagtggctatgttggaatgtttttgtgcttcaagtgagcccccccccccccccnnnnnnnctcnnnnnnntnncttnnntnttnnnncncatnctcccttctctcctctttttcctctctcctttcttctcttatatttcttttttttttccccnntttgctacagtagagttgagaatcactagaacagnggctggcgttttttgataattgatagggactatgaatgtttcatcaggatatgacagtgaaatcgataatgttcaaggtagccttttggctgcttcgtcaaaagcctattctttgctcgtttaagtccaattataattccttttgataagtcatcaagctatagctggatagcttcttgctatggaatcttggtttggctagttttc

SEQ ID NO: 21791 - DNA, 4063 bp, Oryza sativa
cttcgtcaaagtaaagaaatgcgggaaaaagcttttgaacggcagcagcatctttatctgtatcttgtactttatgtttccttgtccttctaatggtggggcccggcctccccagtgagttgcgggacccaccgctccagtggaagacaagattctttaggcctgttttacttcccaaaattcttttcctaaaaacgtcacatcgaatctttgacacatgcatagatcattaaatatatataaaaacaaaaactaattacacagtttgtatgaaaatcgtgagataaatgttttgagcataattaatccatgattagccataagtgatacagtaacccacatgtgctaatgacggcttaattgagctcaaaagattcgtctcgcggtttccaggcgagttatgaaattagcttttttattcgtgcccgaaaaccccttccgacatgcaatcaaatatctgatgtgacacctaaattttttttttcgcgaaataaacacacccttagtccatgagcacaggtgcagtagtagcttcgaaaaaaaatactaaaaaaaaactccgaaaagggagaactgaagacctaaatacgggaggaggtgaaattcagggggttcatgttcaggttcaggtggccaacacatggccttgacagtccagttcagcaaaaatgcatggaggattatgggggtatatacgagctctcatgctaagacattattgttagcaataatgcagccaaataattgggtcaaattctatctaaacttgccttctgcctttgggccctgggcatatgcgttttggattggggccaatagctcgtctcatcgcctgacattattttatgatgatgatcagtgccgaagctccgatttgccattgggaggggcgggggggtgtggctataatgctgtcatgccggccagactccataacaatcactgcagatatataagtatacaatctataatcgctgcagatatataagtaaacaatctatggctctgtagcttgataaatcaaccaacatatgttttgcgatacaaaagaagcccaaatgttcattataccattaggtagcaactagttccaagtctccaacatcaaataaacaatgtaacatggctgcatacgatttaccataaaaaaattacatctcaactaacttgaatttgcatctacgagaattagctagatcaaatgccttaataatatcattggaactaatcattgctgataaatccttttcaatatagactaccaaataatcacgcaaataggcatctcccattttacttcgaagacgagtcttgacaattttcatagctgaaaaggctctctcggtggttgcagttgacacaggaagagtcaagactaatctcaacaacctatccaccattggataagaagaatctttgccaagcttaacaagtccacttgttaaatcagccaaagatgataaaatttctagttccggatggttgcacacatcaagttgaaagtgtggcaattggcactctaattgcattcgttcttgatttgagaaatctgtgggatagtacttctccactagaatgcataccttttccatgtcaaatgagtcaagccttggatccaaggacacacaaagtgctaaaaggtctgtagcttgagaaccaaatcgatcttctaattcaatcagttgttgatcaattgcaacattaaacacatcaactttataatggtgtaaagttgaggtgttatcattcttgtttcgagattttgtcacatcaacaaacctaaaaatacaagggtaaataagattaatccatacaaaagaaatcaccattcagatttaacaatttaggcaaaagaacttacttcctattcagatctggaatatcaatctcatgcttctcacagaaggatttgacctcctgtagaagaggctcccaaccatcatttcttaagtcaccaagtaacattttggtgttagaaacagaatcaactgcatttaaaatatcaattgacttcttttggagagtttggcacagcacatcagtgattttcataatcttttccatcatgagcataataaacacaaaatcaaatgtgataatcattcgcagggcacatgaagcatctccacgtgaatactttgaaactgaatgatcatgtgcaatgttgcgtagaactgaaactattgcaccaaacattttctttaagctctgaattgacttgtaatgggaactccatctggtatcccctggcctttgtagagagctcatctgatttgcccctcttcctgtgtcaagctctcccaactcaatttcacgagatatttcttcagcttgtgtagctagtaactcattgttgcgcttaggagatacactcacaacatttatgatgaaatttgcatgctgaaagaagttatgtacctcatgtacttctcttgatgccgcgacaagagccaattggagctggtgagccatgcaatgaatgtaatatgcataagggcactcatttagaactagtgccttcaatccattccactcccctctcatgttgcttgtcccgtcataaccttgacctctaatgtcttgtatattcaagctattatcagataagacagcacaaattgagtttttaagagtcaatgcagcagtgtccttaacatgaacaaggtcaagaaaacgctccttgataagtccttctttggtaacaaagcgaaggactattgccatttgctcttttttagattcatctcgagcttcatcaaccatgatgcaaaacttgctattgccaatttcttctctaactgatttttgcacttttctagcaattatgcttagaatttccttttggacatcagatgaaatgtactttgcatttcttggagcattttccaacacaacttctttcacctccttgttaaatgaagccaaaagcttgaccatttcaagaaaattacctcgatttaacgaatttatagattcatcatggcctctaaatggacacccttgaagtgttaaccacctattatgatagacaatactaagtgctgttagatattaaattattgacatagtatagtcttacatataaataatatgcaaaagaaaaaagaacaaaacttattacctaatggactcaatggtagttgtaagccttagtcttgctcctgcaaacaatttttctttttgtgcaattactgccctgtcaatgtgagccatactatttttgagattattgaaacaaccaacagaatagttatgagcagatccagagttacccatatgttttagaaaagcacactcttttccttcattaactttcttccaattttggaaccccctcactgtgaatgtatctgatccaaacctcccaattggtttctttgaaaagagaaaacatggcttgacaataagcacgggccgtgtaaggtgaatactctagccaactaaattgtttaaaccaattgctttggaatcgacgagcatgagatgcatcattcaatgggtactcatccaatataaattgatatgggccttcagatatataaaatctttgagctttatcttgttgatcagcagggagtgcagagatttgaacacgtttacctgggtccctctcaaatgccgtaggtaccaatacttcttgttcagcttgcaaattttgctgatcaggaacttccacattggttgggctaggattttcaatttcaactgagacagccctagcaacaactggcttgtagaagcaatcaatcggttatcgttttcctcttcatcttggctgaaattaagatgggaaataacaaaactgagtactcataaactgattgaagtctaatggctaccagatacaacctacaaaacttttgttgtattggggatttggaagagaaaagggaaacttggagaaagaacctaccctaaacgggttgaacaccacctgttttttggaacttccgcagatagtgggcttgtgccctggcagagtccaattccggcttccaacgtgtttaacggggagaaaggcgaacgttgttgaaaggcgaaatcacacaaaagcttgcccccg

SEQ ID NO: 21792 - DNA, 1128 bp, Oryza sativa
  unsure (1)..(1128): unsure at all n locations
aactgaagaggaacttcacctgaacggctgaacacccctgtcttctggactccggcggatggtgggctggtgcctggcggcgtccagtccggcctccaacgtgctcaacggcgagataggcgatcgctgatgaagggcgaaatcacacaaaagcttgccgccggcgccccttttccgttttttggcttcgtcgctgatggttgctgctcctgctcgcctatggcattgcgcaatgcgaaggtgaagcaacggctagcggggtgatcgagacgaggaattaacgaagaaggcgaggcgtttttttcctaatggtgggctgagatgagaacttgccttgggctattgggcttaccactaccagggagatagaagagggttttggggggggggtcggcccaaatctgataggggggtgttggcccaccccggccccccctgtagcttcgccactgatgatgatgcaaaaggagaatcgaccatgttgattaattgtcgaagctgagcgttattcggatggatagggaagggtccatcagtctccatgcattggctcaacaagatatgagggcaaattggtccttcatcctctccgcgcgattaatattagtagcgcctttggcgagggcaaaatcggctattgtcctgcggtcacaaatagttccgcttgtttgctataatacattatgtcgattaaaattatatgttcggataatcaggcaaaagcagggtttagaatcttgttaaggatatcgaacaccaaggaatttcaatcagattaactatttcaaatttgggtttctcaaaaaacattcaaagttctcctagagaactgactttagcttggttcaagaagcttaaagttttaaaaaatcaaatggttttcgttgagattgttaaccctgggtgaaggaaggaaaggaagatgggttgatcatattatttcccttcatagaagtcagtcccataagtcatactcgcatacgtatttctttttgttaccaaatagttcttgtgacatatttagaaaacggatatatcaaatagagtgtccaagcgcatgtaaataaccgtcgtttttgtaaagttctantttnnaatnggggactcagtgtctcagntttcaccact

SEQ ID NO: 21793 - DNA, 1638 bp, Oryza sativa
gaggcgggcagtccagtaaggcgcggggcgccacattcggcccggactacaccggaaccgaccgagctggtagaacggcagccacctccctccaccggccaccgagcggcacagtgcgtgccgtccgccctgagccgacaagcgcgcgagagaggggaagagaaaaacatgagatagatacagtatatatatgccaggtgggccccaaaataaaatgctgactgaattgccacgtgtacgccacatagaccaaaaccaccccggattgggttgaggggggtaatttgtctggtttgcatagttggggttgaagaatatctggatttgtagtttagggagtaattcagacaaccgcgatagttcaggggggtaattcgtactttttccttatttgtataactgtgtatccaaatttatagccaaacgttattatatttaggacgaatgtagtagtttttagcataaaacttttatactactacttttagcctccaaaagccaaaactgaaaatagaaagcgacgaaaaagcctccatgtcaatctaaaattaggttctgaaatgcaaaggccgcaattcaaataagccaacatagattacctgcatatgccagattgttaggaattgcgcaccgacattaaaattgttattcttatgttaggggggccacaattgtctgcttgaaattgtaagaataccaaagataaaaatttgagattatgtttaagctcaaattacacaagcaggtaagccagtctgtaaaatcaaagatataacaactagtatatccgaaaggactggtacttgatcaactttccctatcaagcccactttttagtcccaatgcacataaaacacatatacccaagagaagagagtgaatgacacaaaaaattcctcccaacagggatctttctttccttactaacctgatctggcattatcaaatctcattacttgcaagcaactcacccagcaaacagtgacaactgacaactcgttgatccattccagttctgaaaccggagagaattgtaccaacagggatctttcttttctcactttcaggcttcaaccaccagccgctaattgcaatggattctttgttctgccatccccccacaaagccctactttatggaaaagaaatgagggaacaagtgcctatcttgcataggatatgtatttaattgcaggattaatattaatcaattagtaggtgagaacatgaggtgatagatgtaagtagatagatggtgtgtgtctgtgtagagatagggtggcttaattagaaaaggccaggtaggggatggttgttggtttgtcactttgttcagtgccacagctaagaccccacattattttgcactctctctgattggatggattaagtggttgggatcataaatggattgtgccactaatagtatcaaggggattaattctagcaagttgattagtatatgccatcagaaggtgattgtgtgctttctgtattcttgttcaagtatgttatggttttctgtttcttgtccaagccaagatctggtgattgtgtgctccctttttttcctcttcttgatcagatgacacatcatttgtgtatgttaaagaggaaaaatcatttatgtgtgatctgg

SEQ ID NO: 21794 - DNA, 6744 bp, Oryza sativa
aaattatgtttgatgttaatgggtgttgcctgcacaaactagaaactcctcccatcttaaaatctatcaattttagcattcggcacaagtattaaaaaaagatgttaaaatcaacttattacatttactaggttgctatattttggataaaaattaattgaagaagttgttatattttagaactgatggggcagttaattgtttggtttcctttttagctaccatgcatacgagacttttatagaattattggtggacagaatattctttgtcatggggatggctgggaggaatatgttccaaggagcttggttaatcatcacatactcttaaagcctaaggccctgtttagttttcatgcgaaaacttttatactgtcacatcaaatgtttgacacatgcacggagtattaaatgtagaaaaaaaaaccaattatacatattgcgtgtaaattgtgagacaaatcttttaagcctaattgcgtcatgatttgacaatgtggcgctatagtaaatatttcctaatgatggattaattaagcttaataaattcgtctcgcagtttacgtgtgaaatctgtaatttgttttgttattagactatgtttaatacttcaaatgtatgtccatatatccgatgtgacacgccaaggctaaatttttttttgccaactaaacagggccttaattctggagcaaacacaaaaccttagtctggctgccccagaacccaggaatctgcatacggcaatggcgagagtgatgtgagcttccgctattacgaatcaacattgacttctactccaacattgctttcggacccgtttggtagagctccaactttaaaatttaactccagaatttggatttggggtgatgttgtgaaatagcctaacatagctccacctctttagtttattttgggagagcgctttatccggctatactcttattttagggggagctgaaaatgtttgactgagctccagctccaatagaagtggagctataggagctggagagtcaaacatgcccttcctctagctacacaagtgaagtacgtatgatagtaagggtccatttgttttgaagggaaattatagaaattttataggattctaatcctataaaactttttcctacatgaccctttgaaacaaaggattgaaaactattaaatactgtaaaatttctaagaaatgtctcaatccatacgagttttggagaattttaacatgaggtccaaactcatggaaagtttattataagcctatctctcttatctaattcctacgattttccgatggttcaattaaatgatcattcatatatttttttctacgttttacaatcctctaatttttatagaattcctatcaaaaaaaattatgtttttcatattcctcccttttctcaatccttcgattcagaggccctgaaagtttatacattgtagatatactccctccgtaaaaaaaatacttggctgctgcaatacggcaaggggattaaggctgtctttagatctaaagttttttttttcaaacttccaacttttccatcacatcaaaactttcctacacacaaacttccaattttgacgtcaactaaacacagcctaattacttggcttgttttggctcaggagttgtaccagcaacatgtactactagtgtactatattactggaagctagtacgactatcttgtagttgtagctacagtgagcttatgctacacgtgacagttccctttcgagctaagcattaacttgatgaacattagttaacttcttcataaagttaattaatatttgtctccaagaaacctaaaccccacaaattaaatctccacaaagatagtaaagtgcagaatacctactacggagtacccggtcaaaaaaaaaacctactacggagtatctagtagcacgccatcctttaatataaacaattgcagcaattacattaaactctataaacctagtaatgccagccaaatatttaatacaacttcaaacaacataccatcggatctagtaatgcccccatttaaattacttatcattttagtttggcctaaccattaatttttcgaaatcagtacaatttaattacaaataaattagagtaaatttcataaactacatatactttacacgatttatcacaaaactacatatttaagaatttatttcacaaaaccacagatttagtgtcttcgtttattacaaaactacatgtacttggcataatatatcacaaaactacatatttaagaacttgtttcacaaaactacagatttaatatctccatcatcacaaaactactacaggttttagcaatgaagacactatatgtgtagttctgtgataaataaatacactgaatctatagttctgtgaaacaagttcttaaatctatagtattatgatagattgtacaaagtacatctagttttgtgataaacggagacactaaatctgtagttttgtgaaataaactcttaaacttgtagtttcgtgataaattgtgcaaaatacctatagttttgtaaaatttactcttatataatagaaatatatttcttatgataaatataaattataaatctaaaacaaactgtacgaatatatagagattaatggtcaaatatagaaatatccatgcagccacgccaagtcccaaattcttgtcttagagtgtgtttggcaccccttgctcccaacataaatagtgtgtacggaaaatagagcgatccattagcgcatgattaattaagtattagctatttttttaaaaaatagattaatttgattttttaagcaacttttgtatagaaactttttaaaaaacataccatttagcagtttgaaaagcgtgcgcgcggaaaatgaacgaaaggggttgggaactaggggtgccaaacatggtttacattaccgtccgtataccggccttaccgcaggggtagggtaatagaaaaaccgctgtaacctccttaaattcaaataaatttaaaaaataatttaaatttttgataaattttacacgaaacagctttaactgccgaacacacccttaatccacgtcgccaaccttaatgttcgtagttgccgtgaagagaggtttgtcagatcagtgtcgtcccatgtcattttcatgcccgcccatgtcttatctgccaatctccattcacgccacaaccaccttattcatggtgctgttgcgaattcccttcctcgtaaagttaataaatatctagctccaagaaacaatattaataacttttagttaaacgccccaaacctcccctaaaataaaaaagtccgaatttcccctaaactattatggcagtataaattatccctcttaatttaaaaaccagaaatttttcatcttcaacttttcatatcgaacgaattatcccctgacccactctggaacggttttagttctacatgatacacatgtgacattctagttagcatataaaataaaaaatgctaagactcaattgtcagttctacctcttctctcgtcactacatatgggccctaccttatatttttatgctacctgaacggccacgtgtacgtgggccaaaatcgctcaggagaccagtagcgaaatatttcaaccttataaaaagttaagggtgaagaatgtctggtttttaattgatcgagtaattcttgttgctacaacagtctataatagtttaggggtaattcgaactttttactttttttactgaggaccaccccatatcaatttttcaatttctctcttctcttccggtttcccactgcacccaagccgccatgttcttccacaattaagttggtggcgaccgaggtcattgagctgcatgataacaacacgctcgacgctgctgcacaggccatcacggctagcccaaaagggtcgtgctggtgcctacaggcgacactccacgatctgtcccgtgacatttgttgccgctgctggcactagtgatcaagccatgatcaccatggtcgacgaggagaagagagatggagaaggggtgatccaaaataataaaaaaaaagagtaaagatatctagctttatatgaaaataggtaactatatgaacgtttggtagatacatataccagccaaatattcgatgcataattcagacaaattaaaatatcatccagtgtaagtaggtagccatttttttataatcaagcttaataccgactaatcgtgaggacgcaattacaaaaccggatacgtcaacgtacctagaagcacgtaacgatgacaagtttttctgtgtgactctccataccatttttattactactatctaagaaaaattgcggctttcgcttttagacgggtcaccaacgagaacgacgagaccgcggttgtacgtactctccccacgtgtacagcccaaaaatcggtgacacgtagcagtagcaaaacccacgttttgttgggctacctggaaaggttttagacgcatgcggctgacgactgacgacgatgggatggagatggacggtgatggatgctctctttgttactacttcttttggtaaaaaaaaataataaaactactggctatactcagatacataaatagaagttatgttttctttaagacgaagaaagtagtattttggacaacacacggcacgcacggacggtccatactagtctcgtactcttgaccaagcagatgtgttggatgctgtaatgcccccgtgcttttcttactataattccacttctgttaacatgttttttaaaccgcactagaactttctacgtagaaattactttaaaatattaattaaatctatttttaaaattgataatatttaaaacttgattattattatacgttgataattacttttttataatattttaaaatttataatatttttacacgttgataattttttccttaactctcattttttttaatcagtcgcgaacagggcaccgagaggcagaatagtagatcgatcgtacgatctatcatatatcgatcaggccatatgcacgcttgcccagctagggacgtgtgaccggtagtgggctccggcctccgcggtcttgggctgtgtccactgtccaccgcttcgccatggatccggatcggccggctgcttgtgccgcgcgcatcgtctcgccggggagctgaccaccggctctggggactgggaagggcagatcaacgagaagtgaacagcgtgaagagaaaaactgttttcgtcaacaaaagatgcattttggagggtccaatagcttttagatactgtggtggtacctgccaaaaacgataatattattgcggtatgacaaaatataaaacaatctgggaatctttccaagtgaaaagagaatctcaaaacatcatcttattgatccacataaaataaaaattctagaccatcagatagagaaaaggagggtgaaagcggccgttggattggattagtaaaaaaaccaatgaaacgctatctagagctttctagccttctttcttgcagggggagagagacagtgcacatcaggcaacgattatggctggatgggctggcttggccgatcataaataaatataataattcaagcccaaagatcgaaaacatagctctaagagcaagtttaatagttgctcttaatatatggtaaaaacataagatcgaaaacatagcccactattaactccaattcatctatagccaatctaatagtcaattcatataatagttgtttactatactattagtaaccatcatgatgcttaaaggtaaaatctccaatgacaatacaatatcaataagacgcatgcatgctcgacgaaacatttgatagtgcaattaatgggtgttttttctaacattattggtgagtaaacatggcaatccattttactacttcaaatcggacaacaatatttcaaaccaataaaagaaaaaaaaacatcttaccttactattatgatgctatgctcaaacgtagacctataatatttagcaacgaagggagtaataaaattagtatttattttcatgataacatttatttattacatacaagatagatatatttgtattgtatgtatagatttttggtcaaataagttttccgaacacctattaagtacataaaaataatatgagaatggtagggtcatacaaaaatgcaaacgatgatcggtggcaatgaggcggctaaactgctaaagcaaaagctaaaaagatgattagggagggagaaatggcagcatagaagacaaatacaaaacccaaccctgtccgctacaacaattctaaaactctattctgcatataaattctttaaaaaacatacaaataaacccacttctcatatttataaaccacggatccactgtcgccgataagtatagctatagactaagtataatttatcagtacaaacaacgtgtaaatgtaaacacgtttagtacataaagaggttaaagtcgtgcgaacgtatgactgtatacgctagttaatcatgaaagtgggataatgtaaccgcaattcggttggaaaatgctataataatcagtataaatttatataaatttctagagcaacataaagaaaataataccattcgtgtttgtagaataatctgagtcaacgcacatgtgacatcgtgaaaatttttataccaacaaaaagggtcaaaaagggttggcagattccgatacatattctagtattttaga

SEQ ID NO: 21795 - DNA, 716 bp, Oryza sativa
  unsure (1)..(716): unsure at all n locations
aaggaattgactgcnattctactggtaccaacacccctataaataaaatcggtacattacatcctccaactttaacaaccggtacaaatcaatatttttagtagtttgcaaagtggtttttactgacatgataggttgatcgtgcttagactcactaagtcagcatgggctactgtaggacccatgtgtcaacgcccactcttcttgtcccctctctttctttctccaaaccaagccaacaagcccctccgagcacgtccacttgtgagtccgtccaacatctagctccgagaggctatgatgcaacaggaggttgatgatcgaggacggagatcacaacggcatgggagctcaacaacgcgctcattgcaccatccccaagtcggcgctctctccctcatctcctgcgctacgcacacaaggagctcgaagctcctagcgaccacctcccaacggtcggacaaggggctttgggaggaggtcaacagaccgaggacgaaggtcatagcggcacgggaactcgaggagacgctcgccgcaccatccccaagccgatgctctctcccctatctcctccgccatgtgcgtgaggagcttaaagcttcccgcaaccaccccctagcaactagaccaggggctttgggagggtggtagactggggatagagggtgggtggcacgagagctcaggaggcgctcaactactatcctctttaa

SEQ ID NO: 21796 - DNA, 3502 bp, Oryza sativa
  unsure (1)..(3502): unsure at all n locations
gatgggccttgattgtcannttganaaccaccttgtacccccaattaagaagcctgaaaaacgtgtcattgaattattaaggaaaaagtcaatatataaccttaaactttacacagaattttatttagcacctaacttcaaaaccggatcgaacattcaacctgatgtaaaaccattcatattatctctaaagtagttttggatagttgttttacatatttcgaagcttcaacaagggttttgaatactccccccgtccttaaaaggaatgtagtaacgtttttgccttaaaaatttgtctatagaagggtgtagttttagagtgattcactacgcttctttaatagtgcttgaccatttcttatcatttgtaaccattgaaccaatagtactcgttcctccttgttttctcccattcttggtttctctccgtattaactccttgttttctcccattcttgttttctctccgtattaataaagggcatagaagtctttttaatctcttggttactatgtatttgattagttaaaactatattatattttttttgggctgagggagtaactaatataacataaaattgtcaacttccgtcctcaatttatacaatatagtaatgccaagtatgtgtttgcactcatttgtgggtgagagaaaaagaggtaaagatgaaatatttaagtagagattttaacatgtaccccaatgtgtatatcacatagtcaagtccattcaatatgtatgcaaatttgataaaaacaaaaatcatcttactataagtgtaaagtttggaggttgaatcttgggttttaaagtttagggcccctttaaaacataggaattttggagcatttcaatcctatagaaaaaattcctatgaatgcatttgaatcaaaggattgaattatatccattcatttgaaattcctatagaatggacaatcctatagagattttggaggaaacttagggccctttgaatcgcaggattgagaaaacgtgggaataggacaaacacggtattttgatataaatgtaagtgtaaaattgttgatatttctgaacgatgttaccaggaatataatcccccgcaatggtgccagaaatattagacgatattcttatggtttacaaatataaattcgcaagtgcacggatataccgttgtaatataaattcgcaagtgcacggatataccgttgtattattttacccgaaagtatttccagggtatcgtatttacttaatcccaaggaaagttatggtcagagagtactatgctataaattcatatcacacttatgcaaatcaaagtctaatgcagggtttaatcaagtcaaggtaaggataggttgacacatagaaggaacagtttagaatactcttactaattaataagtctaggcttagtgaagaagaaataagaaaagcatcgtttctatacttctagtatatcgtcattttagtatacgcttgctaatatacaactatgtggctaatacctcctaactatacccttctggtatatcgaaaaaccacccctaattgttgagttctttatgacaatccgtcatggctatccaaccagttatagatacggaggagtaactgcaccgggaacctttattagacctatatacgtacgtggaggaatacccgtattgagctgtcaccatcagcgtcctacctctacagatctgtggtgactagcaccacttaatgatatctaataatctaggcattgtgcttacattactaaatattactctatgtgtcgacgtttgatgtcgcgatttcggtatttgcatagtatggggatcgttggtactaggatatatgcgagattgtagtaaaagagatggagatgaggatttttatataggttcgggcccctgaattatcaggtaataaccctacatcctgttggccgaagccggccgttacttttattcatcataatcacaccagtacaatatttggggtagcctatctaactgttgtcgacatggcggtctgaaagtctgactcgtagtcgacaatagggtagccttttgttagtgatatgccctagaggcaatcatagagatgattgtatcacacactatgtttacatatttatccgactttgttccttgaaatagataaactcattattggttaatgaatatgtgattctttcatgagactctttatgttgtgtgttgctatttctaaaggatccctgatcaaatatcatatgtggaacaaatatgtttagatgatcagcacatgtattaattgatgatcatgtctcatggatcatggtatagagataccaaattaataatgtggacacatgttagtgaacatgttgttggatagacccaatatgagacactgcaagagccgtatgtgttgtatcatcagtgatctcatttagtgttggtgttgaatccttagacctgagattatcatggttcccaacatgtgtagtagcttacttagggactgctaaacgctactccgtaattgggtagttataaaagtagttttcaggtatgctatgaaacatgtagtgggatatgaatagtcaagatgggatttgcccctcctatggagagatatctctgggcccctcgatgttgtagattatagaagtgcatggccatgccaaaggtgattgaggagtcaatcacaagttatataatctatcaacaggttcgagtgaatgattgagctattagaggatgacacatatctagccttgagcttaatcgatatcgtgaggcaaaggggttcatacaagtatacactagaggttcagccgatatgatctttatgtatgcccggtgggtcaatacgttctgctaggggccgctgttgacgcgtggaacgaaaaggagtttttgggttacagccgagtatatatgaacctatagggtcgcacgcttaatgggtcggaataaggggattggatggagatccaatataagcttaattcggatagggatccgaataggagtcctacgggccttggaggtccgagtgatggatcctatatattcgtgaggggtgtgaccggcggaggcattgcatcacgtgagaaaccctagccgtcacttccctcctcgagcaaaaccctagctgcgcgcgggtgctagcacatctgcgcgtggcgttccgtccctgtacgtgtgggtaccggtagaggcgctgctggtttgcggtgctgatcggtgtgggagtacggcgaggagaacgcacgaggaggagaaggtcgagccggtgcgatcgactacttcctctacatcgacgcgcgctacttcacgagagttccttcgacttctcagcgtcttcttccgctgcgcagcgcgtcgagtggtaacgatctatgatctaatacttgcatggttcctggtttacgcgatagaaaattttgatttatgctatcgtagcctnnnnnnnnnnnnnnnnnnnnnnnnnnnnnnnnnnnnnnnnagttgttcatcacaagcacct

SEQ ID NO: 21797 - DNA, 1255 bp, Oryza sativa
  unsure (1)..(1255): unsure at all n locations
gcatgatctgaatgaggcggttantttggttgggtgctgcaagttgcnggatggcataagaaaaanaggaacgccnaatttggcacttttcctctgcanaatagagaatgcaataattntgtatggtgggatggagtatctgctgaaggacgttttttttctcctaaccgctattttctcgatggatgtttggatggcatatctgttgaggatgctcttactctgctccatctcttctatcttcagccggctctgttttgagaacctttggaagttatagctatttcaaaaatctctagcttcatgaaacaatctatgttcttatttcaaaatgtaataggtttagtgaatttttttaggggtgaataactaatacggtccttgatatttcatttcgggctcagtttagtccttgagatttcaaatcgtccaaacaaatcccccaaattaattattgggataaatatagtcctttgacccacaaaaaatgccacgtgagcacgttaagtcatcttcgcatcaagcagaatgaatgaaatgaccattttacccttatataccatatagaaaagaaagaaaagatacaaacagaaaaagtaacatgccagcccaggcccagcattgttgcagatgggtggccgacaaatgaatttacatgatcagtcctaagtgacagttccaaaacgatcatacacgtgtgaaacatttaccttcttacttttctttcttttctatatggtatataagggtagaatggtcatttcattcatgccactacatgagagaatgacttagcatgctcacgtggcattttttgtgggtccaaggactatattaacccaaatgattaatttggtggacttgtttggacgatttanaaacataaggacttccccccccccccncnnnnnnntnnnnnnnnnnnnnncnnccnncccnnccccccnncccccccccccnnccnnccccccccccccncccccccccncnnnccnncnccccccccnnnnaaggaaaaccgtcaaaaaaaaccttacaaatacacgttaattgggggaaattcgctaagggccacaccaggaattaaacaggatgcatgcgggggcacaactgaagttaagacacaagttaacattgttaaccttaaaagagcagctttgtcttctttagaacaaacccccgactttatgacccaaacgaccaagaaaaccgttggccaggtcttttataccaaaacctccaagagggaagaaga

SEQ ID NO: 21798 - DNA, 1911 bp, Oryza sativa
  unsure (1)..(1911): unsure at all n locations
cgcgctggaaatcacttgcatgaaanncccctangaaatcctggcataactaaactgttttctatgcagggccagccgcaacacccgcattatcctttgccagcatcatttcctccactagagcgtcagacaatagcctggacacgcacaaaccaaatgtagtcgggaagaaaggcaagaaacccaccaaagtgctcttgtccactggcggtggccgccgatactgaaggaagagtgacactggaatggaagcagttgccagttggctgtttcctataagcagtgtgtatagtgcataacctggacttcacatctgtaacactcccaagtcccaagtagcagctttttctcccatttggtttgatctaaatcgcctgactgttttagaaggtttttactgtgtatctacatcctgacccatgctaagggagtaagggtgactgccctgtcgcaaaatgagaagagctatgtaaaatttgataaataatgatgctaaggatcatgcgcaatactttgctcaatgtacgtcgacgagttgatccgtcataggctgatacagcctgctgtttaaatcgtgagatgctctgagtcatattttcaaaatcacggttacggggcatatatataaattataaaatacacaatatagaaggaaggaaaagcagaaatgcatggtttaatgcaataagtttcaaatgggatggaatgtcaaactttaagtaacttatgatgatatttatactaggagtattggcaatgtatggactaaatattgaaaaagtagcagaaattaatttctttgtttaaaaagcaacggaaatatgtgttcgatagggtaaagctaatgggcgatcgatcgccccaggtgatcgaccccatcccccctatatggctcctctccccttcttctcttcctactacaccataaatctttttaaaaataaaaaaacagttagaaaaatttatgtatagaaatactatatatataaaaaatatttgaattcaaatttaaatttgaatcgggtattttgacttataaactttgggttaataacctttagatgtatagaaaatcctatatataaaaattatttgaattcaaattcaaatttgaataggatatataactttggctctctaaactttagatgtatagaaaatcctatatataaaaaatatttgaattcaaatcaaatttgaatcggatgtataaacttttgacttataaactttgggtctctaaactttaggtgtatagaaatactatatatataaaaaatttgaattcaaattcaaatttgaatcgggtatataaacttttgacttataaactttagatatatagaaaatactatatataaaaaaaatttgaattgaaattcaaatttgaatcggatatataaacttttgacttataaactttgggtctctaaactttaggtgtataaactttagatgtgtaaacttgaggtgtataaattttagatgtataaataaatttactaaaaatagaaaagtaatacggtaccaaaaaagaaaaccacgttgaggaggagggggtgtcgccctgatcgcccttagcgatcaatcgcccattagcttttccatgttcgatatgcattcgagagtatcccgatacgcatttgtgtttgatacgatatctgatatggatatgcttgtttttagaagtatggttttctctttttttctgaaataacaaattaaaatggtggtaaatttgtaattgctcttttattttttgaaaggcagcatccaatattggacatgactacacagcgctactacttcatctatgaaaaatcctatccacctatacttcaaataaaaattcctcttaaccacccacgtctagggacctcaagtgccgggggcgagagacgtcacctgccc

SEQ ID NO: 21799 - DNA, 931 bp, Oryza sativa
  unsure (1)..(931): unsure at all n locations
ttggaaagggagggtatggaagggtattgatttatanctaaagaaggctagagttcgtaanntatgctatttaaggatgtaactctantcatnnnccccacccccccactggttganatgnattacnttgttgaanccccnctnnanangagcaacactagcaacaaatctggaaacaaagcagcaaaaggagagagctcgatcgagaaaagatgatgtaaaatgaagtgaaatccgattacctcctttctcggttcttctctggaaaaagaaatcacgaggaaaaaaaaagcaacatgaatggatgaacctaccaaacgaaccatctctaccagaacgaacacgaaccagaaacaagaaagacaccaggcaaatcattcaaaccctcaccccaaaatttcaatatgaggacgcacagactaaatttgagcactggaagctcaaacaancgcggcaanacaagacgacaacgcaaagaggacacgccgaacaancngngcgacgggaaccggaaagaancccacctttntcgcgtcctatgaacagcgtaaacacagattcgtcgctcaaaagctaggttttgttgcaaattatttcccgagtttaccgccgaaaagtgctaagagttcgaattcatcgaggaggaggaggaagaggggcgagaactctgcttttatcgccaaaagatattgcaattttagcagcaaaaaaaggaaagaaaggtaaagggcagctcaccggatatcggcaaggcgatcacccgttcgaggcggcgcctgtgccgccgcagcgacggcggtcggcggaccccggcggcgccctccgcggtgtactccctcctccttcgacgtgggagaacaacgactttttccgagggcgggctggcacttgtagaacaccagttttctaggttcgggttcccgactaacct

SEQ ID NO: 21800 - DNA, 833 bp, Oryza sativa
  unsure (1)..(833): unsure at all n locations
cactgcgattggaatgcanatacngcactgnacccaaccaaaacccccgcgcatgcaaccccctctgctctgtcgtaaccaaaaatttccctctcccctgcgaactcccaccacccaaatttaacttcctcaaccttccgcccgtcgcgccagctggcccgttactgacagggtgggccccacgccccggcgcggtgggtcccacgcgtcaactaccgtgggtagggtgggctcgggtgcgcccccccccccacccagtcccgtgctccgcggtggcggtcaccgggtgcggggggtgggccgcgtatataggcgggccgccgcgccgcgcgctgctggctaggtgtaggagcttcagctttggcccacatcgcccccctctcgccctcttccgtagctttcgtctcaccgcccccaccgcctcgcctgggggaggggaggggaggggagcccttcgccggccctggcaggttccgtaagcatttttagcatgagtatgtggtgggccgcgaatttgtttgacgttggtctgcctttggggccctgttttaaattccttttggtgccgcttttgaagtccctcttctaggtttttgtagggaaggtgtttgtagcagctttccttcccggccccaaaattgttttgcctactttcggtaaaaattttagaggagctttgtcaccactatttatattttttattccccccccatctatccacaaatattttttgagggttcggccctccattccagctggtgtttctttctctagtaccgcacgaacccaggggtgatgagtggatccctctcttcatattatttcagtatagg

SEQ ID NO: 21801 - DNA, 3426 bp, Oryza sativa
  unsure (1)..(3426): unsure at all n locations
cgatggatttagacctgcatctccctttnnnnnnnnnnnnnnnnnnnnnnnnnnnnnnnnnnnnaaaaagaaagggttaattggatccatgccactgtaaatatgacaaatcagaaaaatatcattactattcatgaaatcgggtagatgctactccaatcttctaaaattaaaaccataccactccatcacgatttccgtcctctccgtcacatttttcgccgtctccctcttatcttcgtctcggtgcctgaggaggagggcatggcggcacgccgccctcaccggcgccgagctccatgagggagatgatagccgggcttcctctcttcgttgaggtggttgcgctgagagcagacaattagggcgatggcgcaaagcggctgaaacgcgcggtggcagcggagagagaaggaaatcgttgggagaagcggccagggcatggcgagctcgggctaaagttgggaaaggaagaggagacccatgaatttcgtttttgcaatcaatttaagaagaagagcaactgggaggtcgtattcgaacgggaggcggaggcactgcgtacaggcacggccgcacgggacttcgtatagaggttgaagacgatgtgctatagcggaggcgcagcgcacgggcacggccgcgccggtgaagcccttccccatccgccgtcgttccccatccgccgccgtgctcttcttctccggcgccggtttgtccgtcgagacgaagacgaagacgacaagaagataacacggagacggctgaatgtgacgaaaaggacggaaattgtgatggagtggcatggttcttattttagaaaattagagtggcatctacccgatttcatgaataataatgtcatttttctgatttaccatatttatagtggcatggatccaattaactaaaaagaaaatggtgtgataacctgtgtttgaaagaattcgagctcagaccaatgcatagctctggcagatcccagctagtcaagcactcgagctagcagccgttctcaacggaaccacagattagcaatttagcattgccaggctgccagcgacaccacttggctgtgttcagatatgggaagttgggaactaaactctccgtacggaaaacggagcggtccattagcgcgtgattaattaaatttttgctattttttttaaaaaataaatcgatataatttttttaaacaactttcgtatagaaactttttactaaaaacgcaccatttattagtttgaaaaacgtgcacgcgaaaaacgagggagaagggttgagaacatgggattgcaaacaaaactgttcgcttcacatttctactagttttctaactacactgctaactgcttcactgtacccattttgccattgagtcagagtactcgcctgtactgtacgatgtagttacataccaatacggagtactgcgattttcagaccaaccgtgcatgggatactcttgcgttttcggcttcacatcagttacagtacacgcgacggtcgggccctacgttgtaaagccacctgatcaatgccaattgaaacgttttaacgctccccaagcacgggagttcggtgactatttaaggttttgttagcttgtcgaattgaatgcatggatgcgtacatacatttacatacccacttgtttcactttcacctttcctccgcacgagcgacctaacaattttaactgatttataccagcacaagctaaggtagcgggagactagtgcaaccacgctacagacctactccctccgtctaaccaaaaaaaaaaaaagacaatccctgggtttccacgtccaacgtttgactgtccgtcttatatgattttttttataattagtatttttattattgttagatgataaaacatgatcaatactttatgcgtgacttatctttttaattatttttataatttttttaaataagacggacggtcaaacgttggacacggaaacctagggtttgtcttttttttttttggatggagagagtatagtacaggtcaaggaaacgatgcacttttaacttactgtaataaaaaagaaaagaaaactactaaaactccagctgcagcctgcagaaacatgccgtgcccagagaggtgttctctccgtctcagacaacaagcaagcaactaatcaaagccgccggatcttccgattctatttcaacttgaaagagcaaaaacaatcaagttctccgggggattgcattcggtgtttgggctctaaccctttggtctgtgaaattgtgagtccatgggctatggcaatcttactcttggacttgaacaagacagacagctatgggctttgcggtaaggaaataaaagcccaacccaatagtctaacacggatacgatcttttggtttggaataagttcatcagaggtcccttaattttacgccgaatccgattttcgtcctcaaacccaaaaactacatacaactggtccctgaactattaaaaccggtgtaaatgaggtccctcgacgtttttgaaggttgttttagctgacgtggcgcctacatagctggtttgactaggtctacgtcctacgtggcattgacgtagcgcttacgtgacaattatatcatgaaaaaataataaaaaccatagccccacatgtcagctgcacacaaaaaaaattaaaaatagtggggcccacgtggccccacatgtcagcctcactcctcccttctctcttcttcatcctcactctctcttcttccctcttccccctatctctctctttctcttcttcccgagcagcggatgagcgggtgggcagcagagcaggcgagcgcggcgagcagtccaagctccggcggcggcggctcgacgtgcgccgcgtcggggctaagggagtcggcgacgggggaaggaggcaagcctcgaccggagagaggaggcctccggtggggtggtgggcgcctgttgacagaaaacacgaggcctgggagatctgcttaactccagtgcaggtccaaagctcgccttcggatgtatgagcgtgccagttgatttgatcctgcaatcaacaagagatagaacaaagaaaccgcaattaatcctataaatgatagccgatcggctagatgccgatgacatattatttatttcaagccgatgtcatgcgtacatcgatcggcaaatatcaataagcaattcagaactaaatctactcgatcaactgtagacattaatgatatataatccttatatcgggatatacttaaatcaagtgattgggatatatcggtcatcttgccgagacagtataaatcacttagatcgaaatatatattaatagtaggattatatacattaataacatagctgatcaggtagacctaacatgtatcgggtaatacttcgatacaactctatactaagatattaaag

SEQ ID NO: 21802 - DNA, 2057 bp, Oryza sativa
  unsure (1)..(2057): unsure at all n locations
gtggctttganntttgaaannnccttgtanaacactatnnnnnnnnnnnnnnnnnnnnnnnnnnnnnnnnnnnnttgagtttgagtttgagtccaggaaggaagaaactgtataccggtgatgaatcgtcgcgcaactggcggctggtggtggtacggggaggctttgcaattatcgggcgactttgagacttgagatcacgtatccacgtcgttcctgatgacctgatgattccagtactcgtgcgaaaaaattttcgttgggctgtgtaatttttccgatgttcaggtcattgagggttagtacaaggcactcgagaaaatactcaatatgtccttgtaccatcgccattcgccggttcaccaatcaccatggccgttggacttgatgagagagtcagacgcgtctgcgactcttcggcggcgagacgtggcgggctgtgggggaggaggggcaccaggctcgatgggcctcactgaatctaatgacacataagtgccacgttagcactacgtggtacaacgataaaatcaatatcgtcacgtaggtgctacgtcagcgaaaccatcctccaataccgttgagggagtcaaattgcatcggttctaaagagaagaatcagattccatcactcgaagggagtcaaagtgaacttattccgcgatctgcgaccacattggtttcacatggtagccatctgggccatgcaggacaagggtggcgttgcatccggccggcccacgtggcccgttatagctttttgtctgcccgctgagcttttcgggctggcccatacagcccatgccttctttttttttttaactcccgcatgccttcttttttttgttactatcaaactgtctgtttgtctctgtcaactgttaaccatgagaaatgaaaatgatacacgcacaaaaaaaaaattctgacaaactctttacaaaaactgatttggaaaagtgttatcaactgatcataagaaaaaaaacatacaggtagtacttcctacaaaaaaaaaatacaggtactcaaacgatacgttcctcttggtgtcatgctctttgaagatttctgaaagataagcgttgaaaaagcattggttaaaccttttctttctctgtgaagaagaagcagtccgtgtgcagactttgcagatatggctgtttaaaaataggtgatgggagagaaacggcaagaggttggatgtgtcaccaggtgtcaactatggcctcacagttgcaaccatttgacaaggtctgtctgagaacatgagggccttctattgcccggctttctctgatggcgttgtcttgtatccccttctatctaccaaacgccattcttggccgtttcaagcttagaaaaaggtatcaatcttctctcctcctcttagtttgaagacatggaaagctttcgtgtgttcatgtgttcatggttgatggcggtcaagcggcgatgaattgatatcactgggttctaggtatgctgtctgttcgtccatgtcctttcctcaagaaattcgcttgcctttgtgttcgtgaaaactcttgttgctgtaatgatcaattaaaagacgatcatgatatatctgcagaaacatgaactaattaagtgattttggtttatatcttgagtactactattagttttatcctttacatgccatccaattatcaaacaaacagagaaacatcccaagtcccaaccttattgttcttgtataaacaaaaagttctaggagtaggagtgcaaaggtattgacaggtgaaaaagttttgcagcataaatagtaatcaacaaggccaaaaaaaaaagataataaaaaggtggaatcaaattagaaagccaatggctccagaacgtgcaaggagtgttttgtcaggtcaaacaattacaaaatcctgaatatgcccaggaaactggttcacaaaaagaaggcataaacatgcagtttaacctttgcatgtctagctagggacattaaatcagtggtgaacatgttgccaaagtgccaaacaacatctaaatcttcgagggcaaccacagaagatcaaaac

SEQ ID NO: 21803 - DNA, 2601 bp, Oryza sativa
  unsure (1)..(2601): unsure at all n locations
gtggncctttgatgaccctgcctcatcnnnnnnnnnnnnnnnnnnnnnnnnnnnnnnnnnnnttcgtcgcggccgatcacgcccaaggacaaggcccccgctgtagcgacgtcgcggccgatcacgcccaaagacaaggccaaggcggcggcggcgtcgacgtcgcgatggtccgcggtgtcgccgaggcagctgatgcagaaggcgtccaatgcctttacaagaggcagcagcagcaagtcgcgcgctgccaagaaagacaaggaggcggccaccccggcggcgacctcggccgccgccaaggacgcggccactccggcgtcgacctcggccgtccgcaagaaggccgccacaccggcgacctcggcggctggaaaggcggtggccggtgcttcgcccgggccgacgagagcccagcccacggaggagcaccaccagcaacccactgaagcgccgccggccgaaccgtcacctgccgccgccgcggtgcaagaagaggcggtgacttcgagagcccagctcacggaggagcaccaccagcaaccacctgaagcgcccgccgagccgtcacctgccgccgtcgccgtgcaagaagaagcagcggctgcggagaccgaagcagagcaagaaaaacaaccggatgagacgccgcaagaagtcgtcgcggcagtggaggagaaagttcaagacgagcaggttagcacggaagcagcggaggaagccatcgccgtcgaggaggatgccgccgccgtgaagaccgatgcgccggagccggaagagacgcagacgcaaaccggtgccattgcagagtcggaaacagagtttcagaggagttcagaggatgagccggcatccgacgccattgtcgaagaagcggcgatcgaatctgcaacgcagaatgagccagatgaaccagaatccaccacggttgaagagatgcccgtcgaggaggagatcaagcccgatgagagccaacaagaagagacgccaaaaccagaagagagaatggagaactctgaaacaagcgtgatctctgaagatccaaaagaaatggatgcaatctctgaagaccaaaaggtggaagaacccgtggttgctgaagaacaagaggaactctccgaggttgtaaaaatggctgtcgagccgagcatattgtcagagccagcaacgccgtggaggaagaagatcgcgacgacgtggagacggagcaagcgaactcgtcggagcccgcaacgacgggggaggaagaagaagatcgcgacgacgtggagacggagcaagcgagctcgtcagaccccgcaacgccgttgaacgaagaagctatcaacgaggagggcacgtcgacggagacggtgaagacgaagaaggtggcgttcaaggggagcaaggtgaagacggcgatggagaggcggccggagggggagcagccgaggaagaaggacgtggcgcggagcaacgacgtgatcgaggagaccaagaggacgctgatgatgaaaaggaagagcaaggtgaaggcgctggttggggcgttcgagacggtcatggacacccccagcccgggaaaatcgagctgattttgatttggatttttttttctttttttttggagggaaagcttcagcggagatgcacgtattgagtggtttgaattgaactgcgaggtgtgctttgtggtgtgatgtttcggtttcttgttctctttgttgcattgatcgttgattgattcttctgataactgaaacaaatggaaatgttattgtcgatttgtttgtttgttgatcattcgatctagtgttgtttactaggcttagttgtatgtaactaaaaagggaaatagctgtgtgttcttgagagctgagactggtgtggttgtcaacttgtgctacattgctgagttttgagatttatgcttgtaaacaattattgatgacatgcaatccattttgtacgttttttacatgttcatggatatggatttctttatagtacatgccctcatttcatacatgaaatttgaatatttattgaaaataactaaagaaatgatgatatcatctaccctctctgctccaaaatataaacactagttgaaataccaaaaatataataacttccaatactattgatctcatcaatcacctttcatttaattctttttctgatcttacctctaaccattccgataacaaagtatttttcttgttaggtttactctcagttaatttttttttaataatggaatagaacatcatcctcaacaagctacaaccaattattacatccaaacactcaaagtgagtgtagtctctgttaaataacctagagattattatattttgaaatgaaaggaagtaccattgtatcgtactccctccgtcctacaatataagggattttgagtttttgcagcgtttgaccactcgtcatattcaaaaattttttgcaaatataaaaaacgaaaaagttgtgcttaaagtactgtggataataaaataagtcacaaataataatttaaaatttttttgaataagacaagtggtcaaacgttgcaagcaaaaacttaaaatcccttataatctgngacggagggagtaccaaatn

SEQ ID NO: 21804 - DNA, 2740 bp, Oryza sativa
  unsure (1)..(2740): unsure at all n locations
gatggtttgagaccttgattncctttgtanaacnnnnnnnnnnnnnnnnnnnnnnnnnnnnnnnnnnnnnnnnntttcctggaacagaatatttgtataatcacttttagccgtaaaataaatcaatttctgcatattacacgtattactaccggccggtaaccaggctgaacatcttcaattttcagtagtaggcagttttagtcatggtgtcatggtgtccacgattaacatttctaagtttatccaaaaagattcagactaattcgcctgaaggcatatacttggctgatcgaaatacctggatagctagtcatggtgcacacgtcgacatatctgatggttttttctgctcgcattggcaactaattaattaaattaatcaaccaaaccaacgggcgcagatctgcagcggcggcgcgcggcacgacgaggtggacttcgagttcctgggcaacgtgagcggcgagccgtacctgctgcacaccaacatcttcagcgacggcaagggcgagcgtgagcagcagttcgtgctctggttcgaccccaccgccgacttccacacctactccatcctctggaacccacacaacatcatgtaagctctgaaaaatttaaattttatcttttaggagtatcttttcttttttctgggcttatatttatacttatcaatcaaaatttaaatttttaacattaaatttggatttgatttttagagttttttaatcatagtttatttttcagaacttgtttttaaatcgctaagaacatttacataaaagttttatttataaattatttttcgtttgtaaatatgtcgtttggctcggtctcctcgtcaaattcagagagacaaacctgtgtgtaacaaatctgtaaaaaaaaatgttggtggtgcagactgtacattgacgggacgccgatcagggtgttcaagaacaacgaggcgtacggggtgccattcccgacgcggcagccagtgcacgtgttcgccagcatctggaacgcggaggagtgggcgacgcaaggcggccgcgtcaagacggactggtcgcgcgcgccgttcgtcgccacgtaccgccgctacaacgtctccaacgcctgcgtctgggacgccgccggcgccggcgcctcccggtgcgccggcggcggcggcgggtggatgaggcggaggatggactggtggagctggatgacgctcaactgggtgcggatgaactacatggcctacgactactgcgccgacaggaagcgattcccgcaccgtttccccgccgagtgcatcatccccatcggtagaacgtgaggcgtcgtacgcgacgtcgactccatgatgattccatccgtcgtccagcgatctgtaggctcatacttgtgttttgcagtgaggggaactgaatgaataatcgtctcttcttgatcttttaggtttgggttgagttgtgcagggtaatgtggaaagtctcaactcgttccagagatctgtttttttctttctttggtggccacgacgatgtaaatggacttcttgtttgatttttttttctaaagatctattcgtctcgtgatcgtccccggcttttattattgtgagacgacgagctatagaactctgcaaattggatgtttgggccgtaatggcgaagtattagtgctgggcctttatgcttggtgggtatgggcctatctgccaaagtattaagcccaataatttgtggaatgggctgaagcgtacatggggactggacctgctattaatatctgtataactcacagacttttttttacatatatattcgagatgtctagctcctgtgaagaaaacctcaggtgaattcatccatgaacaaaacgagggatttccagtgcgatgtgcaattttaagttttttaatatgcaccaaacatttcttactgttacgcagagagaacactattcctactactttagttgttcacgtccaaaatctcaaattaaaggaaggaattgttctgctttgtgtgtccacagtgcaccgtgctcgcctgtcctcccagtgctcccctctaacttagccgccgcaccgacatttcaccagcaataatcaatggatgcgaccctccgaaaaactggaccttatcttcgatcagctagctagttcatcacccttccgaaaattgaagtcctcacggttcttcttccacctccctttcaggcatcaacatccagcagaggacccgaaatccccgcaaatatcccttcatggagaccacgagctactgcatgagatgtgctactgctgtttgagatcagcagaagagcagagagtctagtcagacagctgcttccaactcggctccagattgctacaaggtgtacgtccttctcttgacaggcctagacgatttgtcatgcagcagtattcgggttttatcttttcgcttatacttatacttataagtcaaaatttaaatttttaactttaaatttaaagctgattttagagtttttttttatcgaagtttatttttaatataaacttttaaatcgctaagaacacgtatataaaaattttattcataaattagttttcgtttacaaattcccttaaaatttatttttttcgtttgcaaatatggccgtttcccttattctacaaataaaccaaacaatgaagctaggagtaagagattttaatattttttngtnntntntnnnngngnnngnncntactgtaccntaatacgatgnagccttn

SEQ ID NO: 21805 - DNA, 2010 bp, Oryza sativa
  unsure (1)..(2010): unsure at all n locations
tgatggccttttgataaccttgatanatcannnnnnnnnnnnnnnnnnnnnnnnnnnnnnnnnnnnnnnnatccagtacaattgttactatcactgcaactttagcagttgcaaggtagctgatggatcaaaaatcagcggctcagatcattagaaaatattgttcacgaatcactgtagcaattttctactgtagcgtatactgtgcagggggtggcagagcaaatccaagctgttggctgcatcgatccaacggtcataatatgctatcactgctaaagttgcagtcgttattacaactgcattggatctcaattcataggaagcgcgtgccagcaccaaggctgtaaaagatgacaaaaaaaatggcgacagcttgagagtgatgtttactactacggttttaaacgtatgacgcttttgacgttaattatttgttcttataaaaaaaagtatgttactattctctccattttttaattacctgacatcactccttcaaaaaaaagactggcgtaagacattgttcatttgcaaactctgatttgccttttatgtggaaaaattatagatatataagaaaataacatactatgtattacacacattaaacataaccatgaaactttcatttatcatggactagtcttttaagagttattaaatggccaaagttggaatagtaatagttaacgtgaacaaatatttgaaagcggaagaaataccatttacttttgtagtgacttatattttagaaaaatattttttcagtggtttctttgttgtacccattgaagtatgatatttgaattataagtacgtactctgaaacaaatctttgatgattttcatactatatacgtccattcttccaatattaatgtttgaaattatatgcaccatgcatatatttaccctgttgcgctgatccactacaatacatatatgcagtcttcatcagtgactatgacttttctacagagaaaatggagggatatgttacttttcgttaagaaaatgaagtgcattttaatatgagttccatagagccaaattaaacctagttggttcgtgccaatgcgcaccgaatctctcaccaactgagctcttgagcgatagtgatcgattaattttgttgccaccattatcaaagctagtctataatgttctatcacttggaaacctacgtttcaaagaaaaacgaaaaggtgacacacgtgtccctcagaggaccaccaggcaagcaacacaaagtgatcaccaatgcattagcactaatcatagagaacccaatgtggttagtccactgaatgctcatgcattgtggctgactagctacaaattaatatacgtagtacaatatatcagttggaggctggaagaaaaagaacagcctacagctcatcagtgcggatagctgaacactctgatagtctgatgtatatgcatgattcccaactttaccagccgacccattatcatcctagaaattggcgacaccacttgatccatagaaatgattttatgatataggaatcgaaggccatggcgaccattactgtcgcaacatgattcttgcatgcgtagctccccttttgatctatctgaaaaagataggtttaacaagagctaaagacggtggacaattgaatgggatgggtgttgttgagcagataaggctagctacatctacatggtcatggaatggagcacttgtctaggctagctctagaagagagcattatagggtatatgcttgttggattgattattggacgagcggtatgcatttgggattctgaagcttatattagcacggtcagcgttacatttttctgaaagtctgaattcgcctcgttcacgaagtgccatttaatnttgcagtacgtatgcataaatgatcagttcgtcgatgcatgtatttccgagttcgattgatgctacgataattattgacagcctgatctaatacttcaatccctaggggtttagacagagtcggntaagctg

SEQ ID NO: 21806 - DNA, 1429 bp, Oryza sativa
  unsure (1)..(1429): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacaacataatcgtttaagtcgcaaagaaaataaatgtaaatgttttaatcacacattatagtttttcgctaatacgctatttggcgtattttgtgcatatagccatccgatgaggctatcagttaaaagaattgctcctacaactgcagatcagaatctcttgctgagtagtacctttctaaggattgttaaaaaaaaaaaagcttaatccatatatgttcatttaatcagcgtgtaattgacaagcaagcagtagcataaatttccataacaagctagctaatgaataggacatctaaacaaactaatcctaatcaccatcatgctcttattagttcggttcggtcacatcgtttttaaatccgcacccgtttgtttttgcgtgcatcatatctcttcattcatgtttcgttagtacagctgcaatctgtgcgtacttatcagtgatcaatgcatgcatttgagtgtcactccacgactcctcagcttgggatcagaataggtgacgagaggttgccgatcattcggtatttcggtgcagtgagccagccggacatacaacctctgcccacatgtcaattgcacacagggttcatagtcccgagcggtatcttaggttataaaaaaatatattggtaaatcaataaaaaccaatggaaatcgaagaagttttttttttgtcaaaaaatcaaattttagtttgattttttttaacttgactaaagaaaaaacgagtgctttgtgctatcgtggtagtccagaaaatccaattttcgcgtaaactagactgatttttgttgggattgtaaacgcttgcacctaatacatatatattactgcacaacagcatagcagggcagaggcaagactaaggcagcttagacttgagcccggcttacctccataaatatgcttaaatccttttaaaccattacatatttttctagaaaaccaatatcctattaattgagccctactcgagcgctaggcttagaaaatttttggctccaccgctactacacagaattccgttccgagccaggaaccccttttcctgcatgcgcgtgacgcacaccaatcatatcacaacactaaaccgagcaaaactaaggcccaaaaaagaagcaaactggnnnnnnnnnnnnnnnnnnnnnnnnnnnnnnnnnnnnnnnnnnttgttctacctgncccgt

SEQ ID NO: 21807 - DNA, 766 bp, Oryza sativa
  unsure (1)..(766): unsure at all n locations
cgatggcnnttttttgtatatcnnnnnnnnnnnnnnnnnnnnnnnnnnnnnnnnnnnnnnnnncagccgcagcagcagcagaatcaacaagggactcgtgcgccccgtcctccttcaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttccttattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggcccgaacaacccggttgttttctttgcacccccaacctcagtcannnnnnnnnnnnnnnnnnnnnnnnnnnnnnnnnnngatagtcaatcaaaatccatc

SEQ ID NO: 21808 - DNA, 2610 bp, Oryza sativa
  unsure (1)..(2610): unsure at all n locations
cgctgtgcgttgacanccattttanatccnactcggtacccaattagctcgaccacggtgttgctgcaataaaaaccggcgggacgggacggcaaacggcatgcatggcatgagtgcgcggcacgaacggagcggaggctggtctggtggtctgctttgatttcatctcggctggccgcggccggtgcgggcggtggacgacaccgtggactggtctcgagcgcggccgctgggtggtggttggtttccaaactttaaatgcgagcgatcatcccgtcgggtcgtgcggtacacgcgagcatgcctctccgctgcataggcgtaggacgcttaccttcgtgtagcgaagttagtacaatgcaatggcttcacatgcgctgcgaacaggggcgcgggcagtgtgatattccaattctcgtctcttgttgtgacttggtcgccggtgaagctctggtagcgtttttactgtggcaagttatggttgatgctgtctgttgcatgtgaccctgtaggttgaggaaattaggacctgtactgcggtgggattcggtggataatctggtgatggcgtgatgctaatggaacaagcgacatgattacacgacccgctcgatgcaaattaacagtcttctctctttctttagtcagggcacaagaaatcagatcgtgtcccatttttttctcttggaatcgaattgggaaacagatatctgtttgtgtcttgaactcttgatgatactactactgagtatctatctagtgaggcatgggatggatgacgtcaccgtgaagggtgggcgtgttacggcccacgggacttgtgtattgcctgttgggcctcactggggcctggtaggtatttctcctacaaggtaaaaaaaaaatcataactatcgatcaagtcgaaattaggcaggtgaagtgggccgtattccaaaattttcaatgtggttactggtgagccggataaaggctgatgaagttacaaatgagctgggttggcaagctgaaggaaaaagtatgccgaaggtccttaaacttgtcatcgagttacaaaatcgtcccccaaacataaaaccggatacaatacatccccaacattcaaatccaatgaaaactaagtctctcggcagttttgacttcggttttgttcgacatgaccgctaacttagcgtgggacccacgtgggccgacacgtcagggtgaccacgtcattatcatctctttcctctctcccccctctctctctctctcccccagttgtcggcgacgagaggtgcccatttcctccaccagctagcgcatcgccgaccgccacgtaggacaaaaccgggggcaaaatcaccggaggacctatagtaaacggtttttgtaagttgatagatgttatatatctaattttgtggttgggggatgattttgtaactcgatgacaagttgagagaccttcggtttaccttttccgcaagctgaatacaagttctcatttcccgggcttcattcggcctgacaattggaccttagcccttaagttgggcttatttacgaccaactaagttaaaatcgaaggaaaatgatacatgtacagaaatgtgtttagaaacattttacaaaaactgatgtggcatttgttatatattgtatcttgttttttcgtaactatccactgattaaatccaagtttgtaagagtttagtaaagttctttttaagtacgtatagcattactcagaatcgaatcacaacctgtgattaaaaaaataatttctaattccaaattggttctaatgcatcatgtggtgacagtttgacagaagatgatcagaactacgctgcaaacagtggcacgagaagcagtttgtgcaaacaagcgattgggtgcgaatcaaaaattttaagcaaaacatggctggttgatcaaaccgagtgcgagcattagttttgtttaatccaagcagatcttatcgtttccaatataaaatggttcgacgttttcgttagcagtgttgctgcagctgcagatgcgaatgttggtccctcggttaaattaatcaaaaccggataagctcgatctccccccacgcaaggctccagttttacagggtgtccattgtcgaaggtggccagtctggctggcacgcccagtactagtacaggtttatttcagcggctgagcacacggaaaacatggccaaaacccacaaagggatccatcttctggctaaaagcagctcactaaaatttatcaaacttggtacgtacatcgaccccgtgttacaaaaagatatcaaagaatgcgatatgcatactacatttacatctccgtggcaacaaaacacattcattattcgccatctgacgtgctcttctcatcatttttttcatcgatgacggatcatgcatgcgtagcgtacgttatgatcatcttctcgtgtcgatctcaacggagcttgcactcggcgggggtgccctgggggaaccgcttggcgtcagtgcagtagttgtagatcatgaactttctctgcacccacctcatgcggcggtagctcatgtcgctgagctcctggttccaccacccgccggggccgccccttctgccggcgggcggggc

SEQ ID NO: 21809 - DNA, 3781 bp, Oryza sativa
  unsure (1)..(3781): unsure at all n locations
cagaggggttcacgtggcaatgtgaaagtaaagtagggaactcccatgacgtgctgtgggttccacatgatgtagtaggtgtgaaagactgtgtggggtcaaccaaaggcggaattgttgctcgctctgcccctgcccctgcgtgaacacgttggtgtgcagcgtgtacggctcgccggtcacgttccccaggaactggaagtcgatctcatcgtgggtggaaccctccggcgtcatctgcagcccaaagctcagaagatcactcaaaccatcagcttcattactccactttagtgccgtttttttgccgaatttggtagatgaataaatgatgaagtgatgagaccgtttgggaaggaagataagcttacgtataaggtggtcccggtgccggcggagttgccgggaccgagcttgatctgcatgtcgatcttgcctaagaggtactcgctcttggcctggaacccagagccgaagctcctgtcaagcgtaaggtggagcccacgcccaccattgtcgatcttgccgcggccctgcccccacgacacctccgcgtcctggaagaagttgcctccatgcgcaatggcccccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgtacacggttaaagaagtaaatgcggcacggagcgcgtcgctgcagagcgccggatagatttggggcgggggcgatgcatggctggacgcacgctggatccagccgccgcgtgcctacgccggggtgtgggggccagagacgcgggggactttacttgaccacaccacacccatccccgggggggcatccgcgaaagcggtaacccgtaaaccgggcaggtgatgcctgccgatggacggatggatgcgagtacgtggtaaagtgtgcagcttttgtggcgcttttgctcggctttgctcgcggatcgtacgtcacacggggccgcggccagcctcggctttacagttcatggcctgcagtgcagttcggttcgcgcggaagcagcagatcgtgatccggacggacgagccaacacgacggcattgccgccatgtgcgcgaaggcctgcgattcggggaaggttcgcctggtttgccccatgggcgaaggaagtggcccggccattccatccagggcatcgacggtcgatgcacatcgttcgtacgtactgtacgatgagcgagtgatttaattgcggtcacaaatcggtctcgaggacgactgttgctgctggtgagagtgtaattgcgcccttgatgtgtctgttgggagtttgtgttttgtgacagcggattacacgctgtgatttactggagtagtggtaagttttcaatacctgaaaggttacgttttgattgatcgagttcgggattagtaaggacgacgtccgtagatgaatcgtagctgggctctttagtactccgacatgatgccgttaggtacgggcatgttgattacgacacctctggccaaatgatgaacagagtcgccattggacttgtctaggagggagacaattgattctctggccaaattcttgcgtcactcaaccctaaagatggataactattttttttaacacctaaaatgattacacgtcaatatattagctaaagctggatatagacctaacccgctatatgtaacttgcactgtggagcatgcagcttatactgttcttgatctacgtggcatgtgaagaacgataaaacttggtggcgcgctgtgagtggccctagattgatgtgaagtggctaaggctcgcgagctagactagtgggctacaactttcttgcctcatgattgcttgttatgtctaacgtctagtcgactcaatcctaatggaggtaaaacattgtaacccttaggaaacagcatcatgatctaagtagttaaggcctaagagtatccccagcagcttatccaaatttgattctcggtacactcatatggatggccatcaaaaaaagattccttcttcatatccttctcactccaatagatcatttatatttcatactccataccacatcctcctatcttttactaatatctttcaactaagcatatatttgtattattttctaagggctatattttgaacaactaaattttaatagttttattttatcacggtaatctaaatggttagattttaacggacatatttctaatagataatttagtgcattaaattgctactttctctaaaattactcagactatgtttctcttttttctctacccatagtctgccttttgcccattccaatatattccaaccttttctatttctccttttctctctgctctgttctacactcttcattctacccaggaagcatgcgtggaggcaaggtggcctgcgagcgcagaggtacggcggcctgtcggtgtagaggcacggcggcctacggacgtggaggccggtgggcgccgaggcaactggagctagcaagatcgatggtggcggccgacgggcgtggaagggcggacgaagatagcagcaaggggcggaggcagtcggcggggcgcgcgcagggccgacggccacaaccggccggcatgaagggttggagggatgcatgctgccgctggcggggttctccttctagatctggtatgtctctctctcaccctccctccatggctacacactccctctacaccatccaccgtacagaaaaatacacatccgaccggcgacgatgacaacataggggaggtcgatccaaaactcctgataggggtgggagctgcggccactgtgatatagcgtgaggagagagaaacgctatatttgggcttcctctctccgttttggcgcatcatctatttttgaagggctagatggcgtatccactggggccccgtttttcactcccgtgcactgtatctcggacagggtatccgatagaggatctcctgatgctctaaggctattcccaacccaataattagaatgatgtccatagcattaaataaggtgccacctaggatgaaaaatgatgtggcaagtgaataaatgaggaaagagaaggaaatcatgtctacccaatatccaagacatcatgtgtgataaggagcattaaatttaagtatggaatagtaatgcttgtattaaaagagtagtgtctagtactaatttcttgatgatgtggagtttatagaaactatctagtgttttgggttgggaatggtctaatggggtgtaagagtcgaagacccccgttgtccgtacgaccatccgaaaatgcaagactcccaagtcaagtcctttaccacgcatagcatgcaagacttgtctgtcacacgacgtgccacgatggaacccacatggcatatactgcttcttttgctggagatctcgtactatacaatacacctggttccagaaacttcacaagaaatctagctggccatggcataagcaaacattcagcaactgcatccaataaaatccaaataaatacttccacagtggcagcactgaagaacacctcggcatccaggtggcgagtcgaaatntcaanncacact

SEQ ID NO: 21810 - DNA, 712 bp, Oryza sativa
aattcccgtgtccccgacggacgcgcccatgcacgcatcggggactcggggtcgacgactccggcggtgcgcatttgtggcttctactgcaatattgccgatccatcgatcggtagtcggtagagcagctctgccataaacttggacttaattggttacttagccaaaagcccaaaggagaatttgcagctagctaggtagatctgatacagtgaacacaacgcattgcaactgaggggtgtttaaatctaggattataaagttttggcgtgtcacatcgggtattatatagggtatcgtatggggtgttcgagtactaataaaaaaaactaattacagtatccgttaataaaccgcgagacgaatttattaagcctagttaatccgtcattagcacatgtttactgtacccccatattgttaaatcatggaccaattaggcttacaagattcgtctcgcaaattagtcgcaatctgtgcaattagttattttttagcctatatttaatactttatatagatgttgaaacgttcgatgggataggattagaggttaacatctattgttattggtaaaaaaagacccatagattaaattgttggagtactaagaagaggttaacatatattattattggtaaaaaaagaaccacagattaaattgttggagtactaagaagaggttgggtacagagtgagattctaacccacg

SEQ ID NO: 21811 - DNA, 1525 bp, Oryza sativa
cgcattcttaaaaaaaaagtttgcaataggttatttggagtatgtagtttcatgaaatttattcaaataaaaatataagaaaatctcctgtatgaattgggctaggcatgatgcatggtgtgtgtgctcgtcgtgtaatggtaaaaaatggtaggcttcattacagattttagtttcttctaacattttaggtttgcctggttatgcatgtctgaaaatgtcacatggtttctggagggcattcacagctcacatgctggctgaatttatgagagaacctggaccatgcatgcatactgaatcctctgtcatcactcatcagcctgtagccaatgtgatgagagttcaatgtatgtagtacaaaattcaaccccatcttcctttttttgtgactgacttgcaaatttcaaaaaggaatggcatatgtatgggatatacttgattaactggaccagctgtaaacatctattatattattaaaggaatagaaaaagaagcctccacgttcgctctcatggcatagaaattctcacattaatcggagaaaaagaaaaaacagagtccatatagaaatacaatttagaaatagctgaaattcagaattaaaaaataaagaatattagaagaggagactagagtccatatagaaatacaattaggaaataactgaaattcggaattaaaaaaaaaggaatattaaaagaggatactagagtccgtatagaaatacgattaagaaataattgaaattcggaattaaaaaataagaaatattagaagaggaggctagagtccgtatagaaatacaatttaaaaaaaaatagaaattcggaattaaaaaataaggaatattagaagtagagtatagaatctatataggaatttaaaactaactaaaatttggaataaacataataaaattaaaagtagagtttagagtccatataaaaatacaatttacaaataactaaaattcgaaattaagaaaaacatgggaagaagagtttaaggtcaatatatgaatacaatttagaagtaactgaaattcgaaattaaaaattaaagaatattgaaagatgagtttagagtgcacatagaaatacaattataaataataaaaattcagaaataaaaataaataatattagaagaagagcatagagtctatatagaaatacaatttacagaaaattcaaaattaaaaaaaaagaaatattaaaagacgagtctagagttcatataggaatatatataatttacaaataactaaaatttgatattaaaaataattaataactaacacgtatataaaatataatatgaatattacccattaatagttttgtaaagttattccaaaatttaaaattatattgttcctccaatatatttaaataatataatgaaaaaacatatatgctattatatgagagaaaatataataatgttagccgcgcaatctgcgtgggccaccacgctagttttcatcgttgggtaccaccaagttgacaacaatgcacttccc

SEQ ID NO: 21812 - DNA, 1035 bp, Oryza sativa
  unsure (1)..(1035): unsure at all n locations
cgactggttttganaatcgactcggcaccctgcaacggccagctcctgacgctgtcgctggacaggtcgtccggctccggcttccagtccaagaaccagtacctgtacggccgtttcgacatgcagatcaagctcgtccccggcaactccgccggcaccgtcgccaccttctacgtacgcatcgcatcgatcatcgccaatcgagtacatatgcgtatgcctgcctgtaagagctaatggtgattgggtgttgcgtggaagcagctgtcgtcgcaggggtcgcagcacgacgagatcgacttcgagttcctggggaacgcgagcggcgagccgtacacggtgcacaccaacgtgtacagccaggggaaaggcggccgcgagcagcagttccgcatgtggttcgaccctaccaaggactttcacacttactccgtcctctggaacccctcccacatcctgtacgtatcacggttatgttcttttcactttttttacaccaatgcacttatacattagtagagtcgtggttatatgactcaactcattagaatataaattctgttgcttacgaatattaagtaattttatcatacttgaaaagtactgggaggtgccatattttttaatttaaaatttagtacatctaactactaattatcttgagttaccaaaatttctagtataaaatcttattacctctagacactttatcaagaattataaaattcctcatgaatattatgcatgtgtagatgggcttttaataagattttagtgatatcgaaaatatatcattggtttgtgttagagtgtatagtggtgtgcgcgtgcgcgcgtttatcgtggtaatcgctaaaatgacaaaaggatcaacttctgttaatctgttttgtttgttcagtttctacgtggacgggacgccgatacgggagtacaggaacacggaggcgacgacgggggtggcgttcccgcgggcgcaggcgatgcgggtgtacgcgagcctgtggacgcggggtccagctgattcaaaccagc

SEQ ID NO: 21813 - DNA, 1477 bp, Oryza sativa
  unsure (1)..(1477): unsure at all n locations
nttagggtttgcagtaaacagcattaaaaggcacttagttgctcaagctattttgtaaatacgatcctagagctatacaatattattatcaaaggccgtgaacccacacgaacctgtcttaacccaaggcctacgatgattcagaccgaactggcaacccgaccctgggtcccagctcgtcccaagccaacccaggccaaccattccacattttagttgttaagcaagttttaagaatttaaaacactaacttgggtacattgctcggcttgcccataactgagggcgcggctattcgaatagattatactctgatcagaggtgtacatctttacccacaagacatgtcttcctcacgtgtaaccacgtgccacataccaccacggcatacggacggaagacatgacatagtttccaacccatcctagccatagacaagagtaccgacccaaccccacctacggccggaacctccgggacaggtaggcaggactgagcccctagcagcaggacaccagccctgtgccatgacatatcgactaccgggccgcagctcgtgtagccttcattttccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcataaaaccattttgagggttttgaatagagggggaggtgtgaatccaattccacaataatccaatcattccatagtgtccaggtgatatgaatattcccaaagtctagagttgtaaaaccacctaatgttgcctaattaaccagcgaagcatctacctaagttcacactagagtacccactagttggggttttgtttattctagggtgaacaaggtaataataccaataccaataataataaggtcataacaaaggtaaataggcatggctaaataaaacaatgataacgcgggaatttaagtaaagcggtaatgcaataatttaaatcaaaataattttataaactgggattcaatatgttcaaggatgatgtgacttgccttgctcgctttcccaaacgtcagcttcaacctccacgtagagcggatcttccgaagctccagcgtctacacgaccagcggaaaggaaaaaggcttttactctaaaaaactccatataacaagcaggaacaaaacacaaaaatgggttcttgacttcttaaggaaaaattagagacttgaacggtccaattccgagttcaaatggccaagttatgaacatttgaagtttatatgctctttaagtgaatatttgcgaatttcatcatttaaattttaatttaaaaaggatttattgcttggggtaccaagcaaggntacaaaanngccac

SEQ ID NO: 21814 - DNA, 1553 bp, Oryza sativa
  unsure (1)..(1553): unsure at all n locations
ncggcgcgagctcgattccgcggggagacggtgcggcaagggcgngaaacgggcnaaggaggcgcgggaagggtttaaatagggttggaagttggagagaaaggaaaccggccggaaggtccgaccgccatcaaatggcgccggcgagatttgcgggagcaaatccgcccgtttgaatgcaagagagagagggaaaaatgggggaacagggggaggggatcccgggaaatatttccccccacttaattgcacccggggacagcgggatgcgccgaattcgccgtcgacggcggcgcttggcacggacgggaagcgggaaccgccaggagtacaaggatgacaggtgggccccacccgtcagcgagggtggcgggcgggcccgcccgtcagcggcgcgcgcgcgggaaaagcccgagtggcccccggggagagaaaaaaaaggggaagggagatgggccgagccggcccattagaggaaaggggacttttttgggtttttctttttataaaacctttttaactttgtttatttcttcttaattattatttgtgctctgaaaattccactaaaatttatttacgcattttaggcttttaggaaatatacaaaaatcctccaagccttatttgacttttagctttgcacattttaatttttggaggctttcacatggattttacttattctttgcataatttcgaggatgtattttagagtcgatttgggacgcggcaaccctcgagtaaaggacataagtttatattggtagcaaccgattattttaccaagtgggtagaggctattcttttaaagaaagttgattctggggatgctatacagttcgttcaagagcatataatctatcgatttggtatccctcaaactattacgactgatcaaggttcaattttcgtatccgatgagtttgttcagtttgtcgatagtatgggaattaaaatgttgaattcttcaccgtattatgcacaagctaatgggcaggccgaggcatctaataagagtttgatcaagttgattagaaggaagatttctgattatcctcggcaatggcatactcgactggctgaagcattgtggtcttatcagatggcttgtcatggatcgatacaggttcctccttatgaacttgtttatggtcatgaggctgttttaccgtgggaagttcggattagctcgaggagaacagagttgcaaaatactttaacagccgatgagtactataaccttatggccgatgaaagggaagatctggttcaatcacggctacgagcccttgcaaaggttactagggataaggagcgagttgcccggcattataataagaaagtagtacctaaggacttttcggaaggtgaacttgtatggaagttgattctgccgattgggactcgggatagcaaattcggcaagtggtcgccgaattgggaaggactgttccaaattcataaggtggtgtctaagggagcatacatgttgcaaggactagatggagaaagttatggccgagctctaaatggcaaatactttgagaaga

SEQ ID NO: 21815 - DNA, 737 bp, Oryza sativa
  unsure (1)..(737): unsure at all n locations
gtggtttgatatccacttggtacccctactcagatctcccaaaacacaggagtagggtattacgcttctcagcggcccgaacctgtatacatcgcccgtgtcttgtgtgtttcctgtcttgcgagccttccacatacagagagcttagaatctctccctgagtccccggccgaaccggcaaaggggggcctgcgcggtctcccggtgaggagccccacgctccgtcatctggcgcgccaagtaaggggctctgcgagggattttctgagctctcgcactctttcgtgtgcgccaagcttttcctgttcagcccaatggccgagccagcaaaggcgcacgacctctccccgagtatgagcggggacgacggggagccaaacccacgccgtcgagctcgtactccactgccccctccacgccaaagtcctaggtgggagaaggcgctcgagagggccgaaggatccgcgacttcgacacccacaggaggtggagaaaggcggcgagatggggagcatcgcctcctcgtctacggcgacggcagcacgccccagggcgcgcttctacgtcacccgcccgtcgccatgacccggagtcttcagcccaacgttggctggacgatgtggccaaattggtcatgacttgacngcacgcctaaatgctgtgggcngtccttcgcaccaaaggctntgtgctgttaccatggctccgattntaaaattgaggcgcgcaagcgcacc

SEQ ID NO: 21816 - DNA, 2079 bp, Oryza sativa
  unsure (1)..(2079): unsure at all n locations
agtggctttgaaacccattttganatccnagctctgtaccctgaaaagatcgcctccaaggagccccagactaccgcagagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgtcgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccgaaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgattccactgcggggtgcgaccttttgtgttttctagatgcatactctggttaccatcagattcgcatggctagggaggatgaggaaaagactacgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgtgcaactaggaaatgttactctcagatctagcggaannnnnnnnnnnnnnnnnnnnnnnnnnnnnnnnnnnnnnnnngttnntncaaggntntacaaaannncnngccatc

SEQ ID NO: 21817 - DNA, 1054 bp, Oryza sativa
  unsure (1)..(1054): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataataatgttagccgcgcaatctgcgtgggccaccacgctagtttacatcattgtaagtgtaccttctatcatatcacatgggtaggggccctgaaaatatatcctaattaatgtatgacactttttatgattataagaatcaagaaaagaattggcgggaacaaatacaacaactgtgcgcggtggacttgtgaacatggacagtgagaatcgaagatcatcatggagaagaagaggaagaagaagaagagagacacagagaagaattcaccaatttaccctctctaccacccaaatgtgagctatactgctctacgttattagttgaccttggtgcagactcgccggatctcggcgtcggagccggcggccgtcttgacgccgacgcggccgagcttggtgatggcggcgacgaaggcgtcgaaaaaggcggtctggttggcggcgaagtagttgacggtggcgcgcgagcggcggtcggcgaagagcacctggtcggaggcgaggaggcccttgagctgctgcagcgtctggaagtagccattgtcgaacttgttgggcgagacggcgtcgagcatggcgacggtggtcgggctgtagctgagcgggcacgtnttgctcatctgccgcaggaacgcccagttcatcggcgggctgtactgcggcgccgccctcttgaactgtaacagccgcccacgaacttgttgcagtgcgtcacccta

SEQ ID NO: 21818 - DNA, 1854 bp, Oryza sativa
  unsure (1)..(1854): unsure at all n locations
gcgcgatganccgaattgccgagnacnnctcnnnnnnnanngnaanaaaaatacaaattttccaccaacattcttttcccaaccaatcacaacccttcaccattcacttttcacacctacctctactattcatccaatcacaaccctccaccattcacttctatctactttcttaataaatatatataacccctaaaacttcttatattctgggatagagggagtatatacaatggtttgcttgtagcatttatgcagacagagtgacacatcatcagactggttggccatgcatgccatctgttgcagcagcaacgttttgtgttctttgagatgctttagggccccaaaaaggtacaaatggacacgagaagcacctttttctgttgcaccaaatcatctattcattaggccatgggcatgatttgcacaggacaagatgctttcctatgagtttggcattgctagatgaagggacaacaattgagaatgaaaataggaggttggtagcaatttttgggagctttcgtacatgtcgttagcactgtctcttcaacagttttaccaaagtaaaaaatgttgttaatctcttgtgcttctgaaagtatggaaagaggtttcaccatgtgacaatttcttgtttatcttaccaagtgaaaactagtcccaacttttttttttcttcagttaagttagttggtaaagcaagcagtttagtgcttatgagttgtgacagctgatttcccttcagaaagcgatggcatgtttgctccaaactaagacattatgatggcaatccaaaaggagttgtacgtgacaatgaattggatatactgtagagtgtagacctagaaagaaaagcagtggtgtgtggaaggcataaggaattgtgttctagagtcacgtttttatcaccattatttttcttgtttgcttattattgacttgtggttccctatttcactctagatagccaagggaccaaactgagaactagtttgtaacctctatacagtactccctccattttaaaaagaacaaatactgcttaaaatttgatagctttttcaaattcatagccaaaaaaatattttttaagggacagagatggatgctgtatgcatctatgggtcagttacaaaattatgcaacaaaagcattgtcgaacttcaggaaggaaagctgtttaggttgggcacacaactgccccccatgaatgacatggccaagaattcaagctgatgtggaagtttgagatattaagtctatcagaaattaagggcccctttgaatcgcaggatagaaaaaacggaggaatagaaaaaacacatgattctgacaggaattgaagtgtaaaacagaggattgcaaaacacaggaaaaacacaggaatggtcgtttgattggtgcacaggaaaaacgcaggaatcggatgagagagatagactcaaaggaaattttccaagaggttggagctcttgctaaatttcctctaaaatccacatgcaatgtgccattccataggaatttcataggatttggaaagcttcaattctttgaatcaaagggccaaataggaaaatttcctataggatttgaatcctattaaattcctacataaatcatttaattcaaaggggccctaaacgctggtttgctaaattttccagccagctagtacatacttctattgctgtggtaaatttaatttgaaggtctggaccatgctgaatctttctgttaaaggaggctagtcatggaaacggcatgttcatcgctttgtcaagaaaatagnnnnnnnnnnnnnnnnnnnnnnnnnnnnnnnnnnnnngatgtattcaccctgaccagtcg

SEQ ID NO: 21819 - DNA, 1478 bp, Oryza sativa
  unsure (1)..(1478): unsure at all n locations
ttgctcaaggcacacaagtgcatcggtatgaaataatgtgtgttgataggagcaggcgtggtatctatcacaagaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagatgcatcagaaatgatatggatgagtcagaagcaggtgggaggactttacgttgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacgtatttgatgcaggtatggcgtacgacacaccggtgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 21820 - DNA, 1108 bp, Oryza sativa
  unsure (1)..(1108): unsure at all n locations
ctgggcatttgtttatctannnnnnnnnnnnnnnnnnnnnnnnnnnnnnnnnnnnnnnnnnntgttggttgcggaaattccccaagcggcgcttgtgcgactccaggtccttgtgtttttcttccaagcggatgctcttgatcaggagacgttggaaatccggataatccccggagactagacggacggacaggtcaaggtccattcctggcaggaacttctcttgcttctcctcatcttcccgcacatcctccggagcgtaacgggccaggttgatgaactcgtgcaaatactccatcacggagcggtcgccttgcttcaactctcggaattcccttttcttaagggccacgactccggcgggcacatgggttcttcggaaagcggcggtgaagcgagcccatgtaataggctgtccctctggctgcgtagcctggaaatggtcccaccatagagatgcgggtccctgcagctggtgggcggcgaagatgactttctcctcatcgctgcactgcacagtgtctagctttttccccacggcatgcaaccaatccaacgcatccacggggttgttggagctagagaaggtaggtgggcggatgcggagaaactcggcgagtttagagtgttgtgggggtggtggtggagcattaagttgtggcggattttggaggtggtggaggaaagcagtcatcatgttggcctgctgggcgaggatttgggtgagaatggcgttggtgtctggtggtggtggtggaggtggagaagaaggtgaaggtgggttgccctgatggttgtggttgctgccttcaggttggttgccatcaccggtgttagcacttctcctggtcatcaccatctgaaaaccccacacagaaccagcaaacagagagagctgacaattaaagctaaccacccacgactaccataattcttgaatttattactgctattaaatgggttcattaaagttcaagttgcttaggcgaataaaataaagacaggctccgacacagttacaccacacaccggcataaccgtgccccacacaannnnnnnnnnnnnnnnnnnnnnnnnnnnnnnnnnnnnnnnnnnnnntataaccgtc

SEQ ID NO: 21821 - DNA, 1659 bp, Oryza sativa
  unsure (1)..(1659): unsure at all n locations
ccatccggttttagattgttatattttctagtgtagaatttggcactcagaatacaaaattttggtactgtaaaatttgtcatgtttttgatacctgagagggcgatcatgtcggtctgggtgaggccgttggtggcgaagagcttgttgagctggtcgaggtcgaaggcggcgccggggaggctgtgcttcaccacggcgcgcgtcccgaccttgccgtcaagccgccccagctccacctggtagtagggtcctcctgcctgcatcaacgacaaccaccaccactgtgattaccaccacacatgacacatcatacaacttttgcctttgccttgcagtgaaatccaagcaattttactgctactacagcacgccgttcttgccatcaactgcaactactcacgagtgtgtgtgtgtgtgcgagcagaattttcggcatggcctaataataattggcagatttccgtagctctacgagtccacagcctgcctgtcgactgtcgagagcgtggctggtttggtaggtacgtgttggacgccggcgtctctgcttctgtatcgccgtaccgtacgtacgcgcgcggctcatttcagcgccccaacccataccgcgtaggagtagtagtagatttgaacggtgtgtttagttgacgctaaaattagaggtttgattgaaattgaaataaagtgatgaaaaagttggaagtttgtgtgtagaaaagttttaatgggatggaaaagttggaagtttaaaaaaaaactttggaactaaattcggcctatacttgtttttcacgctggagaaaaaagaattgatggatccaatcggagaagaagaaagaccaaagcaacgacatcgcagtaactctcgctgacgagacgacgaccactatgcagtggtggttacatggacaccctgctctgaattaataggacagctgaattcggacatgctaggggggaccacctccctcgccctcgcgaattttagcgccaaatcccaatttttccgattccattcggttaggtgaatgaattctctgcttggcttgcttctgtggagtattttgggcttctgtttagtgtagcaaagcaccggaccgatcgatataacgaagcgcacagcgagaggcgcataattgccgcacagctaagagcgtggactcgtgccgagccgggaacacgctgcggcgccgtgcggggcggcatggcatgtcaccctcatcatcgctgtcgcgcgcgcacggtgaaaaaacggcaaaaactacgggcgaaagcgaagttttctctcaagcgagcgcactcgaagcggcacgcgcgcgcacgccgagagagagagagagaggggatggtgtgggtgtgtttacctgggagacgacgtcgcgggcggcgagggcgaggatgtcggcgcaggagaccttgttggcgcactgggcgtcggcgtcgacggcggccttggcgcgggtgatgaggtccagcgcgtccggcgacagcgtcgtgtccgcgcccgcgctgtgctcgtcgtccggccccgcgatcagcaccgacgcgtcgcacccctgcacacgcacgagcacgacacggcacgatcagcaacacgaagaacacggagtcgatggcatcgggtaccgagctggaatagcaattcaatnggaccac

SEQ ID NO: 21822 - DNA, 2364 bp, Oryza sativa
  unsure (1)..(2364): unsure at all n locations
tctctctctcttagccgcacagaaaagtgattagtatacgattaattaagcatttattattaaaaaaattaaaattttattttcaaagtactaattttttatatagaaaaatttcacactaaacacacggtctaatcgagaaagcagccaaaccaaccccactttataacagacccaaagctatttgttaagatcatttcttaattaaaatgtttaatttatccctatatttaagtagataatccgagacaatatcaattattatagtagattatttgtttcgcattctaaaagttatgtttcttataactattgtactccttctttataccatttgtcctaactttttttattaagtccatttcttaagagtggatcatttatttcattttacgcgttcatcaaaccttggtcactgttttcggcagcctgagtacttttgcactggagacgaccaacgtggtcacactatctctagctgtgtgctacaaccgtggcaatgtgttctttcaaaaaaaaaaacaaccgtggcaatgtggcattcagctgcttattgattatgcagtccgttaggaagtactatctccgtcccaaaataagtgcagccgtagatatccgtgtccaacgtttggccgtccatcttatttgaaaattttgtgaaaaatttaaaaatatttagtcacacataaaaaatttttcatgttttatcatctaatggcaataaaaatactaatcataaaaaaatttaaaataagatgaacggtcaaacgttgaacgtgaatagtgtaaaactacacttattttggaacggagggaataccgaaatggtatcaggaggacaccaggagaagatcaccgaattatagtagaaatcaggcacgagcttgtcctggatttttcacattttggttcttttgaaaaacttatttcgcaaatagacccctagaaaaacttatcccaaaaattgtcctttttggggcgccagagtggctggcgccctcnattcaacaagacggcgccagcctttttagtgccgtccccctgtatacgtggcggggcgatgctgaggtggctagggggagtaccccagaatggcttggcgccacccccccctcgaaattttaaatttttgtttaatttggttgatatttttttcacgcttagggacacacaagaaccaaccatagaaaaattgaactcaaatggacataatatgtgacctgtaaaatttttcctctcctctcctctcctctctctcccaactagtgcaaaggaaaaagatgtgcaacttttttatttttattttatttttttgatacttttttcacacttagaaactcacaggaaacaaccatgtaaaaaataaactcaaacggacgaaatatgtggcatgtggaattttccaaagctccaccgaaaaacttctctcctcgaaaacacaatcttgcaagcggaatttggaggttttaatatcgccgccgaacccgacaaagctggggagaatcagatataactttttctgtagatgtccgtgcatatattatttgcctgattccgagtccgtaagataaagttacgcttgttttaatagatgacatattttgtccgtttcgatagagttttggaaaattctacatgtcatatattttgtccgtttgagtttattttttatacagttagtttctatgttctcctaagtgtgaaaaaagtatcaaaaaaatgaaataaaaataaaaaaaattgcatctctatgtactgtttaacttatatatgtcatttcatgtggttatattttgaattagattaagtaatttcatatagtggtagagtgcattatgtttaacatgctgatcaaagggttttactaaaggagttatggtctaattttagtgaatgtgcaaagtagactaagtggaatgctagctattttcagatttagctaagtgatagttcgagtttaaattttttttgcggttggttatatcgtgatcctgagtgtgaaaaaacatccgacaaaataaaataaaaacaacaccgttgcaactccatacagaaaaacaggaatggaggcggcggcgccagccatgcttgcgcccttcttcctggggcggcgccagcatggctggcgcccttctcctgccacgtaggttcgcgtgcgccatggtggcaggaggacgactacagagaggctggcgccgccccgttggatgacggcgccagcccctcttgggccctaaaaaggaccatttctgggataaagttttttaggggtctatttgggaaataaagtttctaaaaaattacaaatgggaaaaatcggccgatcaaccacagtgggtttcatagttcattaaccctactgtt

SEQ ID NO: 21823 - DNA, 8847 bp, Oryza sativa
  unsure (1)..(8847): unsure at all n locations
gcccacttatatagagagcgggcctgttaaaatgaactagatgtttagaaaagactcatgtgtcaataaagctagggggtgggtggtgcatcttttgtgtaattctccaagtgtacccgacggcaaaattttgaaaaaaaaaacctaattttaggcgggggggtaaagtggggaaccgtatatgaccttcttgaagggagctagggagtttgttttaaagaattcgatacacccccttaccggccattttgcagcggccccccggcacagtacaaattcgccctcgcgaaggcgggcaaggggcccaccttcaaatttagttgagggctgtcgcccaagaacgaacggccgtttgccacgtcattttccccgccctctggaaggccgatttttaaaaatcgccttcccagaggccggtaggttttatnttgggtccagccactctggcgccctaaaaaggaccatttctgggataagtttttttaggggtctatttgcgaaataagtttttcaaaagaatcaaaatgtgaaaaatcggccgatcaacccatgtggcttccatagttccatcagcctaactgttgtgtcatatcatatcaacaacgatacaaaaaggttcctgtctagatatgctccgtggggcccatggaaaagtgactcaaagaagaagaagaagaagaagaagagatggtactcgtggcgaaggaaggatcgacggggagaaagcggcagcggcaggagagccaaaaagggcgcgtctttccttcttttttttttcttccttttttctgtctgagcatatattcttgagagattatactggtttagtttaatgaccccactatcagactacccgttatagtgcaagagacatctttgctttttcagagtctttcggatgcagaaagagactagtttaaagcgctccgcttcttgacttctttcagtaaggacatccttgttggcactcaaatgttctagagataatcttctggacgaagaaatgtgcataaaactattacattcagggtgactagttatacccattaaactagctactagtagtactagtacattcttaaagaaaatgttctactactaattactccttgctgctagtactatcctggacttgatgactgaatattcacaggccgtgttactacagatcgagcttagtagtactcccaagttaattactgggacatattcagatttgccgtaactaccgtgccagttttgtacagagatgtcatcgacgtaaaaggaccggagatcattccctcacatgcctcctccaaaagttctgaatttgtctgtgcatgagcaaaaaagcaagagttactacctcactttctttgcaccttcacatgctgcctccatcaagttactcgtgtccgatttcatgaactcaacaacccgagttacatactcgtgcgcaacatcacgagcagttattaatgcgagtgcttgtgatcactcggaagaagtggccggtgcgtctctcggatggagccaagtaactgtgacctgtgaaatcccattggcacgatacgttttgtggttgcagcttaaagagcggctagctttcatgctttgaattgaaagttcgaattacatgagtggaccgattgattaggttatctttcgagctctgttattactctatctaagttataactggagtactatagtaaggaagacactgtagttagttaatactagtatagtaatagtactgaattttggtatagaacattatattgggttggtacatgtgcttgtgtacatgtttgtataactttccatgcctacctattggatgcattcatggacaaagaaaactgctttcagtgtctagattaacatatctcaaacttcatatgcacggaagaggatgcatgtggcacaaagcaatgcaaattcggtacagattgctcagggatatgcctcttctagccaaccaagtaatgctagtttatttccgttttgagtacctgaccatacctgatcagctaggaatgtgctacacaaaaaaaaagtgtttgcacaaaagaaacaaagttttgctttgtcaggtacgtgcaaaggagaatgattgaaagggcagatgaattctgatatgagtgaattctgagaccggtcagtaggaagcaataataattgtacacaatcctgtgcttgaacggtaactgctttggaaaagcttgacagttgcagcgcaaagcacaacactttatcgtgcttacagaacaaaaagaaatgattaatcgagtgtttctgagtagatttaagccctggtaggaagcagtatggagggattatcttaggggtttgtgctaacaaagcaagataataatcagcacaaacgtaacttggacggcaaagtcaggtaagccatgattaattaacaaagggttaatgatgattacaagttctttggacgccgctccttccactgagtgacagacaacggcttcggagcgggtagtgactcgtctccctccacttgttattttccatcacttttataagtaaaagaacactgaaatgccggtagtctcagcttgttcttcactcccatccattcaacaggttacatgaatgaatatacaacaaacattaagtactgaaaaaacagatttaataaatctgtcaggccatatgtgatgaattaagggatggaaacggtcaggaactttatcatttctaaaaaatggttctccatctattgagaatcttttatatttatcaatttaacgacgatctcagtacatcgttaatacaaactagaaaagtcaaaatttatgtataataaaaaatgtaaatggtcgaaaacggtgctcccttcgtttcacaatataagtcattttagtatttttcatatttatattaatgttaatgaatctagaaagtacattgtgaaacgaaggaagtactatttttacgaaaacaatactcggtctaccacgacgtcactatattcatcattttcagtagtaacatggataaagagtacactggtacaagaacaggatcctgtcacaatcggctttgagtacacagtggtagtatttcttagatgcagatatcaacgccgtattagcgtgtcacggacaattctagccaaggaccacgcaaaacgttctagacttctagtaaggtgtgcacctgcattatgccggcatccagcccccattccacccggttttccccgtgaatccacgccgatatcgttgggctggcgcctgctggcttcgcaaccgtctcgccgcagcctcggattgaccaacgcggcgcatcacgcgcgcgaagcaagcaagcacgcctgccttccaatccgtcccgattttgcacgacgatgaggaggtcgttttcgcggccacgaccacgtcgtttttgcaccggattctcccgtgcgcacggggcgaggcgtactgccctacttgggcgaccgatcgatcgaaatggggcaccacgaccaccgttgtggtgcgtggccgtatctatccggctttcccggatgttccaccactaacagcgatcttatctcatctttcagattgtttcgtcaagctaatcatcatggtcgacgcattcgttggattatacgatcctgtgatcctacaagggtaggtttaagttaaccgtgggggttgattattgctgtctcttgttgagcccgtgaacattaggtggtgataaaaacagaggggaacagactacagagacaggcccagcgcaatctcggactcgcccaatcatcgccgatcccgtcgttacgcatcgtactcgcacaagtaagcgacgcgaagccattaaactgggaagaaaaactagccacacccgtgagcgaagaagatcagattaaatatagacacccagctgcgtcgttgcaacgggtgtgattcggcgccagttaatcgcgcagcaagcaactgatcggaggagctcgtagccttctcgatcacttgacgcgacgcttgccgctcgcgatctcgcatagtggcaacagctaagtgtggcaagtgacgacgacgacgacgaggctagctaaaagggatttaggtcttgtatccatccgtatcctatcctagctatatcatcattccgtcgtgatcctgggattcgtgtacggcacttctccaacatacataaatacattatatgcatactttcttgtatattgcccaatttttctcttcttttctttggtccctccctgccctacataattccacagtatcctcatcatcgatcgatctccttaatttggagtttgatagatagagttaggttgctcgacgggtggcagagtacttcccctgcctgaacaatgtgtaattagtgcagaaaagcaacgtactacgcatatccaatggaatacagtaaagcgtggtgtatatcttcaaggttcagcaaagacgataggcattagtatatctttactgatgcccccacatccagcggcgcacgtcaaagctagacatacatgcaaagatgcagtggtacactacacatactgcaaagacaacaaattaaagcaatagataggatggatggatacatgaatacggttggtctcggtttgccgaatgccaggctggtcacatacatgcgagaggatgtgaggtagagatgccacatggacaaaagtacgtgctcgcctacaaagctatgtccggggaggtcatctttatcggctagtctagctagctacgcgaagaagaagaatttagcccggaaagtgacggcccaccggccgcttcgatcgaccgggcgccgcgccgatcgatcgacggacgcattcggatgcagcgcacaactgcacaccacttcattttttttttctgtatgtagcacgtactgttgtctccaagcatgtacaggacagagttcacgtgcaggtgaagtgtagacctgggcacctggccgtagaacacaagaggacagagaagagacaaacagagttagctcctctggaagaagctacctcttaatccaagggtgtgtttagttccacgttaaaattagaagtttgaaaaaattaaaacgatgtaacgaaaaagttaaaaatttacgtgtatagaaaagttcgatgtgatgtttttagggttcaaactttgaattacacacggcccatgtcaattttgacggcatcgtaaaatcggttttggccgcgagccagccgtcctgcaaaatccgccgcgtccgcgcacgcccgcggccgtcggtttttctgtctgcctggtccaggagaaagcctgtctggctggctgcctgcctgcctgaatgcgttgataggggaagagatgagaacgagatggtggtgggcactggacagggtagcgagcctgtacatctgcatgcagagtagtagagtatttctcagcgtcttctctacgtccctggtcgctacgttactagtacgttaatcaatccgagttttggaatgtttcgcacttgccaaccaagtatgtcggaatgttgtggtggtagtacacagtagtacacgctgtgtgcttgtcctgtagctgtagtccgtgatgacaacttagttcgacagtacattattcatccaagttttcacctacagattataataaacttctactctcagttaaaagccctggcaaatcaaggccaaggacggcagagcttatctagtggagtactagtatatccactagttggtggcgacacgcatgacccgatgcgacgctgggtgtggatgactgctaggttgtgagttgtgactgatcgacatcgatcatgatccactgtcataagcttgcctaggactgatcttggatagatgaactccaacttgagatcatattgaagctgtgctgtgattgtgagatatatatgggcccagtaggcctgctgggctgtgctccacaaaacaggccaagacagagatgtaggttgggctcctggccgactgacctgattagactagctcaattagccgacactgatgatgacatttagggttggtttggtttgtggtctaaataggccttaccaaattttgtcagtgttaaattttggcacgttttggcatgactaattttggtaaggcaaagttgtgtttgtattgaagccaaaatagcctaagttcactattgaaatggtctattttcttatgcatgtcaaaatttggcttcaaactaaatagacactaaacactattgaaattgctaaatattggtaagcataatttagacctcaaaccaaaccagcccttagagcccttcaatccagagatgacgacggaagtaccagctaactgaaaattgtatatcttggagattaattagacagaccccaaccgatcgttttcaggctgcttgatcgtataactggcctaaacacgatcgatttcttttttcggatacgtaaggaacatacttttttctattaaaagaaataaaagttatttacatgtaaaaggaaaaacagcatgagactgatacagtcgatcatgctgggtgtgctgtagttacgtacacgatttgagcagtcagttagtgagacaccagcgctgaactcgttgctaattaagcattttggtatcttaagcttctatgtgtttttttaaacagaagagcagagctcctcccctttccattaaggaaaagcacatgttcagttcagcatcttaagcttccatgtagcagtggcatgccgaatttggaatggttttagtggcaacaggctagcatgataggcaattgtgcaaggattagttatagctgtggaagagcttaaacctttataaactctctccctggcttctcttcaactataaacacaatagtagtttgaaaatcatttgacaaggtatccaattgcacgaggccatttcaggaaggatttaactaacactagagccagttaaatccagactataacacggggcttgtactttctattgacatatttttttcaatcttgttttatatattgagtttggatttgatttttttttggttgtagagatgtcgtttactctgtgttgtcaatttttctcaaaactctttatgcctatttgtattgtatttgaggattaactgtgtgtctgttcgtaaaaaccggaaatgtaaattatttccattattaaaaagtatatatatttgagggataaaggtgcacgatgggatatcctagaggggtcaaaaccacttctaggaccaactgtggcctccaaccaaataatcttctataccataataacaaagaaatccacaaagtcaatagtgaaatggtagaaaaaagtcatgcattaaatatgcagagactttttcattccaacactagctcattctagttaatagatggagaatgactcctaacaacactataaatgtggtcgtgtgcatccccttgttgtagaggcaccacaggagaaacgatctttaataccggttataagaaccgagactagtaaatcaagactaaagatgtggaatgctaggattcgaactcaagatctcttagctctcatacgcgttaacatcctatctactacacacatctaacttggatggagatgctttctttttgaattaacactggagacatatttaatacgggttggtgttaccaaccggtactaaatatgcatctttagtaccggttggtaacatcaacctggactaaagatcctccagcattagtctcggttagtgttaccacccggtagtaaatacacatttttagtaaaagatatttttagagacttgagcttttagaatcggtactaaaacactaaaacatctttagtacttatttttaatcttgctaggatatttgtgttttgggtttaggataaaaaatcgcttctctcttggtgaggccgagttttattaaatccattattacaaaaacaacactaaattaaagtatactatatcatattgcaaatatgtccacctttcatggctgtgctgagccaacgaggtaagagtgattcaagatgcattttacacaacattcttcagaatgattcaagatgcatttaacacagcatttttccgcgttatttcaagcagtaccattactgacagtctgacactgcaagttgtgacattgtggctgtgtttagataagtttggattaaatttcagtacttttccattacatcaacctgtcatacacataacttttcagtcacatcatcttcaatttcaaccaaaatccaaactttgcgctgaactaaacacagcctgtatctacttgtatatcatgcatgcatcacgactcattccatggcaataattaatggaggactggatgtttctcgtggtctagctagtgacactatataattaattagtgtaacaataattaggttggattaaccatgatagatgatattttatatatattgtctccatctataaatataacagatttcgagttcgaatttatccatagatataacgaattctaacataccactttcataatccatccaaagcacaagtttactcacgaaaattgcatcataggtgtaatctttggagaatgcaatacgtacgctagggattgagatcctctgacagaacttccctctaacttggtagatgatatgtaggcctaagagtgatgggtccacatgttagtcacagtgaacagtaacgtcagaggatccctctctgtacgccaaatacccgacgctaacgaaattatcgagcgtccacagccactggttccccctctatctccctacacgcctactctctcactctatctcacacacaaaacatgctcccttctnnnnnnnnnnnnnnnnnnnnnnnnnnnnnnnnnnnnnnnnngatatgcattcaaangccggcg

SEQ ID NO: 21824 - DNA, 995 bp, Oryza sativa
  unsure (1)..(995): unsure at all n locations
gtcgatcacatgtatgtaganctgttgtgatgantttttcgtctagacgtttgtgatgtgtcatttgtgaatgatttagataatatcactctcncccnnnccgcggttgagatcnaatacnctatgccgcagccgacantagaggatcccgcctcacagncaanacaaaancngacaaaccaacaccatctggacacaaaccatattttctttaccggaactatctgaaatgtgaccttacttgacattgcgcctgatgaaaacaataactgcggtaacctcgcatttcgtgtactacgccactaagtttacatgactttacagatattgttcccctaaaattgttaaagattacccttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatacaaaagatgtatgggagcatacctgtgatgaattgagcgaaccaacagggcttcgccgctccccttttgctgccctaccctctctctcttttgttttttttggatttttagtgaatataatgaaatttcacagaggagggactgggctttatagggggagaggcaaaaatcgccctcccccagggcggcaagggggccgcctgtaaaattccatgccccctcgccgcccatttgcaggcggcccccccccacagtacaaaatcgtcctagcggagggcggcaagggggccgcctccaaaaatccatgcccccccttcgccgcccatttgcaagccggcctcccgcacagtataaaatctgccctagcggagggccgcaaggggggccgcttgcaaatttcgttgacggccgttcccccagagcgaacgggcgtctggcaacttattttcc

SEQ ID NO: 21825 - DNA, 5180 bp, Oryza sativa
  unsure (1)..(5180): unsure at all n locations
aggccggtagccgactccttccgtcaattttcantatgaaaatttatttttgtaaaccttttaataaaaaaaattataaataaaaaaatttcatcttgctccgngggcaaaggtgcgtatagatggccaaacgggtggccgggcctggcggcccgacttacacaccgggtcatgccgtgccagcccacgggccgcacacacaatctaggcacggcccaacacgactcgggtcgtgccgggctggcccgaaggcatgatggcctatcgtgcttttccacagaataagtctaattttcctccctcctcctggactgtaacatacctagctaaaaaagtctatattttctccctcttctttgggctgtgacatattaatagctaataagtctattttaggtccctattctttggacagtgatattcatatgtctatttttagtccatatactttgtgtgccgggcctagcctaccggcctatcgtgccgggccagcccaacgtgtcggtggagaggcccaagcacggcccgatggttgggctgggctatcacgggcccgacccaagtcgtgacgtgccgtgcttgggtcgggtcaaaatgtcgtaccgtgggccgggccttcgggcctcgggcgttatggccatctataaaggtgcggggaaaagtacaccgaaggtccctcaacttgtcgtccggataaaaaatgtcctcgaaccgcaaaaccagatatgcgaggtccttcgatggttttgaaccggttttggtctatgtggtggctgagtcagcgtgggacccatgtgagccccacatgtcaggtgtccacgtcaccctctctctttcctatcttctctcccttcctcatctctctctctcacttctctgcaagctcgcgggggcaaggcgggagggcggcgccgcaacggccgccggcggaggcggcgtgcgagcgcggcggcttctccgctttcttcacctcctcgtcccgctcgggcgacgtgggctgagcatctgcggcagcaatgcggtcgcggcgccggcgttgcctgcggacgacgacatcgactccgccgccccgcgcgaggaggaggaggaggagacgggcaccgcgcgcgccgccggcgcgtcgtcatcgggcgggtcggggagcaggagcgggagctacccgccgttcaagcgggggagggacgagcttgttgacagccttagcaagtttgccgacgaaacccggccgtcgaagcggccggcggcgaagcaccggactcgcgccaccgaggtccataacctgtcggagtgggtaaaacctcaagaacaccaaccaaccattgatggatagatggtgttgcctcatttgcaacaaggtgaatgttacttgattttttctgttcttgctgcagagaagaagggatcggatcaaggtaaaatattttttgcgaaaaattgtgggaaattttgttattctgtttctgaaagggtttttgtctagagcaattatatggtctatgaggtaccaaaaatttagtgtaaaatttggtacctcatagtacttgggtacctaagaggtactaaatttacaatagaaaaaatgatacctcatggtatcttcttaaggactgtaaaattgctcttttgtctatgggagatgaactggaggatccctttgcatagataatcaagacaacaggaaaatgcttcatatgatgctacatgtatggaaatgacatgcaccggcaatatatgaagaatatagtggctgtgtggattcagcttgagccggcatagcagcagctgcacaagaacatcataacagtgacagtttcactcttcttttagctgatgttacagttatatgatgcctgagggacctgcatctggtgagtccttacaagaaaaattctaggaaccaaatgacagttttggttgctatgttgatttttcaactggataagcataaccatcggttcttcaagattgcacatggcctgaagcagaaagaaccttcaagaacttaggtagactgaaccatgtgcggagcgcggtggcttctccgcgaacgcccggcaccccaccaccgtgttccaccgggcgtacgcgtcgccggctccgctgacagggctgacgcgttcgtcggcgcgcgcgacgacacgagcgcgcccacgtcggccgagcgggacgaggaggcggagaaagtggagaagccggcgtgctcgcgcgccgncttcgncggggggcgtcgcggggcanccctcttacctcggcccgggcagcttgccgttgcanagaagtgagagagagagagattaggaagggagaagaaaggggaaagaagaagaagaggatgacgtggacacctaacatgtgggacccacgtggggcccacattaactcagccgccacgtagattaaaaccagggtaaaatcatcgaagaacatcgagtgaccggtttttgtaaagttaagaaaccccgtatatcttgttttatggttcgagatgttttttatcctgataacaagttgagggaccttcggtgtacttcttcctaaaggtgcgtatgactccttttttgctttgcagatgctctcttgttattgtttgttccctgtgatccatgtgttttgttgctaatatttgtatatagtagtgtgggtgatgttcataaatatatggatcagactatgcacttgtatatggtagcgggctgatgttctggtctagtagcgtctcgcagatctgaaaccttctgatgagttcatgtttttggggtttctgtttgggttgaaactgaatcgaagcattaattttctagccatgatgtaggattgaaatttttgctttttgttcagccaaaactagctgggtggcccgtgcaattgcgcggctagcacttaaacaaaatcatatatttttagtatgattttatttaaaatttattaaatagctatctcattttcttaagagtttgaaagaccaaaccttatcatctctgtgtttctaattatatagttttttaaaagtcacaccaattgctaccccttatgtcatctccttttttatttgcttgttcgatctaccactatttctattcattcttcttggaacctttaaaaattggatcttatagtttttagagtttttttttgtcacgttgggttttgtttttataatttctaggcgtcccgtcaaacgttgccattatactcctctatggtccgttcactatctcttctctttattgtcattgagattttaaaaatcgaacataattatcgtttgggttcatttttactttctaaaagtcctgtcaaaccgtcagcggctttgccattgtacttctctatggctcgcccgctgtctcccttctttattatcattgagattttaaaattaaacatgattatcattgtttttgttttactttttagaagttccgaacctttaaaaattgaaccttatagtttttagagtttattgtcttgttgggttttatttttaataatttttagaagtctcgtcacacgatgccactatgctcctctatggcccgtacgccgcttactctttattgtcattgtgattttaaaaatcgaacataactatcgttggaattcattttttatttcctagaagtcccgtcaaccgtcggcggctctgcaactatactcctgtacaccccgcccgctgcttctcctttttattatcattgagattttaaaaatcgaatatgattatcattggggtttttttttactttttagaagtcccgacaatcaccttgttcgtttgcttcacggccttcctaccgtccctccttttaatcgttattaggattctatttggtgttttattaacagtttttatatgttgtatcaaccgccaccactctactctactataggcctattacttaatttatctcgtcaggtcttttagatggtcttttctttcaatagtctttatttttatcataaattttatttaattataaattgaaaagttattttttgttttgtaattttataaaaatttttcctaaattttaattaatatcgtattgtgttcttttaatatttttattttttattttcaagagaaaagcccgtgcgctgcaacggatgacaactattttagtcttaattcactgtgagaattcgcttggatctatatatttctataaaatcataagctgcggttaggagtctgttcgtctaaagtcagcatgcgaatttttttatacgactcctatatttccaaaagcggacgaacttaagaatcaactcaaaggatatatattttttcaaaagcgaacaaatttataaaccgactcatacacggatgacataccaaaataccgacaaaagaacatcttaaatttttcataatagtagaggttttttcaaaaaaaaaagtagaagtagaagagaagagaagattacggacaaaaagtcattttcgaggcaatcgtacttttttttgaggaatcggtcgtttttattttttttatacggtagaagttttttttctctttttttattttttcttgccttttttctccacagatagtcggacttttttatggagtcggacgtttttttttaacatagaatttctttttctcattttttcttttttttccaccggaggagtcggtcgtttttttagatagaagttttttttttctgtttttttgataccggcaaaaacatcttcaatttttataataatatagatttcggttgtttcaaaattgtattcctacttgaactctcttttaatttatctaattttggatattattttattttttattctgaattttaattaatcacatattgggttcttatgtggattcttctttcaatattattttttttaattccgaatttcagctaattttaaattgtactcctatttgaactcttcttcttttttttctaattttggattttatttttatttttattcccaattttaattaatctcgtattgtgttcttatatggacttttcttctaatattccctatttttaattccgaattttagctattttaaaattgtattcctacttggactatccttttttttaattttggattttattttatttgtatttcgaattttgattannnnnnnnnnnnnnnnnnnnnnnnnnnnnnnnnnnnnnnnnnttgtaatcaatnaccggcg

SEQ ID NO: 21826 - DNA, 1676 bp, Oryza sativa
  unsure (1)..(1676): unsure at all n locations
cgcggattgtanactcgnnnnnnnnnnnnnnnnnnnnnnnnnnnnnnnnnnnnnnnnnnnnnnnnttcgaattttgattaatctcatattgggttcttatatggactcttatttaaatattgcatatttttaattctgaattttagctatttttagattgtatttctacttggtctctccttttcttttttttctttttctccgattaatgtgggaatttctagcccttacagcgaacgcggtgcctcttttcaaagctgttttaataatataacaaatgttagttattaattatttttaatatcaaattttagttatttgtaaattatatatattcctacatggactctagactcgtcttttaatatttcttttttttaattccaaattttctgtaaattgtatttctatatagactctatgctcttcttccaatattatttatttttatttatgaatttttattatttataattgtatttctatgtggactctaaactcatctttcaatattttttaattttaatttcgaatttcagttacttctaaattgtatttctatatttgtatttctatattgaccttaaattcttcttcccatgtttttcttaatttcaaattttacttatttgtaaattgtatttttatacatactctaaactctacttttaattttattatgtttatttcaaattttagttagttttaaattcctatatggactctatactctacttctaatattccttattttttaattccgaatttctattttttttctaaattgtatttctatatggattctatactttacttctaatattccttattttttaattctaaatttatattatttcctatttgtatttctatatgtactctatactctacttctaatattccttatttttaatttcgaatttcagttttttcctaattgtatttctatatgtactctatactctacttctaatattcttttttttttaattctgaatttcagttatttcctaattgtatttctatatgaactctatactctacttctaatattccttttttataattcggaatttcagttatttcctaattgtatttctatatggactctagtctcctcgtccaatattccttattctttaattccgaattttagctatttttaaattgtatttctatatgtactctgtcttttctttttctccgattaatgtgagaatttctagaccatgagagcgaacgtggagtctcctttttctattcctttaataatataatagatagatttgaacgatgtgtagctctagcccctttagtaggtctcattaccttctgaggaagagctaaactcatactcctacatgtctgttgtgtgccaaaatatttgcttttttttttgctcagcgccaaaatcaatgcctctttggcacaggtcagcgcggctacaacagtcatcaaggcaggcatagcgtgatagcgactccctccgtgagtcctgattgattttgtttataattttgtggcattacattcatcatcagaaatgagcatagtttctgttcagaccagtgtcaattttgtatttttgtcattttttaaaacttctaaaaataagtggttttgtcatatttgtatttttatattttgttgttnagtggaatngcattcaaacccac

SEQ ID NO: 21827 - DNA, 4296 bp, Oryza sativa
  unsure (1)..(4296): unsure at all n locations
nattatacaaatacacttgttcaacttgctccaagacagttattgacatgatacatcagtgaacgttgttagatcaagaggtatctatttcttctctacagattatatgtgaagtggcatggacgtcatgcaaacttggtaatgactactaactgaaaagataagcatattcacacagctgtgctcctgctaccgctttcatggctcaagtttctgttttttggtttgctgttacttcacactgtgcaaagtgcaaaagcaggaattgtttcaattcttaggaattgtttcaattcttctgttcagatatgcctgatcattgtgcaaactactattttgtcctgtgtttttgcggtgagcatttgtaagcatcttgtgttgtcctcttattttcagccaaacaaaacggatttgaggttttgtaagtatattgtgttggcctcttattttcagccaaacaaaacgggtattaagtccagatccagcaagctgggccatatgggggacacgtagacttattgggctaccgggctcttttgaaatgacaaaacgggcttttaaaaaattacctaacccaacaaaatgatcggagacaagtacaccacgcacatcatgctctacgcgcacgtgaggacaggcaggggatgagcgacacgtgggggtatcctgcggtagaaaattcggctgcaaactaaaattttttcagctggctgtcagctactccctccgctcaaaaagagacaacctaagtggagatttgacctcacctaaaacaacgaatctggacataaggttatctttggggggggggacggagggagtagacagtcccgaaattttcccctttttttctctgaaagaaaaaaagacggaaatttattcacattgcatgggagtaacaatgggcctgttcggctggctggtacagccactatacgcagccgttactactgcagctatagactcaacttactgtttgtaaagtaaagttaaatgcagccgaacaggcgcaatgtcgatagcaccgtaaaaacaacagtctgaaagactgaaacgcagactgtttctatggaaggttctggagatttcagaaagactcaagcaaaaatgaattttattttcataaattgacgaaatttaagtgaaaaagtaccggacgaagccgtgccaagccacagtgttcaaaacaagttgagctacgcaacaaaaacgagcgctcaaaagatctctctctgctctagaacgtttcaccaaagccattcgcatttggccacgtggtcgttttctcatctcaagataagccttcttctactacctaagcttcgagttctcttctccctcttcctcgctgcagcaatccaagacgaagctgagagaaagaagacgaatcgagagcaaaagctcaatctaagctcgcaagaaagctcgagtagcagccatggctttagcacccacgtctctccggtgctttctcaccggaaggccactgtgcagtgcgggcagcacggcggccgtgctcccggcgccgaagccgacgaggcggcggccatcggcgaggctctcgtgcagggcggccaatgaggcgccgtcgacgcggggtgatccttcggtgaagcttggcaagctggcgatggtcgcgctggccgccggagtgctcgcgctctcgcctgtcgacgatgccatggcggccaagtccggcgggagggtcggcgggcaggcgttccggtctgcgccacggtccgcgccacggccgtctggtccacggataaacaattcgaggtaataaacgatgattggttccatgtcaaatgaaaatttcatcacattcaccatggataaacaatgatttgttcaggctagttgttgtttctttcagtacgagatcgatcagattttgactgaatgttcacatcgtagtagtgttgattcatatcgatctctcaattcgttctcaactcgatcatgagcagctgaaagtctgaaccctcgaaagatcaaaattttcgtgatacgagtttctaatatctgaaggttgtatgctaatgttctgaatattcagtctggttgatttttaattttcagtacgaagatctgacttaactgaatgttacaattgtatgttttgctcatctcgatgatgaacagataaatgaaagtctgaaacctcgaaagataatggttttcttcatgatatatcaatttctgaaacctgaaggctgctgatgctctgaacattttgtgacgcattggcgcaggacgaacatctacatcaacccaccggtggcgccgcctctggtcggcggttacggctatggctacggctacggttggtcgccgttctcgttcttcgctcccggcccgagcgtggccgtcggtgtcggcggcggcttcgacacgctggtgctgttcatcgtgctcggaacgatcgttggcgctgtcaggcggtttctcaacaggaacgacgacgactacgatgattactgaattaattactgtgttgctgatactgttaggaacgatgtcatcagatcataccgtgtgtaatgtgatatagcgaggctattttttttcatgtcaattctaagggaacagatcggtaagctagaagtgaaatacattaattggtgcatgaggagcaacctgtatgtataattttgttcttgtggagtaaaacgagagtagatttgtatatctggagttaatcgatctgaaattgtctgaagaactgatggtttaatttgcaccagtgtttccctagtattgcagcgggcggtgcagcatgtcgtataattgtataaacatcacggcattcgtgtcagtttcaacaagccattagctaaaaccgtacgtagatcaattcacaaaattactgcccacctactaacaacaagcataagtgcagaagatatggggatttttttcacacaactagaaagataactcgcgcatcgtagattgtatttggaaaacttatatagatgggatatcaaccggatgatacctaccatgtttgaaaagcaatatttctcaataaattttctacatcgcattgcttagataatttttccaaactatttgctagcttataaaatatatgatatttaatacatccctataaataattatctatgatctcttcagtacatagctatatttaatttgtttagaaaccatttctaatttaaaagtaaggtgttttgtcttatttaattgaatgtttagtgtcatttttttaacaaatcaaaaaaaactattattattagtaaatgtgttttatttgtagaatcaagttagtcatccttttagttggttcttattgacgcaagttattacatacttagtatacactgctaccttagtgtggcttcttatatatgtaacaatatgtggaaaaactcatagtcctatggtatggtacagtatagatgtaaggccattaatatctaaacatttaaaaattgttatgaaaataaaacatgcaaaggttggtccaattttagtaaaaagtaagaactattttttttgaacttattagactttctccaaataattcaatttagtccttttggcatttggcattttacttctatcattatagatataatttaattattgtgcagttatatactccgtagaacgataaaatatatatcatttttttcataatttcataattgtttgaatgtcatggtaaagtaaaaaaaaatataaccccaaagtggcatatgaaaagttaaattacagtgaatatgggtttctaaatgtaaaacaatctaaagacatgaatggatcgcgtgatttagatgctatagttatttattttgtagtataagtttggcagcattgctcatagttatattcattttgcttttctgattgtaaatctaatttaaataatgaagttatgtacgattattattattattattattattattattattattattattattattattattaaaagtctaaaaataaaacccaaaatgacatttcttttcagagttgaattatagttaaatttgttcttcaatcgaaaatttagtcataagatataagcggatcaaaattagttatatgatttagattttataaaacataatttttgcttttctaactaataaaacatgaaaataggagaagtaacagggagaaaataggtcatatttttccttaaaaaaagtaacatacgtaagtacatacatgcctaggtgggcccaatgttaggaggtaactttttttctttaagataattataggggtaccgagctcgaatttcaattcaatgcccgg

SEQ ID NO: 21828 - DNA, 1118 bp, Oryza sativa
  unsure (1)..(1118): unsure at all n locations
ttgggcgacttgaatgctttgatatcgagctcgtacccgtttagatataaattttgctttccaactaatagaaggaaaaaataagagagataatggagtgaaaagagaagaacataataggatggtacggagtacgtacatatacaaacgtccatacaaatagggtgggttcagtttagaggtagattgggtttttttttcattctaatctaacggtttaaagaatggatccatcaatttaaatgaaaatcgatggttatatagttttcttccacgtgacagcttaggaccgtttgtagggtgccacataacggtctaggagcgtttgtagaaagtttaataaactttttaatatataatagattgcaatagaaattaattggagacaaacagttcaattcaatatctcatacattatacattcatacataagtggatgaattgaatgctttgtaaacaagcattgatgttacatcagtgtgacgttcagacttcagaatcgatcatacggctgctgcagctggccgactccaacaagggtcttcttcctcctctggttctctctgttccatgtgagaacttctcccatgagacctccgagcaaaccgtcgccaccttcgtcttccaatcatggagaggattccattttgctaatccaagaagatccaataactctcatacattcgcatcaaccaacgtcacaatttagcttcttcttcctctttttcttggtctgttcttgtgctggctagctccgatgtgagtcagtatagatcaccatgtcaccaacaccacagcagcatcatccaaaagcttctttgatgatctttgcacgcgcagcaattgcagttgactccgatcaaacgatctttgcgccaatccatgctgatcagtgatcacgcacggactcgctggtgaagcacgccgcgccgatcgtcctcgagcttttcccagacggggaacgggaccatggccgtgccgggcgtncagagcctcgccgccggcgcccgcttgtacgcctcgtggcacagcgcgtcggccacctggttcccctcgcggtaggcgtgctgcacctcgcacacgcggaaggagtcgagcagccagaggatgtcgtcgag

SEQ ID NO: 21829 - DNA, 1954 bp, Oryza sativa
  unsure (1)..(1954): unsure at all n locations
ntggtggccgaatgcttgaaatcaaggtgaaattaataaagatgagctgaaaccgaatcaaacttggagtcggattgtgttacgaatcggagtcggagatcgggctactcccgcgctcgatcacgccgctacgtcaaggtgcggaacgccgtctcgtactgcgtgaggatggacgtccaggatttttgcttagatgctaggaagggaaaatagaagaattcaaaggatttgttggattcaaattttgaacttaactttgaaccagggtttcggaagaggggcttttgatggaatttttaaacaaggaggtattcaatgaatgatttcggaggggaaatttgaatagcaaaaattcaaatttcgagatttgaattcggatatggttttttgaatttagtactaaggaggaatctaattgagatatttggcgcttattccttaatgacacagagagaaccaactttttgtaattagggtttatgtaaaatatagtattttttaatgacttaaaaattggggtgttacatatatcaagaaattaaaaaaaagtaacaccccaattttcaagtcattaaaaaaagtatatctagtgcacagcccaatctatatttgtttttctccctttaatatgtacgttgattttaaagatgatttttttgaacgactcgcacgagacgatgtgaagttctattaatagagtaggaaaaaaaatacaagattataacccaggaaggtcgtaaccagaaaaaaaagaaaaaaatataccaccacccacacaccgacagcaccaacacacaggtccagaagaaggctagaaccagaccggccgtaactaagcgtaaccggacgccgctaggccaacaacggatcacagacgagatcacccaaaaaaacgcccttacaaccaacacaaagcccaactctatccacatcttccggatttagggagaaagagtgagagagaagatggaacacctctccccctaggccctccgacgtggccaacttgtagaaactaggacaccgtcataagaggatgagaatctagagcgtgcttgcaccaattgctcgagtggttttagcaaggggatgcctaaacgacgtctccaaggacagaagcgacggaaaaccgccgtcgccgtccatcaaggtctcaaaggagctaagactaggcttttgcccggcaaccacccttttgaagatgatttttggtcgagttagatgtcagtgtcactatactctacagccaatttttttaatcaaatttattttacaatcacttagtcgaatttgaatgaaaacgttatacaagtagtacaacccccttgagtatcggcaaaattagtagtagtagaatcaatttccaagtttgcaacagatcggaaaggtgttcgcgccgcgtcctcatgcccctcttgctggcgccgccgccgagcgccgcccgcccgctgatcgccccgaccgtgccccacctcgcgcgcacccttctcgccggcgcgccggagaccccgccgctcctcctcgcgatactccaggcctcgccgcctctcctcacgccgctcctctgccacctcctcctctcccactccccgccccttccggcgctctacctcttccgtcgncttcctcgccctcccgggcttccccgtgccggaggcctccctccccgccctcctccgcctgctcgcgcgctcccgccgacacgccgtactcttgatcaagctgctcgactccttcccgtccaacgaccaggacctcctatacactacggcgctcgctgtgctgctctacaccgcgcttttcgcgttcgacccgggcgcgttcttcgacgccgctgtcaccttgttttacttctccacgcgcgtgttgtctgcgcccccgacacaaatttagagtccgncaacataaacgggctgatccgngcagtctgcgccccgaggtcgacgtagacgag

SEQ ID NO: 21830 - DNA, 754 bp, Oryza sativa
  unsure (1)..(754): unsure at all n locations
gtggctttgaaattatanatctctnnnnnnnnnnnnnnnnnnnnnnnnnnnnnnnnnnnnnntatcctaattaatgtatgacactttttatgattataagaatcaagaaaagaattggcgggaacaaatacaacaactgtgcgcgggggacttgtgaacatggacagtgagaatcgaagatcatcatggagaagaagaggaagaagaagaagagagacacagagaagaattcaccaatttaccctctctaccacccaaatgtgagctatactgctctacgttattagttgaccttggtgcagactcgccggatctcggcgtcggagccggcggccgtcttgacgccgacgcggccgagcttggtgatggcggcgacgaaggcgtcgaagaaggcggtctggttggcggcgaagtagttgacggtggcgcgcgagcggcggtcggcgaagagcacctggtcggaggcgaggaggcccttgagctgctgcagcgtctggaagtagccattgtcgaacttgttgggcgagacggcgtcgagcatggcgacggtggtcgggctgtagctgagcgggcacgtctgcctcatctgccgcaggaacgccaggttcatcggcgggctgtactggcgcgccgnccctttgacttgtacagncgncgcacgaacttgtcgcagtgcgtcacccctatcgtgtgccttctgcaccacattcgtacgactgataagcntacangcagacgatgaaaacagatttac

SEQ ID NO: 21831 - DNA, 1133 bp, Oryza sativa
  unsure (1)..(1133): unsure at all n locations
atatgccccaagcttgattcccaatggaggtgggccatctccttctgccatcggctacaatgcccgaaagacctcagcacttctccgaggactcatcagagaaccagccgatgccggcgagaagcggagaaccagatcatcggctgcagatccttcagccccggctccgaagaagaaggctaagacaaagaaagctaagccagctgacgatctacccaccctagatccatccatcgaacaagctctggatgaagaagaaattgaggaagacatcgaccaagctgcagccgaaataagcgatactgaaaaaacaccatcggcttcacctaagcaggctcctccattcccttctgctccagctcaattggcaagggtaagcaactttctctgtccacttttgcagtcatctactttatagccgattcctcacaattttaataaatatagagaaagaaaattgtcgtgaggaagaaatcggttactccaacccctaaaccagctccaccagtaagatacttctatcatctcattaactgacttgggctgattatatctaacatttatccctttggcagcctcctcctcctccttcttcccctcttatgcaggcagaatcaggcggccgcactccatcggctgcaggcagtcatcatgttgaagaggaggaacaattagctgcacctactattttagtaagttttattaacataaacttgagatcggccaatcatatcttgatccttaatcatccatgatattgtctcttgcaggtcttagccgatctgttctcctttgacatcaaagattacctcgatgaaacagaagaagacaccaccagtaaagcaacagctctcctgtctgatgatgtgaagaaaacactcgaagacatctcccatcggctaggagaatcactagataacctggtgaccaactgtggctcgatccgggcaaggtttgcagatatccaagcctctcttccggacgaattagtcgatgctcttactccagctgcctacctcgagcagcatcaattcaaactggagaaagccaggcagaggttagccaatcgccgggaacgnnnnnnnnnnnnnnnnnnnnnnnnnnnnnnnnnnnnngagattatcaaaccacgg

SEQ ID NO: 21832 - DNA, 2838 bp, Oryza sativa
  unsure (1)..(2838): unsure at all n locations
gtggnngnnnttttganaacttatacatcnnnnnnnnnnnnnnnnnnnnnnnnnnnnnnnnnnnnnnnnnaaattctactacatttgtttttttatttaacgttggttagtttaaaatgaaacttttgaactaaccaatgtcatctaaataaaaatggagggagtaaaatttaatttttaagctgtggcagacaagccaatgatcagcacaatggcaagttgaattagccgcaagagcatttgttctgggcttctggccgaagttcacacacgcctatgatcagtagctctacgtaactgtaaagctgatttctgacgaagaaacggcccgtaataagagtgccacaagcccacaatgtacatatctgtagaacggccggtggcttgcattgcttcagtactccatgcggctttggcaagttagaatgagctgtgaattagtcaccgacataatctgctacttgcatatcactttaaccagactctccaattaattacaaagcacatggttactgtatatacagtagtactaagtgcagcttcagcttaaattaaccaaacagtttaagaccatcgaagcccagcacattctcaaccctcacgccaccctacactatatatacccatgtaaatgcgattgccaaacatcacgtcactttcacagatcatcatcctgatcaatcgaaacagaaactgtatctagctagctgcctatcttgatcgccagccaagcttttggaagactcacgcaacagctagctagctagcacgaagcagatagagtcgtcactgagcaagcaagcaagaagagtgatcgatcgatcgatcaatggcggcgagccttgctgggttggcattcctcgccgtcacgtcggccgcgctgctgtcgccgctcgccgtggttggccagctgaggacggactactactccaccatctgccccaacctggagaccatcgtccggagctccgtcaagcagtccatggccgcgtcaccgatctccgcgccggcgacgctcaggctcttcttccacgactgcgccgtcagggtacatctagagattgcaacagataatgatcgatcgaccgccatagatcgatgcaagcaatgtggtgatcagaatatcagatcagtagaagtaagcagtgatcactgcagtgtgtgatttcgattgcagggttgtgacgcgtcgatcatgatcgtgaactcgaacggcgacgacgagtggcggaactcagacaaccagtcgctgaagccggaggggttcacgacggtgctcaacgccaaggccgccgtcgacagcgatccacagtgccgctacaaggtgtcctgcgccgacatattggcgctcgccgcaagagaatccgtctaccaggttagcatagcaagaaattttacagcacttcgagataccaaaattttcagtttaaatttaagtgattttatagtttttaaggagataccatgttttctattttctactgtttttttagatgaaggcattacgcccagctttcactaaaaagcataagagttcatacattgaaaaaagaggaaaagcagtaaaaactagggaaactgttttaagcactcgggtggatgtccacccgtttcttgcatgtcatctaaatagttatggaaatttttttataaaattaacatgataggttaatatgtaatatatcatttcacaatactaagatatacggaaatttgcactaaaattttgttatcttttagtacttttaagaactgtagaatatatttgcaaattttcatatatcttataatattgaagatattgggagatactccctccatactcataaaggaagtcgtttaggacagcaacacggtctccaaaacataattttgactttttatttctataaaaatatttattgaaaagtgatatatgtatacttttatgaaagtatttttcaagacaaatctatacgtataatttttacattttgaaactcaacaacttaagagttattcatgatttatatttttagggtttgacttaaatattgtcctaaacgactttctttatgagtatggagggaacgactttctttatgagtattaagggagtaccaaattttacattaaaaaatattatacctccggacggtaaactcactttagcatagcagattaaatttgcacacatgggcatgcatgcatgatgggtaaaaaaattgatcgtgagatcgcgcgttcaacgctgtaactaatcctgcatggatgcatgcattggctggttggtgcagagcggagggcccaactaccaggtggagctggggagatacgacggcagggtgtcaaccagagacagcgtagtgctgccgcatgccaacttcaacctggaccagctcaacgctttcttcgccggcctcggcctctcccagactgacatgatcgctctctcaggtactccaaaaatgtctaatcaactcaactcatcgtcgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21833 - DNA, 1084 bp, Oryza sativa
  unsure (1)..(1084): unsure at all n locations
nggacaagccgttgcacgcagaccagcggtcgcgcggcaccgtcgattactacgcgtggagcaagagcgcttcttcggcgggcttcgccgcngccatgacaaggctcggnaaggtcggcgtcaagacgncggccaccggcggcgagatacgccgcgactgcagattcccgaattgatcggctaactcgcaccgtacgtgcgtgcacggtgcactactacttgtacatgcaaacattcaatcttgctcggttcatggacttcttactacagtacttagttgacgatgaacacgacgactgtcactgtaataattaatctcgatcaattcaataattcatacgtaatagatgtccgtaactgattttttagataatggaatataatcccggcttttgattaaagagctacagccaattattacaccaatttaacaaaacacacgtctaaagaaatagaagcacacacaacctactaaaaactcccacatcataacaagatcacactgctatacaaaccgtctttaaccccgatatgcaactccttcagtcccgggtagcatactgagattacgaatcaaaaaattattgaattccatttgtaaatctcatctaagtatatggcgtaggtgttttctttttcctttgtttcaatctcgatccatgactttatacagtacacgttgataaactagatagattaatttactcctagcgataaatttgatttgaccttagaaactacaggcccattaatagcaaagaagcccatgggctagtacagaaagtggattctaaattgtcgaggaacgttctctcgttgtttgcatatactccatccgtttcaaaatgtttgacactattgactttttagcacatgtttgaccgttcgttttattaaaaaaaatttgtgaaatatgtaaaactatatgtgtacatggaagtatatttaacaataaatcaaatgatatgaaaagaataaataattacttaaattttttgaataagacgaatgatcaaacacatactaaaaaattaacggtgtcaaacattttaaagggtaccgagctggagtatctaangcgcct

SEQ ID NO: 21834 - DNA, 2629 bp, Oryza sativa
  unsure (1)..(2629): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgttggtttttccttttgaagaatcttgacttgaaataggtcactcgtgctcaatcctgccctcgggggctcgggtcggctaaaatcgccaaacggggcccagaaccgagccgtgccccgaggcgtggtgaactcccagggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggataagtcgctttcgcccgtggccgccccgccgctgcgcgccctcgcgtccagctnnnnnnnnnnnnnnnnnnnnnnnnnnnnnnnnnnnnnnnnagtgattgtcaatcaatttctct

SEQ ID NO: 21835 - DNA, 1147 bp, Oryza sativa
  unsure (1)..(1147): unsure at all n locations
agacagtttgccgacaatttgttgngcagggcctcggcccctttaaaggctggcttccgttccgttaagcgggtcctcccgaagcggaagcgtgaactctttttggcgcaagaagcctcgtgcgccaccagcgttgcttcccgaatggtgacgccgccctcgcggtccgccagatccctctccacgacgcaggcgcgcttttcaagcgccatggcgcgcgcctcaagggcctcttcgcgccgccggaacaccgtttcggtctccgccgccccgctgttctcgggcagcggcagcgtcaagcaccccttgggcggcgtcgagctttttccctagctccgcctcccagctcccgtattaaggcggagggtgtcctgcgcctcgttcatcatggtggtggcaatgagggcagccccccgctcctcttccacttcattggcgatctccgccagcaccttcttacgagtttcaagctccgagacgtgccggcggtgagccttagggcccacctccaccatggcctccaccgagcgtcgccccttttcgacacgcgcccacgcggcgtcgagctccgcccgctctgcctgcaggacctccacctgggcacttaacccatccaacaccgtggtgtttgcggcggccaaggcctgcagaaggggctttgcgttcagtagggcgatagaaggcgtggggaagagccgccttggagaggatgccacgcggctcgggccgccgatggaagtgccggactcggggatgtccccctgacccggttggtcctgagcgtcgcccgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcagcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaannnnnnnnnnnnnnnnnnnnnnnnnnnnnnnnnnnnnnnnngttctatcaggtntccaatngnccatg

SEQ ID NO: 21836 - DNA, 1139 bp, Oryza sativa
  unsure (1)..(1139): unsure at all n locations
gtggnccannnttttgtannaccttggtnnttttatataacccnnnnnnnnnnnnnnnnnnnnnnnnnnnnnnnnnnnnnnnctgggagtataaggagaacgaggtaattgagggtgcaagatatgctcataaggatgagatgaaggaggcggggaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacttgttctatgcatagatggaacttttatgacaggtaaataccgaggtcagatattgacagcaattaggtgtgatgggaacaaccaggttctacctatggcttttgcatttgtagagagtgagaacactgaaagctggtactggttcctagagagagtgcacaatgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagannnnnnnnnnnnnnnnnnnnnnnnnnnnnnnngagatgacgaatttcaattcacac

SEQ ID NO: 21837 - DNA, 5322 bp, Oryza sativa
ttagggaggtttaccctgttcctggtcgacaccctgccgtcgaacctggcgagctccaccgcgtagtccggtcctccactctgcatcatgcagccaacccatcaatggccattcgtgcgtgttcgaatataaactaaattgccagttttctcttatgagctaaaacatttgagttaaactggtcggtgcatgcaactcgatacagataagtgagtgtgagttaccaggaagacggagtctctagtggcgagggccaagatgtcggcgcaggacaccctgttccggcattgggggtcgctgtcgacgccggccttgggggctatcaccgtcgtgaacccctccggcttcagcgtctggtcgtcggggttcctccactcgtcgtcgccgttcgggttgatgatcatgaccgacgcgtcgcacccgcggacggcgcagtcgtggaagaagagcctcagcgtcgccggcgccgcgatcggcgactgctgcatcgacctctgcacggacccgcgcacgatgttctcgaggttcgggcagatgctggcgtagtagttctgcttcagctgcgccaccgccaatggcgacgagatcgcccccgccagcgcgaggacgacgacgaaatggaagctcctcatcctgtcgatgtttttctcttcactacttgagcttaaacaagcttgaaatgtaataaattgtgtttgagctcgaggtggttttgcaagcgatgggtgagtggcgtttatatagaagagtaagggcgtgtgtcgtcctcgctctgagagcttctgatccatttgtttaattagggttttgcctcgttgtgagtagactcagaaggtgataatgcaaatgatcatttgtttaactgaggtttaactggtcaatctgcaactggtagttaatggccatgattaatcacgcacagctaagctcaaaacctgatttcgagatgggcaaaactgtgggtcctggctttctgctctattatatatactctctgcatttctgcatatactaatccagctctgatcagatgaacattcctacagatcttaatctcttttgtttttttgtgaatcaacattcctacggatctgaatgtctctgatgaactgagatccgggtatgatacacttcttcggtgtacaaacattattttttttgtaggattcttttttttttttggaaatttttttgtgagatctgtccctctgaatattgatcatactactactgtaattccgtaacaaaaacaaaatgatgatattttgtttctctcaactttggatcgatggaacagcatttctgaattccacccttaaaacaaacatttataaattcatctgttctgcattccagaaagcagcttccattatattgtaccttcacaaaagaaattgaagtagcttccgttgaagaatatagccatgcatgattgactagcacagagtttgaaaacccattgcatactcgttctgtaacgtgtacctccatgatttgctttggtgacgaggggcttataagtgcagtttttttttttttttgaaaactataagttcaatcgcaatctgtgggtagacctgacctggtacatatcgccacacgcaggtgtcaacattaagacgaacacatcacaaaatgggtgcaaaactgtgagctgcaggacgtcacactgggcactgaactcgtccataatatattttttttacttttactggaaacttttaaggtgcactcaagttaatttgagccgttcatctttgatcggacggtttctaatgaatgtgacgcgatgcatttgttcgttggatttaaggacatgcacacacggaagttcggtagagcgtattattttttttaagggaagggtattttttacccagtctctatgttcaatcatagtgtattttttttaaagagaagattattttttacccagtctctatattcaatcggatatatgcaaccattttaatttagaaacctagcctatcaaacatgaaacttagcttttaaataatccaatctgaaattcgctcttatgtagatttgaactcaggaccttaatgtgttatttaggtcactgcaactattaggctacatgccctttcactggtatagtgtatattttgtagagtagcctatgttcatgagtttcttttgttaggaaagctgtatgtacatttgtttttcttacaaaacgtttacaaacgatgatgtcgtacaccgtacactactaatgggtcttgattttctatgactcccaacaaactacatcaaacggttgataagtttctttgtgacaagaatttctattaagtacttgtggcaatgctctttattattatttcgactttggagttaatattaagagctagatcacctagtgtatatactagtgttaatttttgctacaacttggcacttattcctcttgtacatcacggtgaatggtaggtgacagttgagttaatacattgcaaataccaatctttaaaagtaaagtacagaaaatttgccaatcaattaagagaagaataattaatggtacagtactggtcacactcgcgggcaagtacagtaaaaccccccaagttcgagtgtttagatttggtcatagatccaggttcgttatgaacttgcgctttcgatcatgaccctgctgtcctgcatgctactactactagtatagtggtatttcttccttcataacctccgtatcaaatgtgatggaatgtcaatgaaatgctagctaaaccaaggccttgtttggaagattagcctaggactaatgttgagagctaatgttaagtcatgaattggtaggctaaacataagcttagggtggtatgtttgaatccatgggctaattcaaggctaaaaggtggagagagagtagaaaaagaggagagagaaggagagagagagagagagctgttttttgatagtcctcacacaaaattagcctcattagcacctcttggaggggctaatgttttgaggggggctaattcacattagctcaaaattagcccacctgtttggattcttgagggctaatttgaggctaaaaggtgagggctaaacattagcccatggaaccaaacagggcccagagcagaactacggctgtgtttgcaacctcttgttcccaacccactctctctctcattttctgcgcgcacgtttttcaaactgctaaacagtatgttttttttacaaaaagtttctatacgaaagttgcttaaaaaatcaaattgatccatttttttaaaaaatagctaatacttaattaatcacgtgctaatggactgctccattttccgtacggagagaaaaagtttccatctgagacatgtgaacacagcggtacattattttcttcaactctaaactacaacaccctcgttttttcgtaaatacgcgcgcgtgtgtttttctaaatctttttatacaaaagtttctttaaaaattacttgaaaatatttttaaaatctgtaataattattacttaattaattatacgccaatgaattatatcgttttatgtatcaccaaaaagctaaattgaattgcagtttcaaacgggcctaaggcaattgggctggaaagtctctcgctttgcatgcactgtttacaaactattaaatagtgcgtttgaaaaaataatctataggtctataggaatgattcttattaatccacttttcaagtgtgtgataattaatatttgattaattatgtgctaatggctcatctcattttgtatatcttttcaatttgtctttttctcttctcaccaacacacccaaagtcgttgtaccgctgtcccgagctatgcagagcaagtattttagccagaagacttcattaataagtgagtcacccccattcttgctaatcgtgctcctgttcatctcatatgggacaaactcattaattctttgggatgcaaatggtgtgcatcttaattaatactttactcttttcctctgcgaggattattactttattcttcgccattctactaaccatcctagcttgtcccttaaaaaactcctaccctttcttataaaaattctcctatagctagtcttcgttttaacaaagtgcatgtaacctgcatctagaaacaggtgcgttaaaaactaagataatgccgcatctatgtcaggtcaactctgccatttgttgcaacacaaattttgcaagtgctcacttgcaatataataagctaacgtctacgtgcatacgcacgcgagcatggacattggctaagtgccaggccaacacggggaaaattcccacacgcagtgacgtgatttttcggcgagggatcgatcgatctgtttgatatctgacgccttcaccatcctatttgtgcatgtgcggcggtgtctcggcgaagaaacacggttcagatgatctcgttttctataaattataaggaaacgaaacgcttgcttcagctgtgtgacaaactactgacgaaatggtcaagggttcactgagaaaacaaggtagctagctagctatgctgagttactaggaataaattataattcctcgacgggaatatccctcgtacatattttctcaatcaaattcaatgaaaatagttaagaaaaaatttagaaaaaattacatgtatcactccacaaaagtcaggttcaaattatcttgatttacacaatgagaaaagaaaaaaaaagaagataaacctaggtttgaatagtattgttcaatgatggatttatctttttttatttcttgacatgtgagttcagtttataatcgatattttgtggattgatatgtgtatattgtatggaggttgtcaatttttttgagactttatataacttttgaacacacgagagattaaaattattaaattaaggtacaattttcccagcgttaccaaatatttgtaccagtgtgtgcgcacgtctgataggatggtgatgaaatgatggtgaaattcacgtacaccatgttgccaattttgcatggttttatatgcagatgcaacatgcgaggaaacatggcattggttgctgcatgtttccccctagttacagaaccaattacatctaagatgtgtgcaaccaggccatatgcatgcctattttgaccaaagttattttccaaggctatgtgatctagatctatgaaaatgccactagctaagtaaatttgttattaaaaaaataaaagtattgagaagaactttttttttctgatatcaatctcccctatagcacatcaattatctgccgtatgtagccgtgcgatccaaaagatcgttcttgctttaaattcacc

SEQ ID NO: 21838 - DNA, 752 bp, Oryza sativa
  unsure (1)..(752): unsure at all n locations
ncgacctagntnnnnnttaccccnnntnnntcgntnnnnnnangnnanngnnnngttaaggaaacggtcgggcgtgacgccactcctaagtcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgcttcgtctgaagatatggtaacgtcgcttcggtcggcgagcgtaattaacgcgcgcacgatatgatctatctcgactgccacaaccgcatacccacctcatgcgccgcaagcgggctaatgggattagtggaagcgtgggcgcgagaaacgagggggcgaaatagcgggcgccagaagcgaggagccgcgcacagcgttggcaagagtataaaggcacagaggaagggatctgtttccttcctttcgccattattccccttgtcttcgccgcttgcaccctaactccttctttcctgtgccctaccttcgacacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctggcgcgagggacccctcgccccagat

SEQ ID NO: 21839 - DNA, 749 bp, Oryza sativa
gatgtcccttttgaattgcatatctcgctcggtacccattattccagcccaatccggatttatttggttttctttgtcagcactaaaaaatcagtatccgggattttagtgtgttttccttgtcaatccgacagtcggagtcctgaatatcggtatctacgagtaggactagcacaacaatggtttgaaacctaaaaggggccactgggaatgagttcaactaacctgctagatagacgcgtatatcaccgtatcaacacctgattgaacgagcatcactttttcactgcgtgtacattgaattttgagttgaaactttgcaaaataaagtggagcatgttaccatgttatacatcgcaaatttttatcacaatctttcatgtttatttgacggcaacttgaacccctaaaattgttctccagtatagttcgtacatatgaggctattactagttcactaatgtggcccatgatgactcggccggttagactaggtcaatgagccacgccagcaaaaactaactaaactgcctttaaactacgagggaattattttaaatcggttataatagttgggagccaatatatttgagattggaccaaccagtgagggagtcaaaatgaacttattcttactcttaagtacgagtattttggtaggaccatgggctgtatgggcttttggctcgtccgaaaccagctcgccggcccatctcggcccatgaaatcttccccttcggctcagtctg

SEQ ID NO: 21840 - DNA, 1798 bp, Oryza sativa
  unsure (1)..(1798): unsure at all n locations
gacgctcaagatgggcatcgagacgcgcctccgcgacaagatccccgagatcctcgccgtcgagcagatcgtcgacaccgagaccggcctcgagctcaaccacgacaacgtcgacaaggtcactgaaatgctccagtaatcctgcatttccaaagttcattagacagcaagttcatgttccaatttcagttcagacaaattcagtagcttactcctgtgaactatcacactgtaattctgaaggttttttttttgggtgttgcaggtgctggatgagatcagaccatacctttccggcaccggaggtggaagccttgatcttgttcagattgatgaatccgtcgtcaaagttcggttaactggacctgcagcgggtgtaatgacagtacgtgtagctgtaacacaaaaactgagggaaaagataccatccatcctggctgttcagttgacagagtagaaacatgagttcagttatgcagcaactcaagagaaaacaaaactttgattttcagtgattttgtggtattcagtctcagtcttgtggttttgaatcaaaactgaagtactgaacgtctgaacctatcataccatctttaaatgcaagtgttctgactaggaaaaaccaaaataaatcagaagtctcttgtctgtaagatataatccaacaaaacattcagcatctattaattcaatgaagagaacaacaacccattttacatcaggttatcagagaattgtcagacttccagtgcatttccttggcaatgaggcacaccagggtcttcctgaacccactgttccactatttccgccttcagcttcactaggaatagctgctagtgatctcatggggtaaattatcggcaggaatagtcatgcattagacattagtgcatgacaagtactgttaattcgagttacttttcgatattcggttccagtcgtatacaccgaagtactgagatgatcagtaccaatctttatgcagaagaattctaaccaaaaaaaaaaaggaaaagaaaaaagaccacagcactttgtatgtcagaaagataaataattcaataaaactttaaaccaatgttacttcattgaatagatatgcgttttacatctgtgtatcatagaattgtcggattttcagtgcatttccttggcaagggcaaatgttctgataaaactagaaacatcagcctcttcagtggaacctggcaccacaaaattcctattagggtagtaccaaagctcttcataatttcaaggttagccatatctatgcttctcaaattgaccacaggccaactccttatccccattgttttccttgctgatacgagtttagtcattgcaatatttcaccctttaaaggccttgacatcacagttcatcaaacaattgtattggccttattaagaaattgaggcttgcggtttttatgcaatcaaatttcacaggaaacaattaaaaatgtttccttaaaaataaccaatcatggcttcaggcagcctcttcatcacattgatgttcatccaattgggctgccttcatcatttgcctaatctcctcaagcttttcgaattcccgcttccgcttcaaaaacccttccaaaaccctaaaagctcgttctgtaggagtcatccccatctcaatcatctccctaaaacacctgtatgcttccaaaaccacacctctgcagcataaaccagtgaccagaacatccaatgcatgccggtgaggcacannnnnnnnnnnnnnnnnnnnnnnnnnnnnnnnnnnnatcagatntacatnncacacg

SEQ ID NO: 21841 - DNA, 1516 bp, Oryza sativa
  unsure (1)..(1516): unsure at all n locations
ntatatcctcgaacctgaaatcggctggcagttcgaaatccattgagtcggcatagaagaaccaaactcgggcatttttttggaatccgtcataaaagctgaagaaccagtccttcagaagttcagccgataattttgctcctgcatcagctggtgtagatgcatactctccgtatgacatacatctgcgatgggtgcgttcttctccatcatcttctacaatcggctccaaccttggaaattcagcttctgtcacagatggccgattgaaaaccttcatgactaccaggttcagccaggattgaaagagccaccatgatccacctgttccaaccactgagccgataattattttggccgatgcgctgtttaacatctggtatagatagccgagaaggattttgcctaagggaaattgtttcttcgttactagggcctcggctaagaaccgccagttggttgtaggaccgcagcttgatccgcagaaaaggaatttttccaaccacatcagcaaaaaagctacgtgttctttaggagtgactggccctttgcccatatatgctgtgatatatcctgaccaacccccaatgctcttagttttgaactcaaaagtgttcttggtgtttaggctcatggggttagccgatgaggttacatctaggccagtgagcatgataatatccagcagcgttggggtcatcggcccttgattgaaaagaaaggcattgagagtgtcggaccagaaataagttgcagccgccaacaggggttcatctttggccgaatttgctactgtgagggctagggcttggctgattccgatctcatcccaatgggcctgcttgctagccgatatccgcttataccatacaggccagcttttctccagagaaggccaggatttgaaggtgtttttccaatggcttgtgtttggattggccgacctaaaaggagttctattggtttcggctatgataaattcagtagggtctagattgccgattggaccgagaaagtattgttggtcatgcaacagactgggaactgcaacaagattggaaagatgctacaagaatagagaaggagaaaacgggataaggcgagcgaaaaccgatctgatgaacggaaaagggatctagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21842 - DNA, 3839 bp, Oryza sativa
  unsure (1)..(3839): unsure at all n locations
gccgtgnntttgaatgcaatcggctcgacccgattatccgggtactccctctggcccaaaaaaagtcaaaccctagatttccgtgccaacgttttactgtccggcttatataattttttttataattagcatttttattattggtagataataaaaaatgattaatactttatgcgtgacttatctttttaattttttttatattttttttaaatagaacagacggtcaaacgttggacacggaaatcagggtttgtttttttttgggacggagggagtacactgttagctctggcagccagttggggcgcctgaatgacggtactgttaagaatggaaggtatcacatcaatggagctgacaagagctagcgtgccattcatctgccgacgctgttcttgtacccaaaacggcactgtttaattcagccttttcgtcggcttgctccgattcagtagctcatacaataatgtagggatttccggtgtattgggaaacatccttcaatagttcaatttcactgttttaatccattttctaaaaaaaaagggttcaatttcacagcatgacgtcttctatatcgaaaatgttgttccgtatactctctgtgagtctgtgtgcaaggtacgggcaaaagccgcatgtctatgctccttataagcttattgtgttatttttccggcccaaagcatcgagcccaaaatagataacagggccatattctgggtattctgccggcccacatgaattctttttattgaaaccaaaaggaataagttcactttaggtcccttaatttgtcgcccagttcgattttcgtcctcagtccacaaaaccggatacaacgcatcccccaacttaccaaaaccgtgcagacgagatccctcggcagtattgtgcccggttttggatgacgtggcgcctacgtagctggtttgactaagtctccgtcctacgtggcattggcgtggcgcttacgtggcaattgatcccaaaaataatagaaaactgtaggacccacgtgtcaattacacataaaataataaaaaaggtggggccatgttgcggcggtcgcctccagtagctggctgggcgcgaagcgagttgcggcggcgttcccaccgcagctcctcggccttccgcggctgctgcggcgtcggcgacaaggaggaggaggcaacccgtcagttagtagcacaccccgagagttcaatctaagcggccgtggcatggagaagggcacattgatgcagcacacattaccttggagtggcgatagggcacgccggaggaggaagcggggccggaggtggaggaggaggagacgtggagcgcgacgacgagcagcgttgcatcggcggtgatggtggcgcctatcgcggcgagcgagagcagccaccaccgcaccgtcgcccaccgccccgttgcagcggcgcccctcacctttcgccgcagtggcaatggcgtcgcatccgccctgtcatggctaccacacgggaggtaggaaggtcgatccaggcacgggggtcgctccgtgtctcaccgatggggatcgatcctcgccggcctcgtcgtcacggctgtctacgccatctccaccgtgtgatctcgctccggcttgacgatgacgaccccggcaagcctatcactgtcacgcggtgccgcacagtagtaggaggacgatgcccacgaccagcttcgtctccaagtctgaatttttctcctttccttttcttcaactgaagaaactgttgatgtttgattaatctgcagcttgaatggagaatgcatgcgtgcataggccgggtatttgtagccattgattcgggcaatttcgcttggaagcaaaggctccgaaagtgagaacattgagtgtttgacgaatcatgcgaggaggaatgggaagatgcggtgcatgaaaacccccttcttcgccaacggcgcctttggcggtgacgcggggtcgggctttcaggcggcggccatcgcggcgggtgcggacgggaaggtcgcggtcgacgggcggcggcgaggcgactgcttctgcgagcctaaaatctcccccccaaccacgccgctggtctcctccaagaagatgttcggacccgccggcgcgccgaccacccccgccaccccggcccccgccgcggcgctgttaacgaccaaatttggtaaattctatcactattggcatcggagatgaagatcagatcgaagtggaatccaagatgaagatcgttgcggagacagagtaaaaatcggctgcagtctaaatcggctaaggtcgggatcgacagagttcgagttggacggggctagccgatacagccgattccgataatatgacccggtgaacgtcatcgggttcaagttgatgtgcttcaaggtgattgccatgcttggatagagtcctgggaaggcaattatatttattaattaggatattctatgtaatttccttagagatatgtttgggcaaaagtctgccgtaaagacttatgatatcttagagtttgttagagataatagtcgtgtccgttatggacgtatcttgtaattctcgggtataaatagacccgagccctatgtaaaaaagagacaacacatccaatacaatctcggcgcatcgccacccttttttgctttacttttatttcaacgagtttgtgctctcgggttgagctgcatcggtttcgatcttcaacaagaggtaaaacttgtcgtgacgacttatgttctcaggattagtgcttccatctttatgacactctaatcttgtatatataattcgtcgagttatcatatatctcacatagtcttcgataatatctttatctaacctataatcggctaacatctgctaatggaaggcagccgattaggttagacaatgacgttaacttagattatgtgatatatctaccactctatgaaacttccagcggcttgattgtctagatattgttcttcttttcatacttaatgctgcatcagttgagtttgatctattaagtcgtgcttagaattgcaatctttagcctgctttctggttgccgataagggtagtatcggagtttcagccgatcttacctgatttaactacttttattctatatgcttgattgacacgttaaatctgccctttatgttaagattttattgcatctaagtatattaagcttatgtttggtatattctacttgctttaatatcttagtatagagtggtatcggagtattagccgatacatgctagatctacctgatcagctatgttatgaatgtatataatcctactattaatatatatttcgatctaagtgatttatactatctcggcaaggtgaccgatatatcccaatcacttgatttaagtatataccgatataaggattatatatcattaatgtatacagttgatcgagtagatttagttctgaattgcttattgatatttgccgatcgatgtacgcatgacatcggcttgaaataaatgatatgtcatcggcatctagtcgatcggctatcatttataggattaattgcggtttctttgttctatctcttgttgattgcaggatcaaatcaactggcacgctcatacatctgaaggcgagctttggacctgcactggagttaagcagatctcccaggcctcgtgttttctgtcaacacacttttggcacgcccggtgggacccattaggagtcagaaattaatcttcctcatggccgagaagctgccaccgtcgccatcctcggctagcccaggtactgttannnnnnnnnnnnnnnnnnnnnnnnnnnnnnnnnnnnnnnnngatgtncatcaatgcccacg

SEQ ID NO: 21843 - DNA, 2176 bp, Oryza sativa
  unsure (1)..(2176): unsure at all n locations
tggaanaatttgaatatcctccctnnnnnnnnnnnnnnnnnnnnnnnnnnnnnnnnnnnaacaagagaacagttcttcaagtcattcacacagactcgcaaggcaacattgttcaaaagtacaaggtaaaggtggttcccgatgagcctgagaccagtacctctaaggagagagaagaaaaaagagttttagatggctcagctcaagagaatcagggtgacggctctcagggggtacatgcagttcaaggtgatggtgctcatgagccacaaagaggaaatcttaatcagaatggtgagacaacacaagattttttcaacaatttccaagatcgagtggactacgccgtacacaatgctctgatcaatcaatctagagtgttagtcaacaccttgtctaacatgatgaagacgatagccgatggatcaatagtcgagcatcaagctgcaggcccggtctacttgcagggaggtgttttcccgaattatcaacctctgatcactgatgttcagccgcctactcaagcagttctttcgagtgcaccatcggctcagccgatggcaccgccattgacttctttgcctgctccatcagcgtcgacactaggccagccgaataatcctcggctattgatgagggagcagccacagcatagcgggcagacggtaaatcggccaacacaggatcaggtgactgctatgtttctacccctccaatctactgtcaattcgattcagcaggcgccgccaaggcaacaggttgtgcagccgattcaacagactccaccaaggcagcaggttgtgcagccagttcagccaacacctccagaacaacaaactgtacagccgattctgcagcaggctttgatgaatcaatcggctgggcaatcggctgggcacgtcctgaatcaggttgttccagaacatttggttcaccatatacagccagatggtacggtgatgcctcagattatgccggagcatttggtgcaaagtatgccggaacatttggtgtaaagtattcagccaaattaccagaattgccaagggggcaatataaattatcaatatcagcctccttcccctcaagttcagtatcagcagggagggctaacccaacctcagtttgcttctcaatataatcagtttgaaccaatacagcaacagtcgcaaggagtagctcaacaacgaccatgggccgatgtaattgccgatgtaatgagagaacaatttgggcttaagccgagagatactggaaaattgtatcggcaaccttaccctgagtggtttgagaaagtccctcttcccaaccgatttaaaatcccagacttctccaaattttcgggacaagatggtgtgtcaacttataaacacattagccgatttttagctcagtgcggcgaagcatcggctgtagacgctctcagagttagattatttcagttgtccttgtctggattggcttttacatggttttcttctttgccgtatggatcagtcaatagttgggccgatttggagaagcagtttcatagctatttctacagtggagttcatgagatgaaattatccgacttgacggcaattaagcaaaggcatgatgaacctgttcatgagtatattcagaggttcagggagatgaggaacaagtgctttagcttaagtttgactgatgcccagttagccgatttggcttttcaaggcatgattcctctgattagggagaaattctcatctgaagattttgatagcctgtcgcatctcgtgcagaaggtaacattgcatgaacaaaggtttgcagaggccaggagaagctctaagagggttaatcatgtctgcccttacgtgtatggatcggatgatgacgacgatgactccgaaatagctgcagccgaatgggtaaggagtaaaaaggttataccttgtcagtgggtaaagaattctggaaaagaggagaaatatgattttgatattaccaaagctgacaagatttttgatctgctactccgggagaagcaaattcaactccccgctggtcatgtaattccatcggccaaggaactaggcaaaaggaggtattgcaaatggcataattctggatctcattctactaatgattgcannnnnnnnnnnnnnnnnnnnnnnnnnnnnnnnnnnnatagtatctcattgccgct

SEQ ID NO: 21844 - DNA, 1502 bp, Oryza sativa
  unsure (1)..(1502): unsure at all n locations
agggccnattganaancctgatatgcgagctcgnaccctacccggaaaccacgcacgccaccgttgtattgtcgtacagcttcaactccaggtctccaagactccaagtcgccaatcagcgtgcgtacgtttgacctaatcttcgagctggcactgcatcgcaaggctgattcttcagcgagcgagcgagcgggacgtacgacgcgcgagccacccgtaccgaacggcgagtgccccgtcaattctcaattctgcccgcatgccccaccgccacatacgctgtattcggctattcccccacgcgtcgcgtgtgcgcgcgcgctgcgtagcagccgcctgcctctgcgtggagtggacgcggccgcggccggtgggcgcgcgcgcctaacgctacacaccgcctctgaattcctcgtgcgaacacacggttcccccccccccccccccccacacgattcgcgtacgtgcgtgcgtgaataaacagtcgttggctcgtgcatgcatgatatgcacggggaaataatgggaaagcttgtgactcaagaattaacaatctggcttgtgtgtgaaccattctgcattctgcaatgtcatttacacgttcgagagctcacacctggctgtctgccatcaacagaaaatgcggcaatcatttgatgaaaccggacgcattgatcgatctgcagctaagctaccagctgcattgaattatataaagcttcactttcaaaataaaagcatttttttgggttagcaccaagctcaatcagctcccaaggcccatctgccattgagccaagagaaacagtactccctccgtactcgtaaaggaaatcgttttggacaacgacaaggtctccaaaacacaactttgacttcttatttctataaaaatatttattaaaaagtgatatatgtatacttttatgaaaatatttttcaagacaaatctattcatataatttttatattttcaaactcaacaacttaagagttatttataatttatattcctaatgtttgacttaaactttgttctaaacgactttctttacaagtacggggggagtagttagtgatcgatcgatcggttgggccaaattttaatgcatttgttagtctaaaagctgccaatatctaattgggcttatgctaacggacgacaagtaatgacatactcatcactcatcatcacgccaatccggtgatataatatttggatgaacggcatctgaacagacctccaaccgtaccattttcttttggcattgatcaacgaacttttttctgttaaaacctaaacatggttggataaagaaggttgaaaattctatggaatttcttgcaaattgggactcaagttgtgttgtggaggttccacaaaacttttcatggcagtgaaagaaagctggggtccaaatgctaaagctgggtggttcaattgttgcccttgagaagccattctttgcgaaggggagaaaaagaagtaagcactttatgct

SEQ ID NO: 21845 - DNA, 4023 bp, Oryza sativa
  unsure (1)..(4023): unsure at all n locations
gaggcncttgntttgcanatgtataacctccatnnnnnnnnnnnnnnnnnnnnnnnnnnnnnnnnnnncttctctgaatcctatacaaaacagttttggcattatgatgtaccacttgttctggccggccattagctctctactttatcgtcaattttggcttaacaaagaagatcacacgcgtaccacaggtagcaatggatctttctgtttggcaactattacaaagcgggtgcactttgcttactcctgtttctttactttgcctgttattttttgggaaggagagagcacgcctgaattgctgatttggcccaacatttgtccctgactgccactaatttgcatgatctacctaccccatatttggtttcatttttatgtcgtctcatttacagctctcataccaactcacaaatgccttgatcaacttgactcctgttcctgttgatgtcatctcattgccttcgctgctgatttgctttgaactagaagaatatgtgttaggcagtcattccaacagttgaaaagttcaaatcgagatgttgccaatatttaagaaccggtttgcagtttgcagttggtacttcgtagtactaatttttttctgtttcagagtcagaaaaatggaagaaaaaaggagagaaaagagttaagtactctacatcaccagatcagcagttgtccatcaattgagcacacacccctgaagttgaaaattccaagtgagaaagaaaccagcattggtaccatatgaaacactattatttattctgacaagcatagtttaccatgcatggacaaatagattcttaaggaaacattaagggggagattaggatctgtgcaacagtgcaagttatctgtttcacttgagagagaagtagcaactcatctcgtgttaactcctacctaattgcctttccacccaagattaacaggagatatatcccattccctgcatctccaatgaacagtacgatggattagacacaatcaactactactcggaattacacaaatgttcctgaacaagagtagtagtattatatttcacaccctcgcttagtacccatttcttgtggtttaaaagtcactgtagttcaactgctactccccataggattgcttatgttatgtaaaaagagaccatactatgtttaagtgagaaagctgtaagctaagtcgggttacattgctaattcttatttcactggccttaatatataataatctagcattagataaaacacgaaaatctattcaaattcatcgtactaaaatatgtacggatgtgtcctatttagttctagctctaagctatatctaaattattttatgacggagaaagtactaatataaggtgagttctaaatggtagacatccttttcttgctatctctctcaacaatttcttaaggaccaatacattctctgctcgaaattgattcttggataatgatggaccgacatgcaaggccctccaaaacagcgaaaatgacggataaatatgaaagctaaaaccaaattggctctaaaaaattatctcactttcccctctaatcctgctgggattaggagtttggaaggattaaaaaaaaatgcagaaagctccttctagctcctgctgctttgttgtcttcagatggaaacccgcggcgtgagaaagcggcagctgcgccgaaccttccacggcggcggggggcgtttaacacgtggcgccgacgtggacgagtcccacgccgcgcacgaatctcgacgcggcgccaacggccggatctgccttcgtgggggtggacacgtgcgggggatcagcgcgccacgtgtgaagacggggctccgttacgtggtaaacgggtcgggtcacggtgggtagggacccgttaacggcacggaggctgaaataaatcacttgggatctgaccaaatcgtcgtctccatttccgcctcgcgaggaagaagagagagagagagggcaaaggtcgtcgccgccgccgccgccgccttcgccgccgtttggtctcgtcgccttccggaccacccgcactagcccttctccctcctcgcgcgcgcacgcgccacacggccgacgacgacgagcaggtttggagggccgacgccgacgcggccggcctccttacgggtcccgtcgtctctgcggcggctgcgccgatatccatctcacgagcagagcaggagtagggagcaggagcaggggaggggggcgccgtcgtcgggctgagtcccggtgagcatccgcatcctctctttctctcattcatctctccgtgactctgtcccaccacccacttttgtcttgaatttttgcttgcgtgcgttaaccctagctgcttcgcttctagatctgggagaagtttttttctcttaatttcagagccttaaccttaatacaagtaacagtttgtttcccccaaaaaaatttttggggttcaactgaattgaacctccattttatggtgttatgatcagctaaattccgagtcataatatggcaatcgatgctgctatacaatttttggtcagtataactgtgtcattctgtgataattttaattggctggatgatataagtcgcaaggcaattggcactttttttcactgttcctcattgtgggaaacaaaaataatattattataacaagtatacgcgtcacttttttttccctttttgataagctaaaaaagaaagaaagaaatgaaattgtggagacagaccttgtagcaatagcaatgcaatgcaattttagaaattcagaagagggaatgtaactatggctctcatgcatggagtggagtaaaatgttgacaataactaacagtaggtgtgaaggtgatataaccttcttcacattttctcacctcaactgtatcacttctagatacgctgctttcatgtatgtctaggtttccattcttattattttgcggaaacattagttctgtggtgttgttggtttcctaacctttaaaaacttgtggttgcagaactttagcacaagttgtactagagaagatatacatctccttgtgctgtactctgttttggtatggaggaagattctggtagatcaatatcaacaactggttttcttagaagaggctctagtgtctccttaaaagatcaaggcaatgaggagaggccaaacaagacaaaactcaacccaatgaatgccaggtgggctgacagtaaggagaagccaagatatttacgtgagccatttcgttcatcaggcactaaggctgcatgtccaagctcttcaaaagctcccgtcagaaaatatttcgaggaaaaacaaggacggacatttttaggagaggcagataatgcagaaagtagtagcagaagaactgaggccaaccgtctgcagtgtagcaagaaagctgttgttgaggaggatgtgcatccatatggtcagcaggatgagccagaagatttgttgtccacatcaactactgaagatcagcctgcagaacttgatcctgaactattagattcttctgtttcttcaggggtgtctgcacatgcaattggttctgtagtcagaaatgctgctttgagatctaaatcacgtcagcagaagggtaaagaagaattgtgtcagattagacctcaaactgcttctgcttttgttaatcggtccactatacctcgaaattctaccaatggtgtgaaatcatcaaatgctgctggccctggggtacagagacgtactctaaaaaaccttggctgcacatcaatatctgatgttttgccttctggctgttcttcagctaattctattcataataagagggctgaggttatgagaaacagggcatttgacggagagagttcttctagaccaaggggcttaaatggacactctagtttaggccattcacctgccatgtattctggtatcactggtcctagagtcagaactgctgaacaatcagcttctcagcaaacacggactagtagcagaagtattcaggagtctgcagattcttcaaggattaagg

SEQ ID NO: 21846 - DNA, 2259 bp, Oryza sativa
  unsure (1)..(2259): unsure at all n locations
cgatggtcnattgtanaactgaatatccgcctnnnnnnnnnnnnnnnnnnnnnnnnnnnnnnnnnnnncgcttcataaggtgccatttgtatgctggcttgatagctgttgttgtaggagaactcggcataggggagactcttatcccaggtcttcccgaaatccaggacacatgcgcgaagcatatcttctaggatctgatttagacgctcggtctgcccatctgtctgcgggtgatatgcggtgctgaagtttaatcgggtacccagctcttcttggagcttcttccaaaagtgagaggtgaattggcttcccctatcagatatgattttcttaggaacgccatggagacttacgatcctagcgaagtagagttcggctagtttgttccctccataggtggtcttcacaggaatgaatcgagctaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccctcaagtctaagtacatcttcgtgctgccagggtggatggaataaggactttcgtgagcttcctgaagtatcaactgtttaagttctctgttatctggaacgcatactcgatttccgttccatagggttccgtgttcatcctctgtgaaaccagcggctttaccctgtttcatattcttgaggagtccatgcatgtctggatcattcttctgagcctcgcggatttgatcgagcaaggtgggcttggcttccagcgcagccaagaatccgcgactaactatgcttaggttcagggcttccatctgttgattaagttcgggtggaatgccacggacgttaagagtgttgcaatggctttttcgacttagagcgtcggcaaccacgttggccttaccaggatgatagtgaattcccacatcataatccttgatgagttctaaccatctcctttgtcgaagattcaggtccgactgagtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccatcctgcatgagcacgcaccccaatccttggcgcgaagcatcacaatacaccatgaagtccttgtgagtatccggcaagattaacaccggcgaggaaaccagcttttctttgagagtttggaacgccttctcgcattgcgggctccacacaaatttctcttctttcttcaacaattgtgtcatgggtcgagcgattttggagaagttctcgatgaatctccggtagtatcctgccaaacctaataaactgcgaacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcagctttcccaataccagacggagatggtgctgatggtcttcctctgattgtgagtatatcagaatgtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgatcgaacagatcatcgatccggggaagagggtacttgtttttgatggtaacttcattgagagctctgtagtcaacgcacatcctcttcgtcttgtctttcttctccacaaaaatcacaggagcaccccagggggaagtactcggacgtatataccccttttctttcagctcttccaactgtttcttaactnnnnnnnnnnnnnnnnnnnnnnnnnnnnnnnnnnnnnnnnnnnaatataaggcacac

SEQ ID NO: 21847 - DNA, 3375 bp, Oryza sativa
  unsure (1)..(3375): unsure at all n locations
gctggcnnatgagacctgcataacctcatgctgcatgccgcagtagactctgaggatccccgcgtcggttggcttggcatggcaggtcgacaggtttgcagcctctatgggccatggggatgcgtcgatggcttcaccgggagcaagttgccatggcgcagctatcattggagtgtacttgcacagtgccgccgcgtccagatccacggagatgcaacgtgggcgatgtcccgagcagtagcatataaattcgtactgttcttcttatttcctctctcagttttaacgcaggttcacctgtacagtacgaatggccatggaagctgtactacgcggtaacagtaaaagcatttcacagtgagcaattcgctgatgtgcgtttcggagtttcagattctgaaattatgaatggggcgggcaagtatatggtggatgctgtagtattaatcgaactcgatctggagcagtgtactgtacttacgtagataatgaacttggattaatttacgccataaaattccacagaaataactcgcgaatgaagtactggtcctgctgcctgctgatgagcctgaatgccgcacgggcaacctccggaaaattaaaaattttcaggagcaaacattcaaatttcgctgagatcactagccagagcctcacgtgtcccgaacttggatgatccagtccagagcccccacctctttccgtgctgcctcgcaaagcatcgacgtgccacctaccccatccggaacagtaattcctcactgccatgtgggacccacgccgtgtcatgacagccatgtcagcgactgaactggtaatcacctcgcgtgtgcgtctgtgcgctcatccttttttttttcctcctcctcccacgagcattcattccctcgcaacgcgcgcacgaattttatttttatttgaaaaattcccgatattgcccttgagctgtcagcattagtaggctatttaatgacggacaaaacagtaatctcgcgtcctaacgttcttaaatgcgcattactagctcgaaacaggggtctctgctccccagcccatgctgctccctttgcccttttctttcgggaaaaaagggaaaaaaaatactccattcatctactgacacatgggcccacatccccacaactaaactgtcagtggctcagtgccacccgtagtgtactgccactccgcgacaacccgcacggcgtcgaactggttatcctcaccggcggagcagcgcagcggcgagtggccccacccttctcccgctgccactgccactgggccccaccgcccggaagatccggtcaccaccgcagagcgctagtctccaccgctattattaccccctaccgcttggttacaaatcacactcgtggttgtctcgtgtagtggaggtggagtacatctaaaatccctcgtcttgtcgctgctaagcttgccgccgatggagccgtcgcggcggctgctgctgtccgactacgacggcgcgatcgtgtcgccgctgccgtcgccgccgccgtcgtcggccacgccgttcaggccgggcgtcgcggtggtcgtgggcatcctgacgagcgtgttctccatcacgttcctgctgctgctgtacgcgaagcactgcaagcggaacgccgcggagtcgtcgggcccgtacgggagcggcggcgcgttcgggtcgtccggtgggggcggggcgggcgaccggcggaactccggcgtcgaccgcgccgtggtggagtcgctgccggtgttccggttcggcgcgctccgtgggcagaaggctgggctcgagtgcgcggtgtgcctcggccggttcgagccgacggaggcgctccggctgctgccgaaatgccgccatgggttccacgtcgagtgcgtggatacgtggctggacgcgcactcgacgtgcccgctgtgccgctcccgcgtcgaccccgaggacgtcctgctcctcccggagccgccaaagccgtccaccacggggccccctgatccgccggagacgaaggtggcggcggcggcggcggctgctacggccaaggacaaggaggcgagcttagctcctgctgctcctgctccgtctccagcgtttagaggcttcttctccggccggcactcgacggggtcggtacgggcgccagggagggttggccctgcctcacgccggtcggccgatctcgtcgaaggcgacggcggtgcggtggtgggatgcttcgaggccgccaaggttcgcaaggacagggtgctgttgatggagccggcggccgcggtggcggagcctgacccggaagcctacgaccggcggttcgggcaccgcatcctggtgagcaccgccggtggctgcgaggacgagacggcaccggcggcgaagcagcggtggagcgaggtgcgaccatccgatctgatgttcgtccggtcggagatgctggtgacggaggccggccggtactcctgctccgccgccgtccactccggcaacggcaggagcgtaatcagcgcgaggagcctatcggagctcgccggcgtgagccggctccctcccatccgcgccagcggcgagccacgagccggcgcgcgtcggtggccgggctcgagctggtgggcccggggcccgcccgcccttaacggccctagcacctaggccgctgttccgcggggcccacttcgcagcccggaaaaaggctcccaattttttctctccccatactgcccccgccacttccacgtaaaccacggcaccctatgcccgaacccgtggctcacgtgatgggcaccatggtaattacacgcagctggggcacaagactgcaagatgagtccatgccatgcccgcctcgggagccgcgccgctagagagagataagatggtggtggtgatggtatgttgctttccgcggggatctcggggcaaaggggctggtttcttcctgaattcgggcggcctggatcgatcggctacggcccgcatatggcgccggcgaaggcgtcgtaacccaatgcggccgggatcttctgcggggccgcgcgctgacaagggcttttggcgcgtcgcgtcggccgggtcgggggacgagggaaccaggcaaccagcccatgcttcacaagagagaaaaagaaaaaaaaagctggtcgtatgcgtgtaaaattcttgtctgcgtaagaggaaaagcgctgcaactttttggtgtaacctgttgcaaagcatctaccgggcaatggctcagttagtaaagcagctgaagcccatctcgcatttctcatctactatcctcttggctttttttgtgcgtcgtgttgctagactcgggttcgttttgcattctatcgtagtggcagtagtactatcagtggcacatggtggaggagcaa

SEQ ID NO: 21848 - DNA, 1260 bp, Oryza sativa
  unsure (1)..(1260): unsure at all n locations
caacaagcgtcgcaatatggtaatggattnggaaagggctaattctatagataaatcattactctaacctataancaaagtttaatataatctccaactcaacccaacccaacacccccccgggnatttgaattcgaatactacaaccccgcagccngcagggcgactatagaggatccccgacgtggacggcgtctgggaaaaaggggcggcggcggcggcggggcccaatatacgggtgcgggggctgacaccgcggtcggaggcgaaaggcgaagagatcctccggggcgtcgacctggacgtgccgcgcggggtggtcgtcggcgtcatcggccccagcggcagcggcaagtccacgctgctccgcgcgctcaaccgcctttgggagcccgcgccgggcgccgtgctcctcgacggcgtcgacatttgcggcatcgacgtcctcgcgctccgccgaaaggtcggcatgctcttccagctccccgccatgttcgacggtaagtacgtacgcccgccgctgtccacacacactgcacatacgcacggtgatccgatcctggaagaaactgtacatggattccatgaatgcggtaccttttccaaatttaaatgttcttctctgcaaaaagatgcttttccttcaaaaataaacaagaacttgatttgagattaccaagatcctgtccaaaaaaaaaaacagtaacgagtaagttttagacgatcaacagacaactaggtttggcatttttcatatgaataattaactattcgccactcttacgattgattagcctagttgtgtcaataataagttataataagggggaaataatgataaaatgtaccaatgtcgcagtcaaaacctaacaaatgaaagccgagttatagcatttgataaacagataaaaccaagttgagcacttttttgccctcgtcttgtttcctagaaatgggtgataagtttttttctacctaagaaaccgcatcaattttcaacttgcagtgaacttttacactagaggacgggtacttttagttgaaagaggtttttacgctaaggccaaatacatgagagcttttgctagttgtaacttcttctagacttcatagctcccttaaatagttcagattctaacctaaattctgataattgatactcctcagtttgccagaatatttcaacctaggatgagacgactnnnnnnnnnnnnnnnnnnnnnnnnnnnnnnnnnnnnnnnnnnnnnnnnnnnnnnnnac

SEQ ID NO: 21849 - DNA, 1313 bp, Oryza sativa
  unsure (1)..(1313): unsure at all n locations
cctggganatgagaactgaatatcctcatgcnnnnnnnnnnnnnnnnnnnnnnnnnnnnnnnnnctaatgaacgaatgctaggaggtggaggtgttgatggaggtgattgaatgcagctactagtgagctatcatttatctcatcacggattgactatctcatactccagtacaattctcattgtagctatacatcgagctgctggacctgaactcgtagaggcctgcccagtccagagacgcggggctggcagattctcctacgccgacgagcttctcaaggcgttctgcgctgcctttccttcttcttcatcgtcgtcgtctctgccgacgcctgcgccgccgccgacgcagccgcagccagagcagcagaaaccagtggtggtggtggtgtaggagaatctgccagccccgacgacggcctctccggcgaaggcgaagctggcggccgcgaggcaagtgccaggcggcgtggctagatccaagaggaggtgagctttcttcactttgccttcacgctcacccacgccgtcgccttcggcttcccgcgtcgcagccgccggcgacgacttctttccgccaccgcgctcgcccgccgacgccgncttgccctgccggcggcgtcccattctcccgtgtcttcgccaccgcatcggcggcgacctcctccccaccgtcgaccggcctgccaagtccagagaggagtgagagagagaaagagagagaagagaggaaaggagaggaagggagaggccagcctgctgaagtggcatcctgacatgtgggtcctacgtgggtctcacgctgactcagccggcacgtcggacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21850 - DNA, 1241 bp, Oryza sativa
agtgacttggtattcattccacatggcatcgatgtggtgctacgtgggcactaaaataaaaccaaccttaaataaaaataaaaataaattaattcttggacccacatgtcagttacccaactcctcctgctttatcatcggcggcgaccaatatgaagagaccggcggaccggcgaagcggcggaagcaaaaccaccacgggaaccgaaaagaaaccagaggtgaggaagcctcgccatcgccgcttcccctcatgcacccctcctcttccgcacaggtgaattgctcctatagttgcacactcatattgaatgcaaggacgtcgaggacacaaggggatcggggagtcaaagtggccagggtttaaactagactcaagcttagtttagcagcaagggttcccaacccatctttttcatgttccgtgcgcacgcttttaaaactactaaatgttgtttttttgcaaaaagtttatatacgaaaattgcttaaaaaatatattgatctatttttgaaaacaaaaattagcaaatacttaattaatcacacgctaatagaccactctgttttccgtgcgctggagatacgttcccaaccgcctgcagcgaacacatcctcactcactttacaagcatatggttctcggggtatattcgtacttttcacatgttctatagcggatacatgttcttgttatgttctacagtaaagatcacaacgtttaaatatcatttagcaaattttatatttcgaaatcatggctaattgtctctgataggatcataggaggctggcgtcatggcgtgcatgcgcgtctgtggaattctgaggtcctgagctttggtgcgcaaagttggacccctgatgaaagattgtcttcgtacggaagtccagccgccgccgggtgcccagggcggttggttccattccatcaatcatttttccaatcgttctaattgcacttcaatcctaatctttgggtcgaatttggcgtaatggcgcgtgaaccggtccccgtcgcatatgtaccatgtcattgtaacaacagatcgaaatgcccaaagaatatttctcacaatctttaaagccacttttgacaaacaaacttattatacatccatcgtcgtcgacttattatcttcctcgtatccttttcccatctctctactactttttacacgacaataacacatacagcaatagatagggtaccgagctcgaatatgatttcaaaggccgcg

SEQ ID NO: 21851 - DNA, 806 bp, Oryza sativa
  unsure (1)..(806): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaggattgagtcgactagacgttagacataacaagcaatcatgaggcaagaaagttgtagcccactagtctagctcgcgagccttagccacttcacatcaatctagggccactcacagcgcgccaccaagttttatcgttcttcacatgccacgtagatcaagaacagtataagctgcatgctccacagtgcaagttacatatagcgggttaggtctatatccagctttagctaatatattgacgtgtaatcattttaggtgttaaaaaaaatagttatccatctttagggttgagtgacgcaagaatttggccagagaatcaattgtctccctcctagacaagtccaatggcgactctgttcatcatttggccagaggtgtcgtaatcaacatgcccgtacctaacggcatcatgtcggagtactaaagagcccagctacgattcatctacggacgtcgtccttactaatcccgaactcgatcaatcaaaacgtaacctttcaggtattgaaaacttaccactactccagtaaatcacagcgtgtaatccgctgtcacaaaacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 21852 - DNA, 777 bp, Oryza sativa
  unsure (1)..(777): unsure at all n locations
nnnnnnnnnnnnnnnnnnnnnnnnnnnnnnnnnnnnnnnnnnnnnnnnnnnnnnnnnnnnnnnnnnnnatcggtggagctctgtcactgtgccttgtgcatgcgtttacattgtgcgcggacatgcgtggtggcgcctctctccggttaaggtggccgggggctctcgtcgccgtcgtagctgcggcagtaacgccggcgccgccggcggggcatggcgaccacaatttccaccgggactttgacgccgtgtgggggaagggcaatgcgaggttccgggacggcgggcggatggtggagctgacgctggacgagcagacgggggcgcggctgcagtccaaggagcggttcttgtttgggaggttcgatctcgagatcaagctcgtcaggggagagtctgcagggaccatcacttccttctatgtaagttggggcagtcttctgatcgatcttggcttgatttgttcgatttttccccctagtttgtgtgaaatcctaagaattgttcatcccgttaaagtagctcggattgttagtagtagacgacagaggaacaccaggggaattccacgagttgacacttgtcattcttgggatgagctttactttatggggcagaaaataataagaagaagattgtcatcccagattaacaagtttggtcctcgattagcagatgggatggttgagcgcnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21853 - DNA, 5905 bp, Oryza sativa
  unsure (1)..(5905): unsure at all n locations
cgggcggttgatcactggtacccgccacctggcaaccccaacctagggattggctttgcctcctccgatcacatggtagcaccgccaccttctccttcacgccgcgccctgcgtttgcccaagcggtgccacgcaggggtcaccttcttgtgccgctcctaccagccaccaccggcgtctctcgttgtggctccggggaatcagttcagccaccttcatcgcacgtgtcgcccccggcatgccgtgggccggtaccggccatccatttgcgttgctgtgtagacaaaggtgcggaaggaggagggaaaagcgcggtgggaggaacatacaagtcataaatcagaatacaatacaagatatgcatgatacttcatccggcccctaatataagggattttaacattttgcttgcactgtttgactattcgtcttattcagaaaatttgtgcaaatataaaaaacgaaaagttatgcttaaaatactttgggtaatcaagtaagtcacaaataaaataaataataattttaaattattttaaataagacgaatggtcaaacagtgtaagtaaaatgttaaaatctcttgtattagaggacggggggagtaacacatgaacttaccagtcaatcaacgtctgcactctgcagtctggacttgcaagttgaaatagtactatcatattgtactactgctcattgcccaactgatgaaaaaattgcataaataagtaaccgctgatctgacttgcttaaccggtgcaagcagtcgttcaccaccaagaactggttgtaatagtagccgtcgtactccgcctgccgctcggatgtcctgctcctgcaccgggagccgcccggcacggacccacggatccaacaccgtcttcaccttcgggttgacgccgccggcgtcatggaagacgagacgtatggctggagctgccacaatgcgacgaacaaatgtgaggaaggcgagcgagagcacgagaacgacttgatgttgacgcacgggactgacgaacactctgccgcccgcgtctttcatagctacttataccctgctgcgcgcccgatcgactcccttgccgccaggcgccgcccagcacgaccagtggcggagccagaaaatttccacgtctaagactgagctaatgagatctcaaatattttcataaattatatagcattttttaagattataatgggtattatggagctaggcatggggcccaagccctagctgccccatgcctgattccgcccctgagcacgacgaaccatgaggcaaggcagatcggcgggcagagaaggcaaggtatatatcaagactcaagaggacgcgaaggatgtggatggtgatgatgggagaggcggaaggggacgggagcgaaagggtgataagagtatgagaccgttggtgttgcgcgtgaactaaaacccattgttttcatttttatcctcatccctgacatgtgggccccataagctgactcagaatcaaatatgtcatgtgggacaaaactaccttcaaaaccgttcaggagtcaatttgcaacggttttgagagttgggggatgggttatacccggttttacggttgaaggatgtgattcaaccaaggatgtgaattgagggatagaaattgactaattactactggaaatataatacgaactgggcctagtgcgccagaatctggattcgagttacgggctgtggcctatgattcggcagctttggaagcccatcgcatctcatactgttgttgctgttagtttcagaaaaagaaatgtgactcccatacaaaatgaaattttgagcaaattcaaaatttcgaaaaaaataaaaaataatcatggacgtagtgcttgatttgcagtgtactatggtgaataaatttattgaaaaagagtaagataaattcaaatttgagagcaaaattaaaagtcaattaggaaataggaaaatgaaataatgaaatgggcctaagtttgcactggtcatgcggccctttaaggcccatgtggagaaaatatctcatggtattctcatctctctaattttctgttattatccctaaactctacacacatttaagtatttctccaatttaattttaacattttttttcattttgttcttctttcggccaaacatctcgcggttaccacgcaaatactacagtaatcgcctcaaaccgcgcggtaaccgtaccaaaactataataccgcagttttttttgaattcaaatttttgaaaccgaaatttacaatgtttttcacggttattgcgcggttaccgcggggggtcggtaaccaccccaaaaaaagggtaaggggaaccgtggtaccacatccccgtttgtaaatgttttgaaagaaaaaaaaagtatatatagctttcctaatcctaacaaaagaaactcatgaacataggccactctacaaaatacactctaccgaacttccgtgtgtgcatgtccttaaatccaacgaacaagtacatcgcatcacattcattaaaaccgtccgatcaaagatgagcggctcaaattaatttgagtacacctaaaaagtttccagtaaaagtaaaaaaaaaatacatcagagaaaaaaaatatgcttccttttgttgctcgaggcatagcatagtactgtatatttgtacacattttgtatgggagtcacatttctttttctgaaactaacagcaacaacagtatgagatgggcttccaaagctgccgaataaataggccacagcccgtaactcgaatccgatttctggcccactaggcccagttcgtattatatttccagtacgtgtcagtgtgtcaggactaacgaattgaaaagatggaaacaaaacagcgacgacgaaatcgatcgtggcaaactgcacgccaagtcaagtcaaacacaaattaatcaaacaaatcacttttacatcgttgtatattacaacttattcggatcgttgacaaaaacaacttaaattttgaacacacaataatgtacgactactaccgtttcttttttttccaaatccaaaaggaaagattgccatccatcgcccaattgccctccaagaacatgcaccctgcacaagtgcagaggcctgcatccccctcgaggtagatcacgtccgtcgcacgtgtgcaacgcatcgtgtgccatgtcatcagttggggaacctgcagtcgcggcggatctcgccgccggtggccggcgacttgacgccgaccctgccgagcttggtcatggcggcgacgaagtcgttgaagaaggcgccctggttggcggcgtagcggtcgacgaggccgcgggacctcgggtcggagtagagcgtctggtcggagccgaggaggccgcggccggcgcggaggttctggtagaaggcgttgtcgaaccggagcggcgtcgcggcgtcgaggaacgcgaagccgctggagccgcagctgccgcgcagcatcgccgcgaagttggggtccatggtcgggtcgccggcgagcctgtagccgaagaagctgcacgacgccgccccgatggtgtgaccccctgaaaaacaaattcgacaagacatcgttgtcacatcacacgcgtcgccgccgccgccattgctgtgcatgtagctgctgccatggcaacgtaccggagagggcgaccatgtcggtggggctgaggccgaggctgccgaagtagccggtgagctggtcgaggttgaagttgccatgaggcaggttgacgctgttcctggtcgacaccctgccgtcgaacctgccgagctccaccgcgtagttcggccctccactctgcatcatgcagccaagccatcaatggccattcttttttcacgaacgcgcaaaaagattgcacgtcaatatattggaaggagaagagttttttttctacacaacgtaattggtcagacagacctatgttaaaagaagaaagaaaaagcaaaacaaaaactgtagctaggaaaaagaaaaactactgtggcagctaaacggaactccaatcagcggaaaggagggcagagccacactacactaccaacaaacccctcaaaatagcaacatcagcggaagaccacatacggccctccgagagaatgaattccagaaccatttgtgcgtgttggaatataaagtgaattattcgttttttctcatcaacttaggcttttagattgtaactcgataccgcgcaaaaatgggccggtaaggtagggtagatacaggcaagtgagtgtgagttaccaggaagatggagtctctggtggcgagggccaagatgtcggcgcaggacaccctgttccggcactgggggtcgctgtcgacggcggccttggcggctatcaccgtcgtgaacccctccggcttcagcgtctggtcgtcggggttcctccactcgtcgtcgccgttcgggttgatgatcatgatcgacgcgtcgcacccgcggacggcgcagtcgtggaagaagagcctcagcgtcgccggcgccgcgatcggcgactgctgcatcgacctctgcacggacccgcgcacgatgttctcgaggttcgggcagatcttggcgtagtagttcttcctcaggttcgccgccaccaatggcgacgagatcgccatcgccagcgcgaggacgacgaggaaatggaagctcctcatcctgtcgctgttttttttttccttcactacttgaacttaaacaagcttgaaatgttatataaactgtatttgagctcgaggtggttttgcaagcgatcggtgagtggcgtttatataggagagtgatggcgtgtgtcgtcctcgctctgagagcttctgatccatttgtttagggttttgcctcgttgtgcgtagactcagaaggtgataatgcaaatgatcatttgtttaactgaggtttaactggtcaatttggaactggtagttgatggccatgattaatcacacacagctaagctcaaaacctgatttcgagatgggcaaaactgtgggtcctggctttctgctctattatcgtactctctgcatttctgcatatactagtccagctctgatcagatgaacattcctacagatctttatctcttttgttttttgggaatcaacattcctacagatctgaatgtctctgatgaactgagatccgggtatgatacacttcttcggtgtacaaacattattcttttgtaggattcttttttttttggaaatttttttgtgagatctgtccctctgaatattgatcatagtactgtaattccgtaacaaaaacaaaatgatgatattttgtttctctcaactttggatcgatggaacagcatatctgaattccaccgttaaaacaaacatttctaaattcctctgttctgcattccagaaagcagcttccattatattgtaccttcacaaaagaaattcaagtagcttccgttgaagaatatagccatgagcccatgattgactagcacagagtttgaaaacccgttgcatactcgttctgtaacgtgtgcctccatgatttgctttggtgacgagggggcttataactgcagtttttgtttattttttgaaaactataagttcaatcgcaatgtgtgggtagacctgacctggtacatatcgccacacgcaggtcggcaggtgccaacattaagacgaacaccgcacaaaatgggtgccaaactgtgagcttaaggacgtcacactgggcaccgaactcgtccataatatatatagtatcctgctgaatttttttttgttttttcagctgaattcctagccactagatcgctccatgattcatgcaactattaccgggcccgcaacttgatttgggtttggatgaggacggatttgggtttgggtnccgagctcgaatatcaaatatcatngccacacg

SEQ ID NO: 21854 - DNA, 2357 bp, Oryza sativa
  unsure (1)..(2357): unsure at all n locations
ctgtgcanttgaaatnnnnnnnnnnnnnnnnnnnnnnnnnnnnnnnnnnnnnnnnnnnnnggcatgaagacgatgggcttcttttatgatttcaagcgcttttcttttgtgtgcgtgttctcttccggggtggtcagggaggcggcttatgtggccgtcgctgatgagagttctacggcagttggcttggtggatcaagtagtaagcttggcggcttccgtggcggctggtaaggcattcacactggttcttgctggatttttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttgtactgtgcggggggccgcctgcaaatgggcggcgagggggcatggaattttgcaggcggcccccttgccgccctggggagggcgattttgtactgtgctctatatttttgtataaatatcaataggtatcaaatctttttatattgaaaactatacaagattaaaatctccaagactggtaaaatataattttattattttttagggcatatttggattgtcaccggacaaatattttgttaccgtacaaatattttattaatttttagggcatatttggattgttagtgccaaatttttcttcacgaccaaatatttggtaaggtaaaattgcatttgatcatatttagtttgctgccaaaatgtaaaattgtagtgaagaatgttctacataatctcaaatatagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggccttttacccctgtcccttctaccctgcgccctaatgtgcccgtgggagtacgtgagtcggtccggggtatggcacggcaacccgtcctgcctgtacaggtgtgacctctggctgctcctgagtgtgcgcctctggagctcctccaagctgagaagagcctaatacgtcgtggtggtctgcaccgtgcaagtcgtcgtcgtagaactggctagtaggaccagtcctaccggcgtgagacgaaaaggccccagtaccgaagatcccggctgcaaatcctgctggacaaggaccatcagtttcgtacaggtatttaacagtattaataaaaagtaaagtaccgtgtgggcgagggatcgacgctccgtgagagtaagagctggcgaacgcgcccaaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatgaatgatcaagttacgacggggtgatgttttcgtacaaaaacagaaacaaaacttaaaaaacctctgggctgagcagtaccgtgcgaaataggtgccgtaggtcgaggtcctgctccgtcggtaggcgagcgagaccgtggttgtaccggaccagctggaggtacgacgtccacggcgctgcgacaggagaagacgcgcatgaccgcacgcatcttctcctgcggcgnggtgcaatcgaaattcaaaaccgcgcg

SEQ ID NO: 21855 - DNA, 997 bp, Oryza sativa
  unsure (1)..(997): unsure at all n locations
atcaagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagttctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaaaagacgactgataaacttataacgcagcgaagttgcactaaccccacgtcgacaccagtaagtccccatcgtgggacggtcttttggccactgcgcgttgcgaccaaccccgtagggtgcgctgtccaccactggtcgacctatggcaaacctctcggctgcccaaagcggggatcctctaaagtcgacctgcgggcaaacaagcatgtggttattcaaatntacaaaggnntcaaaagcagat

SEQ ID NO: 21856 - DNA, 3398 bp, Oryza sativa
  unsure (1)..(3398): unsure at all n locations
cggggttttgtanaactgtanatctctatnnnnnnnnnnnnnnnnnnnnnnnnnnnnnnnnnnnncgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttatcgttattatttctttgttcaccctagattaaacaaaaccccaactagtggacactctactcatggtgccactagtacaattataggtagatgcttcgcttttaattaggtaacattaggcggttttacaactctagactttgggaatattcatatcacctggacactgtggaattgttggagtattgtggaattggattcacactgccccctctattcaaaatccccaaaaatggtttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgacggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaagacaggttcgtgtgggttcacggccttgattaataatattgtatagctctaggatcgtatttacaaaatagcttgagcaactaagtgccttttaatgctgtttactgcaaaccctaaccccctatattatgactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtacctgccgtcaagcgcctgtggtcgtcaccctagtcttccgctgtttttcgtttgtcttcatgtgtgctgggccttcgccgcccatgtaataaattaattatttacgcttccgcttgttaaactctgtattgtatcaacttttggtgtaccttgcctcctgggacaaggaataatacacgcacgtaaggaacgcccgttgggttttttcggtcgtgacaagatgcaaagccgatatgcttgaacctgtcaaggctgaaatcaaacgtttgtatgatgctggttttattcgtccttgccgatatgctgaaagggtttctagtgtagttcctgttatcaagaaaaatggtaaggtgagggtttgcattgatttcagggatttgaataaagctaccctgaaggatgaatatccgatgccaatggccgatcagttggttgatgctgcttcaggacataagatactaagttttatggatgggaacgcgggatataatcaaatctttatggccgaagaagatatggataagacggccttcagattatcctggtgcattcgggcttgtttgaatgggttgtaatgactttcggctcaaagagcgctggaggtaggtaccagaggctattgaattatatatatcatgatctgatcggatggttggttgaggtcaatattgatgatgtggttgttaaatccaaagaaatagaggaccacatagccgatttgagaaaggttttcgagaggactaggaaatatggtttgaagatgaatccgacaaaatgtgcttttggtgtatcggctggccagttcttgggatttcttgttcatgaaagggggattgaaatacctcagaggagtatcaatgcgatcaaaaagattaagcctccgggaaacaagacagagttgcaggagatgatcggcaaaattaattttgttcgaaggtttatttctaatttgtctggaaaactggaaccttttacaccattgttaagattgagagccgatcagcaattcacttagggggcagaacaacagaaagctttggataatattaaagaatatttaagttctcctccagtattgatccctccataaaaagggattcctttccgattatatttgtcggccggtgataagtcaatcggctcggtcttgattcaggagcttgaaggaaaagagagggttgtgttttatttaagccgtcggctcttggatgcagaaacaaggtattctcctgtggagaaattgtgtttgtgtttatatttctcttgtactaagttgaggcattacttgttgtccaatgagtgcactgtggtgtgtaaagccgatgtgattaagtacatgctatcggctccgattttaaaatgaagagttggcaagtggatattttctttaatggagtttgatcttcggcatgaatcaccaaaggcgattaagggacaggctgtagccgattttattgtgggtcatcgtgatgattcaatcggcttggttgacattatgccttgggtattattctttgatgaatctgtatgcagtcatggttatggtatcggcttggttataattgcgccttgggggcaagttttgaatttgcctatgctattaaacaccgtgtgactaataatcaggctgagtatgaggcagtgttaaaagggttacagttgcttcaggaannnnnnnnnnnnnnnnnnnnnnnnnnnnnnnnnnnnnnnnngaantatcaacaaagngccac

SEQ ID NO: 21857 - DNA, 1186 bp, Oryza sativa
  unsure (1)..(1186): unsure at all n locations
cgtggattgatanatctctatgctcgtttgcctgcaggtcgactctagaggatccccaaatatctttaaatgctgtttactgcaaccctaacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagggtggattaatcataccgatcatatcaattccccaacctctaaaaggccacggtttaataataggattcatagccgatgctggcgccctttggatcgctccaaacttctgacaatcttgacaacctttataatatctgaaacaatcctccagcattgtcggccaaaaatatccagcacgtcggagcaaccacctcattttatgagccgactgatgtgtaccacatatcccttcataaacttcgccgattgcaacttttgcctgatcggcactcaaacatttaagcaacactccatcaatcgtccgataatagaagtcatcatccaataaagtatatttcaaagctttataacgcaatttccgcgaagccgattgagatgtattctgtaaatactgaaacacatcatatctccaatcatcggctgtaattgtagcaatctatatttcgatatcttttatcattggcttatgacggagcgtggggctcctcaccgggagaccgcgcaggcccccttttgcgggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctcnnagttcgggtncggagtcgaaagcaatcaagcccac

SEQ ID NO: 21858 - DNA, 701 bp, Oryza sativa
  unsure (1)..(701): unsure at all n locations
cgagcttataaaactaatggagcatgcttgcgcatgcctttggtcgactttgcagttgcccccaanccctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtc

SEQ ID NO: 21859 - DNA, 723 bp, Oryza sativa
ccgcctagttgatccaacactcaagcatgcactgaaagatcccctataatttccccaaagacgttaccatgtgtgaataaattttgagctagtatggttgcagccacgagtaagtcttcccttgatattgggtagccagaatgccgcaaaacttccatgcctaagcgaactgttgagagtacgtttcgatttctgactgtgttagcctggaagtgcttgttccaaccttgtttctgagcatgaacgcccgcaagccaacatgttagttgaagcatcaaggcgattagcagcatgatatcaaaacgctctgagctgctcgttcggctatggcgtatgcctagtccgtaagcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagttcgtgtcgagcgctgattttttcgggctttagagcgagatttatacaatagaatttggcatgagattggattgttttagtcagcctcttatagcctaaaagctttgagtgactagatgacatatcatgtgagatgctgatcggatgccaggtttgcggtcctaagactgcatatcgaacttttcctcatactggacttaaccagaacc

SEQ ID NO: 21860 - DNA, 705 bp, Oryza sativa
  unsure (1)..(705): unsure at all n locations
ccgcgttgataatactnnnnnnnnnnnnnnnnnnnnnnnnnnnnnnnnnnnnnnnnnnnnnnnnnnnnnnnnnncttccctactaattcactactgttttttaggtcatgagaatcaagctgcactaggtgagaactagaaaattggcgtgcccttggcgctcttactacttacaaccaaatggactactctagcatggaccatacggccgcggccgagctgattcgcgacaagcgcatagccgtggttggttctggcaaatcggccttcgacaccgttgcgcaatgtgccgatgtaaacggtgagattgctgcaacagaacatgttcaccttgatcacattttccaaattgaatttgaatttgttatgacaatttttaccgtatgatatataatctatctatctattatattattaaaacagccgtgaaagaaggcaccacattcgctgtgggggctagaaattcccacattaatcgaagaaaaagaaaaaaagaaaaagaagagtccaagtagaagtccaatttaaaaatagctgaaattcggaattaaaaataagcaatattgaaagaagtttccatataagaacccaatacgatattaaccaaaattcgaaataaaaaaaaataaaatccaaaattagaaaaggaaaggagaggggtgnnnnnnnnnnnnnnnnnnnnnnnnnnnnnnnnnnnnnnnnnnn

SEQ ID NO: 21861 - DNA, 1141 bp, Oryza sativa
  unsure (1)..(1141): unsure at all n locations
gaaaattgaagtgtacggggtgaaaaatgtttcccggggggtgccattttgaatttcctttcatataatataaattcgggcactgcaaaccttataatatataaggaattataagataaacgttagttttgaaaccccgtgtcgaattttgaccatgccttatattatggaataaagggagtagaatagaactccaatctttactcaacgagctccaaccaattattacataaattcggtgcaaaaccagcgcacatcatcaagtttaaaaaaccacgcccaaataattgaagcaaacgcaagctaatattcgctcacacaaaatagagcccccttatttttgaaatgcagatgttatgccgccgcggaatgtggcgagatggcaaagggcgagggggggggtcggctttctaattacgccaggctgcgaaaaggggaatgtggtacacaggaagagattagttgaacaatnnanntnaaannannnnggncgncggggcgtaggtggcggcggaagagtgtacagtgtgtacttcacttggcgcgacgagccggaggacggagcgctcagggtagctgggtgggctcccttcttgtttttttttttttatcttttcatcgaaagaaaattaactcgcgatcattttcaacatgcacgactcgggctgtaatttcttttcttgcccgattgacggtggggattttattattactggcaaaaaaaaaaggaaacacttacatgggccaaaaccgaccggaattaagaaaaaaagaaaaatacttactggtcgaaatttcgatgaatttgatcggaattttaccaaaaccgaccggttttcgagaacttgtcggcaaattcagggaatttgtattcaaattttgatttattaaatttgttcagaatttaacagttttccaccggatttcgcgaaattccgaattccgccagcgcccgaaacggaagggcttgtcggaatcgtaaaccctgggcgaaatgtgtcactactagaaaaatcgtttttccagacgaccaaaaatagctttttcatgtgcagctcgatacgtgtacatgtacctgctcgtannnnnnnnnnnnnnnnnnnnnnnnnnnnnnnnnnnncagcaggcgttctagngacac

SEQ ID NO: 21862 - DNA, 871 bp, Oryza sativa
  unsure (1)..(871): unsure at all n locations
ncccacgttcgtcgctttcctcgaccccatttcgacgggtagggctcggggaacgccgccagcatcgccaccttcgtccttgacgccatccgcgagagagggctcgggaaccgccgccgcctccctcgacaccatccgcgcgggagggttcgggagccaccgccgccgagccatccgacgcgggagggctcgggagccaacaccgtcctgaacgctattcacgacaggaggttcgggagccaccatcctcgacgccatctgcaggagagggctcgggagccaccgccatcgctgtcctcgaccccatccgtgacgggagggctccggagccgccgccgccactgtcgtcgctatcctcgacgccatttgcgacgggagggctcgggggccgccgcccgcatcgccaccttcgtctcctcgacgccatccgcgagagagggctcgggagccgccgccgcctccctcgacaccatccgcgcgggagggttcgggagccactgccgccgtcgtcactatccttgacaccatctggaacgggagggcttaggagccactaccgtcctcgacaccatccgtggcgggagggatcgagagccgccgctgtcgttgtcactgtccttgtagcagtcgcggcatgaaggaagagatagggaagacagaagagggaggatggaggaagatggaacaaacatgtgggtcccgcgtctaggggtctaacggaaaacgtgatggagtggcacggttccaatttcttcaaatttcagtggcacgtaactaatatcatgaatattagtgtcatttatnnnnnnnnnnnnnnnnnnnnnnnnnnnnnnnnnnnnnnnnnnnnnnagcntagccaatcaaacggccg

SEQ ID NO: 21863 - DNA, 1378 bp, Oryza sativa
  unsure (1)..(1378): unsure at all n locations
agagagtgtggattccccgtttaaagggggaaaaccgtttttttcgggggttgggcccctttagttgaccctttcgccttattaagtttttttggggttgagggtgcgttaagcctttaattggggccccttaaagggagccccgtttttaaagttggcgggaaaaagcggggggacgtggggaatagggaggggaagaaagctaaggaggggggtttgggttttgcatattttggggttacgttggggggtaaccccaccgccggggggttttattggcggtttagggggggggtcctttagcgttttggggggggatattgttgtaaggggttttgggtgggggcttctttggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttccctgtcatctctcccctactaggcccatttgccctctcccccctccatccatccatccattcatccatatctcccttccttttgccgtccctttttcttgatttgattcttcttcctcccatggtctctcctcttctctccccttccttacactaacagagagctcttcttcttcttcttcttcttcttcttcttcttcttcttcttcttcttcttcttcttcctctcagctagccgtgctccggctgcgtgagatgtaagacgacgcgcgaatcaaaaatctcaaaatctcaagaagccaagaacagcagcagcaagtagaaggaaaaaggaggagagaattaagagggaatccaagaacagtggtaattaacgctttaccaatctctctctctttttctctcttaaattatttctctcctggattctttggtttgccttgtttgacggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21864 - DNA, 880 bp, Oryza sativa
  unsure (1)..(880): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttacaagtttcggctttgcgagcagcgttctgtgcaacggttgaataatgatgtgtcacagttttctggtaggatatggagtagtaattggacgactagaaatataggataacacgcatggatccggatcatgttccatcgtaccgcggacaaacactgtggatgcaaggagaacaataaataaatcctgtgaacagtacaatctggtgcgctaaaccaactgaaatattcggacgattaaacttagactatgtgtcatctagatacgtaaaggcgttgtagaggccgggtttatcctattttataaaagaaagatatataaaagcgtaaatacacatatgcttatttaatcatagtttaatatatcatccgaagttcaaaatacaaatgagatggatcaggagttgacgtggctatccagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgcg

SEQ ID NO: 21865 - DNA, 1141 bp, Oryza sativa
  unsure (1)..(1141): unsure at all n locations
cggccattgtttatagtantactggctgcgancnnnnnnnnnnnnnnnnnnnnnnnnnnnnnnttttaactacgatttatctaactttaaagacttttaatgtttatgcctgtaattttgtaaatgttatgaacggtaagtttattacatgtaattagttttttttgctacaataatttaatgctcaactttttttatctacaaaaactttgtttaaataagtaacaagccctttcccttgttaacatacctgcatagagtgatatttgagaaatagaacgaatgcttcgatctcacatccttcctgtggctgaactgtgttgatggcattaccatatagaccagattcttactgattctagctaaaaacaatatttttaacatcatccaagatccatgactcataatcaatatgttacatctcatcaaagatcattacatacaccatcataacaatctcaggaaaaactatataaacccaaaggaatggatcaccttgtcagctaagagtcagtaacatgctctcatttcactactcaatttactaagaactaaccaattatgcggataaagatcaataagaactcaaccatttccaggagcagattcaaaggagatcttcacctagaaaagactgcaatcaacttattaggatgagatgagaaggtggtaccaaggcgttcatggagactatggaggcaagccagcttggcagccatgactcacaacttcaggaactgcaaagcaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcgagc

SEQ ID NO: 21866 - DNA, 86848 bp, Oryza sativa
  unsure (1)..(86848): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacgtatatccagcgccgtgctatttggtgctgagatgtctaaattcagcgccatacgatttggcgctgaagaaaagtgttattttttaaataagttttgactataattcatttgtaaaattaattttttaaaggctcaaattgttaaaatttgtgcggtgaacgaggatgcgatgatggcggtgattcatcggctcagctgctggctgctcgctcgcccatttccccggcccgtgtcagacaaacacagagctcgccatgcccggtgcggcggtgccgggagctgtgcgccgaggagacggcagcacagaaaggggatggatggaaatatggaatgctgtaaggcatacatcaatccatcaccccatgcacatcatgtgtagtactaactccgtcccaaaataagtgtagacgtagatattcgtgtctaacgtttaaccgtccttcttatttaaaaaatttatgaaaaatttaaaaatatttagtcacacataaagtactatttatgttttattatctaatagcgataaaaatactaatcataaaaaattttcaaataagacgaaagatcaaatattaaacgtgaatagtataaaactacacttattttgtgacggagggagtacttgtccagactacatctagctccaacgagctgcagcgagagagatgagatgagcacaagtgaactggatatttttttcacattttagattttttttgaaagattattttacaaataaactcctaaaaatatttattctgaaaattaattcttttttgccaccaacatcattagtgtcgtggtccaacatgataatgccaatgacattgatgtcatcccctagtctccccgcagaagatacagtaagttacgtatacgaaggacaacggtgccaatgagatctaaaatgatttatttgtaataaaaaatacaaatagatccttggtgttaataacactgatgttgaggacttatttgtaaatttttgtattataaatatattcttttattattatttttaaaaaataggtgtgcatggatgatgcatcgacgagaaggctagttggcgatcaatcacgcgcccaccccccctccccgcgcgactggacactgtcacgcgcggagagggggcggcggacgcgtgccgcgggtgaggagggagagccagttttccttttttttccattttttccgtttctgttcggttgtgttttcatttttttttccggtttcttttctgttttttcccggttttttattttttatgaatacaaagtttgtattcgtatgtataccaagtttgtatttatacgtatataaagtttatatacacgtatgtaaagtttgtatacgcgtatgtaaagtttatatacgtgcatgcaaattttgtatacgttgtgtattttctattttttattttttaatacgtatgtatataaagtttgtatttatcatatacaaagtttgtatatgtcctatataaactttatatacatcatatataaactttgtatatgtgtatatattttatatatattaaaaatatatttatatgtatatatatgtgtgtatatatagtatatacatacgtatagaaggctgatcgcgtatcagccgtccccatgcatcgatataagtgatttagcttccgtgggaaagctagcgggatctggcgccaataacgttgacatagtaaaaaatattcattctcagattaagtttttttaaaagtttatttgtaaaataagtttttcaaagggacaaaaagtgaaaaatgcagcacaactgaacacagcaataactcacgtactccagggaagaaaagaaagagaaaaaggagaggtgagggtactggtaatcaatggaggccgctgccacccctgaaaagggccctgtccttgcaaacgcaccgcacaggctccaccaggctcacacagacactgttgaacttgtttggagagcttcttccataatcgaaaactccctaaacattttagttttttcgtttaaattctaaaagactttaggtatagaatttagaaaataattaaactagaaaaaactgaaaaatttattcttttcaattttttaaaaactgagtgccaatcaattaattctcagaatttaattttaagttctcaaacaaacccctctttctcccctctcccaacccatccatcactcatgcacgtctcactcagtgtctctctcctcctctctgggcatgcatgcatgcggctacgctagctagggtgaaagggagatcatcacgtggagagagatgcagatagtagcactccagattacagattgcagagagagtgattggcagagcggcatgcccctcgccccaccactcacttggcatttctctatcatcaccatgtactactcctactgtcctacaaggacaatgtacggcgcaatgctttgcttgatggagtatactcctatttaagatcgaatcttcagaaatttcactgaaaatctaaccatcctgcagaatcactagtactatagcgttaatcgtgttctgaagattagagtggtagtatcgctttaggtcctgtttgggaagaatatgctggttggtagctagcttctaaaaatcggaagaagctggattttctacttctgaggtctagtttattttctagattttacaggtatagattctcagaatttaggtgacaatctgaactgtttggcggagctagaaattctgggagaagctgcagcagttaaaaactccccgaaacagacgcttattttcgtgtgtactccagcatgcacggatacacactctcggaggctcggagcttgcttttttacaccaggatttgcagagcaaggaatccagtagaaaagctcacagcttcacagtacgacagcgagaaccaacggaagaagaagcagcatttgcagcaaacaaacttctaaaactgacgaagcatgctgatcgaatccgctcccaaaatgcagctgctgtttactgcagcaagcaagcaacagtggcccctatctcttcctgccatcgtctcccggttccaggagatgcccatgcctctactactctctgcagtttcttctgcgggcaaaccgatctagctcgctcgaacggtgcaccggtgaacgcaccgcggcttcgttttcctcgccggtgaaacgcaacgacgacgactgcgacggcgacgcctcgctgtgaaacaaacatatactccggcctcgggattactgtactatggtttggagatcacagccgcttggaataaatgtggcatgtggaagagaaatggtaaagagaaggcaatgccttgggagggatgcttatccattctagtaggagtactactgtactaccgatgcagtcacgcagggattctatatgctttttcatcatagatgaatggcttgagagggtttaaaaaatcacgtgcactaaccttctcagttttaaaattacggtacacctcgtgatgatcgttaaaccgtgggatggcgctaactccacccagaacggtttggtaaaccctgcacattgtaggtcgttggcgaaatagctatgagcataatttgccccgtttgaagggatgatgatgaaaattaaattagcgcacgcaaaatgagtaaaccattaacgcacaattaattaaggttagaaagttagaaaatatatttatttgatattgtaatccaactactatatagaatagaaaattttcatatgaaacataccgtttagcagtttaaaagggtgctaacgaaaactgaggtcaaatatgtatcttagcgaaatgaaaaattaatgaaacaatcgaaaataatctaaagataaaactaatatatttacgtgattagtggtttaaaaagaaatattgaaaaataaactataataaaaaaaccctaacattatatctaaagttaagtttcagatattattttttggttccaactaataagctaacaagcaaacgacaagaagctttgataatagctatcgtactttcatcaacaattttgggtgtctaataaacttgtaacaagcaaacaataagaggttttggtagaattgtaccttgatcaacaataggctttatattttttttctattacacagaagacattcatagcatgtaatagaagtacagatactactatcatattgatacatatgttcaccactctatatcatacggagtattggctagatttatttattgtaactgttttttatcttttatggctaaattgcggaaaatatttaataaccattgatgataacttgggtatctgtaggaccaaaatccaaaagtccaaaaatcatcactcctcactacgcgaatatccacagctaaataatgcactcatacaatttttctttaagagagagggagtacaccgattggaatttccaaatttatgcaaggctttaaatgagaagggctcactcaactgtagcatcatacctcaccatgcagagcgcaacagtatgcagccatggtagcttgagccccattcccaaacaccacgggtgacagtgtcacgtggcgatgcacatcgtcaccatctcatggccaaaaatacgccagcctctccaactgttaatcatatccacagtgcacgttgccttcgctgtgcactgcatcatctctactgcaactgtcgctgcaacagaaaccacagtagcctcggtttttctaccaggacacaggcacacagctgttgcaaggctgagttgggtgctaaaatttctcaacttctattcctttcgttctcacattttctaaattgtaccatgatatattaaaaagttttataaaaaattatattaatttatttttaaaacttttagctaatatttaattatttatacgctaataagacatctggttttccgtaggaggaaagttagttacgaacgaaaacactcttttgacgtaatgtcaaagagacatgagtctctacctagtgggatccatccctatggacccacaagtgactcaccctaagggcatcactaatgtatatgacaaagtgatccatatagatagggcccatataaatagtttttatctatggtaatctttacaatgtatatagatataaggtatcactaagagaagagagatgagtagaaatagataatataatttatttcatgtggaaagtccatatctatatgggtaacttttgttattttttatatatggactattctattgcttatggactacttctacactatactgtggatgtcctaaggttgtgtttggaagtgaaggttgggaactctcgtctctccgcacataaaatggagtaatccatagcgtattattaatcgagtattagctaaaataaacttgaaaaataagttaatatgattttttaaaataacttttttacaaatatttttttaaaagcacacgatttactagtttgagaagcgtgcacataaaaatcaggagagtgttgaaacacggcctaaacaattttatatcctggatttataacatattattaacagtggttattttatattaatctaatgagagaatctattctatgccactgagtttatcccagttcaacaatttggcactggcattgtctctttctataatataccgatgactttatcaattgttgtacaatatgctattgggatggacatcttttttaaaaaaatatccaaaatagccttagagacatacatggttaacaattaatttatctcgttagaaagtttcaggaaaaatatgaaattttctatatggcctccttacacaacattgaagtatgtaaataagtttcattttttttggtatttttaatttttagaaaaaaatattttgtggtatatcatagagaaatagattacacaaaagataatagcaaaaaatatcttatgttgcatatgaaatatagtttacattcaaaacaacaacacaaaaaatattgtatatatcatataacaaataagttatattttaaaaaaatagaaatgaaaaaaaataaaacttgtatacaaacttttatactgtgtaaggagtccatataaatgttttcatatttttttaaaacttttaatgatataaatcaactgttatccttatatatgtccataagggtattttaggcattattgaaaaataagctcaacccaatagcgtattgtagagcaattgataaagtcgccagtatattgtagaaagagagaaagtcagtggtaaattattgaactactataaactaagtggtatagaatagattctctctaatctaattgaaagtttcagtaactagtctctgcaaatattagtcctggttaacctggacttgtaaagatgagaataaatagagaagaataaataaaaggatgagaaaaggaggcaaaagctggagataaagaaaagcgcggccctgacatttcctgcaggagcctgataaacatcacgtttcgtgttggatcaatcatggtgtgctgacatgtgggggtatagtgaaccctggccccacatgtcggtattggcttaaatcggctaaatttagtcgtgtgtttttcagttgacgtgcttacatttgctaatccagccaactgaagtttagttcaaagtagtccatgtatttccagttagcgttagcttcgttgattttttgcacattcatatgtttgaaaggaacctttagacagaagagaacagtgaatatggttttcatttttcctgatgaactgaaaaaaaccacattttccattatccattacaaaaactacattttccattatccattacatgaaggcccaactgaaatccatgtttttttcaaatcaatctagtctgagtggaatatatggattgagagtatacttatactcgttttattttttttttgggggtttgatatgaaaaaagtgataagaaggattgtgatttgtgaacaagtatgataagaacaagtactctgcatgatttatgaaactatatatttgttgcttgtttactattagaaggtctacatatgtgaagtactcctttcgttttaaaacataacaatataatatcggattagacacaatcgttcaggtttatagtacttgataatatcaaatcctagttggtctgaaaacatataaggagattcctagtaggtcgaagcaaagcaaggaagtggtcaaggggatcctgcaagagtttcaaagggaaattcgaacaattttttgagttcaatatcacacaattatctggtactacatccgtcccataaaaaacgaatccagaattggatgtgacatatttcagtactagtatatgtcatatctggtactaggttggtttttttataggacggagagagtacttgtcatggtaatctcatactgtaaggccttgtttagttcacccacaactttcaactttccatcacatcacatcatatctaaaattttcctacacacataaactcctactgcctccgtcccataatataagggattttgagtttttgcttgtagtgtttgaccactcgtcttattcaaaaaatttatgcaaatataaaaaataaaaagttgtgcgtaaatactttagataataaagtaagtcacaaaaaagtaaataataattccaaaactttttcaataagacgagtagtcaaacagtgcaaacaaaaactcaaaatcccttatattatgggacggagggagtaacttttctttccaaactaccaactttttccaaacttttaacttttttcaggaactaaacacaccctaagtaataagcctattagtttttaaaatgtttatagtttttcttggtaatctcgtcgttcgcaaaaccatggtaggataacgatatttcctaccaaaacagtagggaaaccctggcctcctcggagctgtggcagagaaaaaaaagaagacgggtaaattgcatcaaccatacacgaatttatcaagttgcaatctaatacataaacttataaaatacttgtttttgatgcacgaacttagaaatatatcacgtacgtagatactaaaaggaaagccatccctgttataacggctagagaaataaaccgtcaacggaaaacaacctaattggaactgaacggcctcatcttttcgcttatgattatgcttatcagtcaaaatttaaatttttgaacttaaatttaaagttaattttaggattttttttcatcaaagtcttttttcagcctttacttttagatcgtaaagaacacatatataaaagttttattcacaaaattattttttatttacaaatatgatgggtctggaagctgctaagcaaactaatcatcgttgtcctcggttaggtctcatccttactgcgtggttcccgtggcgcatctctctattctatttgcagctcaatcgttttggaattgacttaaaatcttcatgcttataagtaataaaaaatcatctatatataaaactttcatacatgtatgttaaaataaattatgacgtaagaactaaaaacattcaaatcaactctaaaaattaaatgttaaaattcaaattttagctttggctagtaagctaaagaggaagtgatcgagctgatgagcctgttgaaacacacatccccaaacatatgacagcatcaaaatatcaaaattaaccaaccccggtgttttgaaacgcatgaatcgcgccccccccccccccacacaaaaaaaaacatcagggtaagtgataaaaggcattttctacccatcacttgtacaacaagctaaagataaattaaaaaatgtgaaatagttttagcttcaggctttaaattttcatacttctagcgtaagaatatgattttctattttaatggttcaaaagcaaagactgagaataaaaaaataataccacctaaattaacaccaagaatcaaagattaaaatataaaattgtctagacttcgctgtataaaaaaggggttaattggatccatggactacaaatatatcattttagctaaatgccactactattcacgatatcggctacgtgacaatggaattaggggagattggcccattagccccaactccatcacgtttttcgtgaaaaatctccattagccctaactgcacgtgggacctacctgtcacttccatctatacctccctcccttctcttctctttcccctctcctctctctccaccaccgtcgcaaccgccgtcatcgaccacctccgtggtgggaggcctcgggagccgccgccgccaccatcctcgacccatccgacgtgggagggctcgggagacaacaccgtcctgaacgctattcacgacaggaggttcgggagccgccatcctcaacgccatctgcaagagagggctcgggagccaccgctatcgctgtcctcgaccccatccgtgacgggagggctctggagccgccgccgccactgtcgtcgctatcctcgacgccatttgcgacgggagggctcgggggccgccgcccgcatcgccaccttcgtctcctcgacgccatccgcgagagagggctcgggagccgccgccgcctccctcgacaccatccgcgcgggagggttcgggagccactgccgccgtcgtcactatccttgacaccatctggaacgggagggcttaggagccactaccgtcctcgacaccatccgtggcgggagggatcgagagccgccgctgtcgttgtcactgtccttgtagcagtcgcggcatgaaggaagagatagggaagacagaagagggaggatggaggaagatggaacaaacatgtgggtcccgcgtctaggggtctaacggaaaacgtgatggagtggcacggttccaatttcttcaaatttcagtggcacgtaactaatatcatgaatattagtgtcatttatctaaaatgtcatatttgtaatggcatgaatccaatgaacccaaaaaggactccaataaacaaaggctaatcttgtatttcctcgttcttctctactctctccgtttcataatataagggattttggaggatgtgacatattatgggacaagaagtatatctactattgtaaaaattgaagatatttccactgatattttggtacgtcgtctattttttagtcggtttttaagttctttcgcttttggaaatacataaggagtcatataaaaaatccttaaaaaaactcacatgctatcttgtaacgagagtcgtagtcctaatttctttggaattcttgtctggcataagaaagcaacgtacaagatatagctatcatcctaataagggttctgaattagatatcaatattatcaaattaaaaatcccatatactttttagataaaaaataacaataatatgattaaaatagcattcacctgttacaatgtacgggtattttttcccgtaaaatatagagtaagagagtagaatcggatgagatatatccagtactattgtgctccctccgtcccaaaaaaacgaatctaggattggatgcgatgttttctactactatgtatctggacagatgtatttccagattcatagtactcgaatatgtcatattcagtactatgttgggtttttatggtacggagggagtaactgtggacagaggtaataataggacaccaatatacagttaggggctgtttagttcctaaaaacttttccaaaaaatatcacattgaatctttggatacatgtatggagcattaaatatagaaaaaaagaaaaactaattgcacagtttgcatgtaaatcacgagacaaatcttttgagtgtaattagtctatgattagccataagtgctacagtaaccccacatgtgctaatgatggattaattaggcttaaaaaattcgtctctcggtttctagacgagttataaaattaatttttttattcgtgtctgaaaacacttccgacatccgttcaaaccacgtacaaatttcaccgactaaacatgcgcttgctagctactagttgaataccggagtaaggtggtgtttggttggagggactaaagtggggctaaactttagtccctcttataaaaatataagtccatatggtaaagacttatattttaatgagagagactaaattaagtataaactgcatcagctactcgtaagctacacttatgagtatactcgactgatgaaaaatatagtggaccaccacatgtcataggcgagtgagaccatgctcctcgacttgcgactcgagttctactcctaccaactctaggccaaccagatagatactgagaaaaaaaaaacaacgacactgatgtgacatctcagtgtccatcggccatcgcctccttttctctctcctctcctctcaccatcttctcctacagcaaatcactcttctctctctctaaaaaacttcacaagcctactagcctactactaggcacgtagctagcccctgccactctatcgcccagcacaagccatacagctacccgctgtcactgcgccagcggccgcagctgcgcaaagaggagcgcgagaacccaagaaaccaaccaagagctgcgtcccataaaggcgcgctgcttcaatccatccatcttctgatcttccatatacttcgcttcctgtaaatgtcatcgccgccccggcggtgcctcgcagcggagcagcagtggccatgacgccggcgccggcggccgcctcctaccgcgctctcgtcgcgctcctgctcgtcgccgtcgccgttgccgatgatggtgggtggatggctggctagctagctggctgttggttttcggttttggttggtttcttgctggggggagtgtgtggttttgtgtactggggagcagagagattcaggggggagttggtttgatgggattagtattttattagtgttgcaagtactcttcctttttggaggcatggtgattctcttgtgggtgatagtcctactactattttttattgtcctaagatctccctaagaagagtctaatactttaactaatccttgtgagtgagttgtgacaagtgccacttccatctcttctcttccttcttgtactagaacacagttgctggcattttgtttatggtggtggtagccactaggtaatccaccaatatttcataatgtgattcttttttttttcactttctgttttgttctacaagggactccgttctgctttggtattctgttacttatcaagaagtcgtctggccatttttgaatctttgtgctcattgttcaaggaaggagctttatttcttcttttgtatgttactaccaatctgatgagccgaatgctgctgcccgcgtcaggaatctttaggctttgtagcaaccttttactttactattgtgctgatttttgtgctttccaatctgatgttcttgaactctttttttttttgtcttgaaggctaagaaacataaatctttatttattagtactactacgtaaatagattttttccggggcgaacaaatctgtgcagattgtgctgttctagaatccatttgctgttgcaggcttgcagtttgtgatctgtgttctaatgtggctgtatttgcattcagggtcgacgctgctggagatcaagaagtccttccgcaatgtggacaacgtactgtacgattgggccggcggcgactactgctcgtggcgcggcgtcctctgcgacaacgtcaccttcgccgtcgccgcgctgtaagaagaacaccaccgagttcgctacttttcttgctgacaagtccactggttcgtcactgatcatgcctgttgattgcaaagcagcaacctatccgggctcaacctcggaggcgagatctctccggccgtcggcaggttgaagggcatcgtctcgatgtatggaagacgtggtggtgtactttgttgttgtttggaaatgtggcttgctggtgcttggactcgcagtaacttgtgagcttgggtttgtacctgcagtgacttgaagtcgaatgggctgtctgggcagatccctgatgagattggcgattgttcatcactaaaaactctgtgagttgtgtggagtgtggacggcattatcgatttcttcttaacttacggagagaatgtgggttgatacatgtgtttggttcagggatttgtctttcaatagcttggatggggacattccgttctcagtatcgaagctgaagcacattgagagcttgtatggcctattcttgctggaattcatttattataagcagtgttgtatggacatgccgatcgtgttctgtgaaatagttttattcatgtgccggtgtttgtggttttctaggatattgaagaacaaccaactgatcggagtgatcccatcaacgctctcacagctcccaaatttgaagattttgtaagttgcgcgaaacttcttatttttgtggtgtttaattaccgtgctcccagttttctaattgttgtgtgccctgcagggacttggcacagaacaaactgagtggagagataccaagactgatatattggaacgaggttcttcaatacttgtaagtcatccttattttgcgctggaagtttgaagattgtgcagtagttctagtatatcagtattttattgtattttagttatgtacctacttgaatgcgatttctttttttttcttttttttgaaaatcatttgaatgtatttaagagcatgtcaaaagtttgttaagctggtaaaaatctatattgactttatgtgaattcactagcattttacgcaagttgcgttatgtaaaatactcatattttttttatgaattgtggctgaattaatattatcctcaggggattacgcggtaataatttagaaggcagcatctccccagatatatgccagttgactgggctttggtacttgtgagtatatgcatactatgttttcggcaaaatttgcctcgagtccaccgtattgtacttatgtttcaatcatttggaccagtgacgtaaagaacaacagcttgactgggccgataccagaaaccattgggaactgtacaagttttcaggtcttgtacgtatttgcagcttacccctcttaattacaacttttctgcttctgtgtttgtgaggttttcctaacatttctttcatgttagggatttgtcttacaataaactttctggatcaattcctttcaacattggtttcctacaagttgctacactgtatgtggtgattatcttgacaaaaaaaaactcaattaaatgtttaatacagtttttgctgatctgcatgattattcacattgtttgaattagatctttgcaagggaacatgtttactggtcctattccatcagttattggacttatgcaggctctcgctgtactgtaagtacaatgatgaactgaatattcatcatacaattggttattgataaatgaagctttcaagatattttaattcatcaatataactttactcttccagggatctgagttacaaccaattgtctggtcctattccatcgatactaggcaatttaacatacactgagaagctgtaagttttcttttctcctaaatcgttaggttgtgaatattttccctgatagattttctactgccagttcatagttaaaaaacaaaagccttagaaggttctgcttaggaatatttcttgtgtaaattaatatgttatatttgttccaataggtatatgcaaggcaataagttaacaggtccaataccacctgagcttggaaatatgtcaacccttcattacttgtaagtgcacgttttattttattcccatagcatattctgatttgttgcgacctgatttatgtcattgttgactaatttcagagaacttaacgataatcaacttagcgggttcattcctccagagttcggaaagctaacagggttatttgacttgtaagctcttttttcaaactcttcaaaatttgttatgttttctataatttattagtaaaacaagcggcttatcttactctttgcttcacagaaaccttgcaaacaacaactttgaaggtccaatccctgataacataagctcatgtgtgaatctcaatagcttgtaagcatgatttaattataattgttatggtggaacttacaatttcagatgcatgtatctaatgtggattttctttacagcaatgcttatggcaacagattaaatgggaccattcctccttcattgcataaacttgagagcatgacttatttgtaagttgtaacaattttaatttcttaaattgtgttgttacattatttttccttttgaacttctatacttgtttaatttttgtatttcacatagaaaaaccttgtttcccatgtttgattagtaccatatgttcatctgttcttttcttaggaatttgtcatcaaattttctaagtggttctattcctattgagctatcgagaatcaacaatttggacaccttgtaagtcctgttagctccatctatgaattcgaaaatatctgttctatcctattgtgtgtgtgatgaggtacctgtatcagggatttatcctgtaacatgattactggcccaattccatcaaccattgggagtttggagcatctattaagactgtaggttttgttgtccccatcttgtatgtatctattatagtgtcttacagtgtttgatgttattgaacttgtttgttcagtaacttgagcaacaatggtctagtaggattcattcctgcagaaattggcaacttgaggagtatcatggagatgtaagtatttgcttaggtgtgaattttttaaccatctagtcccataggtactataccccatatttgtggtttttcagtgatatgtccaacaatcatcttggcggtttgattcctcaagaactcggaatgctgcaaaatctgatgttgttgtaagtagtacctttcatgtcagccttctttttaaacccataaggacattgaatctgtagcctgagagacatctgtctatcattctcagaaatctcaaaaacaacaacataactggggatgtctcttcactgatgaactgcttcagcctcaatatcttgtaagttgaataaccagaaaatttttgaagcatatgctccagtatatgttttttgctcacattatctatctgttttatgatcagaaatgtatcctataataatttggctggtgttgtacctactgataacaacttctcacggttttcgcctgacaggtagtgtgctccatcatttccatcactatcatgttcatttactcagccttggaaatagcagtttaacaatgtgatacttttcttagctttttgggtaatccaggactttgtggatattggcttggttcttcgtgccgttcatctggccatcaacagaaacgtaacaaatattccattcatatcttacataattttttcatacctaatagacaaagtcaacttttcgttacctacattttatttgcagcactaatctcaaaggctgcaatacttggaattgccgtgggtgggcttgttatcctcctgatgatcttagtagcggtctgcaggcctcatagtccacctgttttcaaagatgtctctgttagcaaaccaggtaatgcatctgcaaggagttttgctcaacaaatcaactcatttctctcctgccaagttcaatattaggatactatcttgtccagcaattattgtatttagtcaattgtttgtttttacctgataactgggttaatggtagagcaacactaaagcgctgtatatttgctgtcacagtgagcaatgttccccccaagctggttatccttcatatgaacctttcccttcttgtatacgaggatataatgacgatgactgaaaacctgagtgagaagtacatcattgggtacggagcatccagcacggtttataaatgtgtttcgaagaaccgcaaaccagtggcagtaaaaaagctatatgcccactatccacagagcttcaaggaatttgaaactgagcttgagactgttggtagcatcaaacaccggaatctagtcagtcttcaaggatattccctatctcctgttggaaatcttctcttctacgattacatggaaaatggaagcctctgggatgttttgcatggtaagtgccgactgccaactcattgcacagtttgattgtcattgcaatttgcacagaagcaccaacatgccattctcaaaagcatgatatttgacacattgatatttgcttctgttgattgcaataccaaattgttacatgacatcttgttaccatgttaaaatcttttttttcattattctagaaggtccaactaagaagaaaaaacttgattgggaaactcgtctacgaattgctctaggtgcggcccaaggccttgcttatcttcatcatgactgtagcccacggataatacacagggatgtgaaatcaaaaaatatactccttgataaagattatgaggcacatcttacagactttggcattgctaagagtttgtgtgtttcaaaaactcacacgtccacctatgtcatgggaactattggctatatcgatcctgagtatgctcgcacctcccgtctcaatgaaaagtctgatgtctacagctatggcattgttctgcttgagctgctgaccggaaaaaagccagtggacaacgagtgcaatctccatcacttggtaactatgattcatgctcttgtgattcttctgttaatctgtcattttcttcagcttattttactttggattctggtagccctcaataattgctgaatgatgcccattaggcttgtgttcctacatggggaccaacaacatgaaacctatcctgtgagtagatctatttgcactgtttacgtgtggtggattgatccatcgcatatggctgttgaaagctccattatcaattgcagtgtttaagtcccctaaagcctgccacttttgtcccctgtcatcaattatgtggattgaaagctacaatttagtgtcataaaaattcctcttgcagccatttacattttttacgccttcacttggcatttaaccgacctccgacttggagagtcaccctaatttctcattgattttacatgcttatatggcttttcatttatcggttttccttgctaatgtacagactgttacaattcttggtctactgttgcaaatgcagatcttgtcaaagacggctaacaatgctgtcatggagacagtcgacccggacattgcagacacttgcaaggatcttggtgaggtcaagaaggtgttccagctggcgctcctttgcaccaagagacaaccatcggatcggccgacaatgcacgaggttgtgcgcgtcctggactgcctagttcgtcccgacccgccaccgaagtccgcacagcagctggccatgccgcagcggcctgctgtcccgagctacatcaacgagtatgtcagcttaagaggcaccagcgtgctctcctgcgccaactcgtcgtgtacttccgatgctgagctgtttctcaagtttggcgaggtcatttctcagaacacagagtagaatagtctgcagaaatcgtcatccgatcttgggattcaggcaagcagctggtgaagctaatcaaggtagtgaagtgaactcacgttttgtgactttgtccacatgttgggtgcccagaaaattaacaagagaattctcaagggttgtggctggtgttctttactgtaaaaaaaatgcgtcctacttctttcttcttcctttttttttatctcgtttttgtctaacttaggaggtgtccatgaatctagtactaaatctcaagacagcttcttctgttctgtaacatttctgggattggaatgctggaactggtattactaatagtctctcggtttggacaaattcgcagggtggtgtttcagtttcagcatttctgttttgcactaacatctgtaatggcatctgatacagtagtagtagcaatatagtactcctagtatagcatatggtatcctgagaaggtataattggtcagtgtgacacctgaattctctcttggattttctcatctcctggcatcgccatgtgcttgtattgtaccgttgtcgccgagcccatggaggcatcgtcagtcagtcagggacggtgtaaatgatgcgaggctgtgcagcgatgctggggccggatgggagagaacagtaggggagttcagaagagatgaaggcgtactgccatggctgcctgagatgattgattgatgagtgggccaaggaggatgggcaggggcggtgcgcaatgcagttctcgtgaactcggggtactgaactcaggacgcatattccaaacccaatctagtcgcacaaaagcaacccacaacgattttttgatggaaaaatattgagagtggaagggaaaatgctcaaacttagcccctatctggtactccaggaatgtagcaaccaagcagggattggacacaacttaatacaacgtatctgaatagatcacttgtttagtagctactccctccgtcccaaaaaaaaaactcaatctgactcctcttaggacaatgtatctggactaatgatggtcacatcccctcctagattaagctttttttaggacggagggaatagattctaagaatccggattctatcttctactactttcatcccaagatataaggagttttaggcttgggtatgtggtatttaaaaagtaggtggaatgaaatgtgagaatgttgtgattggttgagaaaaaaaattagatagaaaatttttaaatgctgaaaaattgttattggttgaaaagagaatgtagatggagaagttattatattttaggacagtttgaaggctaaaaattgttatatttttggattgtgtaacagtagcttttccgaatctagattataacttgggagttttttattctgagaaaagttacggtggccggaagctcctccaaataggttcttgatcacacttcaaagtccaaagatcacgattcctttgaacacatgatttttaaaacaaggaataggataaaagcataagaatagattatcacaagctatgtaatattacaggattttaaaatactatatatggacactataggtaacattttttgatggttcacagtaaatagaggaattttggaggaaatcatacgtggaagagtagagagaaagagagaatgtgcattggacttagcaaagaaaaataaaatatgaaatgtgagctcatgctaaatttcctaagaaatagggtgtaagaattgcaatacgtaggaatatttagtcctattcctttgatccaattttttgcgggccagacgggctggcatgcttgcctctggctcaacacggcccgccaaagtgttgggccgttcgtagtctccctgctcggcacgttgggccatcacagcacggcccgtttaaccaatcgtgcctaggccgtgcggcccgtttggcccctttccttttcccacgcttcgcccccacctttggctcctcgcgttcgtcgccggcgccgccgcgcagcaaccagcgttcccctccccctccggcgatgagctcaagccgacgaggcggcaaggaggcgaggggcgccgcccccggctgcgacgtccgcagccgcctccctcctcaattcgctccccaccacatgctcgcgagcttcctcctcgtcggccaccgccgaccatccactgcaagggggtcgccgcggtcgattcgagcggaacgcggatctcccccgccttaccagcagctggtccagctcgacggcgaagcggccgatccggcggtggcattcgacccagcggctaggtgctccaatggcgggattgctcggctgacttctctgaccaccgcctgctgctgctttcctcactctgacgatgacgattgttgtgaggattgtttacttctcttttacatatctcttcttaggatggggtattcgagacttaaaaaaaagtaatagtaaaacaatagttataccgttagtaaaaacatacagtttctaattcaaaatgcaacaaagaggaaaaaaaacaatagcaaattaattttcttgatttccatagtctgcacttttcttgcctccaaatcttctttgcgctcttatctgtattgctcatctattgtgcaatagagtcacacaacgtaaatgtaatgtttgcaattttaggtgcggtagcatgtaatcattataatttactaatctgattcagttttacacgttcttggtcttccctactaattcactactgttttttaggtcatgagaatcaagctgcactaggtgagaactagaaaattggcgtgcccttggcgctcttactacttacaaccaatgcatataggcatatagcttatggtcttctttatatgttggttaataatttatgaaaatatcatgaaaattttttccgcattgaacaaactgatcaaattaccacagattatgcaatcaattatttgatttacagcatttacaagctgatcaaacaaagaattatgcaaccagcacaaagattttcccaaaggaccacaaatcatactttatttcgcatcctttacatcatgtacacaacatttggcagattttcgacctactaggagatcagatcatcatacgaatcaaaatgtcatctttgcagacagttaagctcctacagctctgagcttttcctccttattcctacctttggttagctaatgaatcaaaaatggactgaaaatttactctctttagtcctgcagctctgagctatcttcataaagaaaaggggcatatgagggcagcagaacagcatccgcatcggcttgctggaaatttcttctgagaggaagaagagcagcggcggcatcaccagcgtgctgtccgacgacggggagctcgcgtacaatatttttgtgctgttaattagtacaaatttcgctttacaattaattgagaattgactaaactgaaaattataatattgctgcaggagaactttaccggctgatgtgtttctgctccattgactgacctatccaacccaaattttctctttggacagacattggttgtacattctgaagataaataaagggttatactcaaatatgtggagatgtctaatttctgaaattacaacgcaacggcattcttctagaattaagtggatataataccactgaatattcttgcgataagaaaaatatatgaataaggaattgagctttgacatgtgttcaggaaaattaaagcactaaggaaatgtcataaaaatttgactctgtagtatttattaaattgactcaaattcgttcgagtataacggaaagttagtgaaatctgtgaaatctgccttttcttctgtctagacataatatattatttggtgatttataaatcagtcatttaaaaaatcgaagtagctcaattaactaaaaatagactatcttattgatcatactcgtcatataactacaaaagagatgatcggcgttgagctatcgtcgctacaaattacagaaagttgaagtgtgtcaactggattttacaatgtgcatatgctcatatactgtcgaaaaattatccaacttctcagctctagccatgtattgtagtgtcttacttgcccatgtttgaatcaatttcttttgaactttcatgtcaacattgctaaagaccaccagttagtgctgacaaagcctaatttgatcaagttcgtatctatatcaatacatcattatatattaagggaataaccctgaaacctgtacactataaccggttagtcttctctggattcgcaccactggatacacagcctaaaatggacaccggtggttgaagttgtaacagatcaaaatgtcataacactggttttgctaattctttctccgcttttcactaggagaaatcacatcagtcaactccgccacttcattgagactaatcgcgacaagtttcgtctgaactgaggttagttcaggtagaagtgcaataggtggagaagcaaaggcatccattacattgatgctttttgtctgcaggcaatggcaaggccggtttttacagcactcacgctcgtcgtagcccctgttcttgcctggagaactgtctacaacagccggatacaatgccttcctgcagtttgttgggctgctggtggaatttgttgggctgctggtggcatcgtcaacagggctcagttctttactctgtgacttgttcttgtcgacagagcttggaagaagacccttgcgcttcttaggggatggaacttccggtttagtatgttgagaagacaacacatcatccttagcactcacaaggaaactagacttgctattgtcgaatttggtccctcttctcctatcacaggtaaacaataaacaagtcagcagaatggaatatatatgtcttctattaagacatgaaaaaggacctgccagtaattgctattagaccgagattaacgagctctcaggcaaatgtaagaaatgtgaagaaaattcaaggcaagtgcccaaaaatctaaatacttagtacttaataatgtttatcaacaatagtttgccagctggctaacatatgcatgtgaaagaaagtctttttgtctgtttgatcctgtgcttgcactaattacgtgccaaacacacatgatcatgttcagaagcacatgataaatttctgcttataattaaaatgccatataaggtcaattaaagttttatgcgaataacattgttggcaggtatattagcccattaagcactagtgctagtgctactgccaactgcagaagcaaagctacatgtatttaaatcagcaataaataactcatgtcgctgtaagaaaaagcaccggcagcagcaatattgcatggacattgcttagaagctgcatccatcgttcaaatcaagaaataaaatcattgtgatgcgtatagattacattaaacttgtttataccagtaatattgcagagtgtccaatggacacgagagttaacaaaggttgaatgaattagagaactaattgtgcttcctgtaacatgtctgcgggataacagcatgatcacatattctttggaagactggaacaatgtagtaatagtgtaatactaggtaactgcagagtgctcaacgcaaatataattaagcaatgtttttggattcttgagcattcaaaaggtatcctgctttactgtagtgccagacaatctgacgcgagatgttcctatggatcgatgggaacaatagctagcaaatttgtatgtatattcgtgaaagagaatactagcaccacctaacaaaactactccttcagtttggagtaccaaatatcaagcctgcacagctaaacagctccttagtccttccgaaaaccacgagctccttcagtaaaagttaatttttccacaatgtttcaaaagttcaatttcccgaccacattgttaaaacgcaagtaaaaacgataattaatcacatctgcccactcgaaaactaattaagcacacaacaacaacaacaacaacaacaacaacaacaacaacaacaacaacaacacatgctacttttcacgcatcatcaaaacgatcatccctcataggccagaaatttctcaataaatccccaaattagttaacgtaacatgtaaaaaaaacaaaaaaaaactcaaggatcagtgatcgacatatttcgacaaaaaaattccgaatatatatactgcaatagtacaaaaatatcaccctaagtcttcaaattttccatcggcagaggcacaggatcaatgattctgacaccaaatgaagcagaagtccgaatcgaaatttcagtaaatttccatctacactgctcaaaatgatccgagcagtgaaggcaccctcaacgatttcgctagaaaagcattcgaaatccaaaataacccagcacgacaaccaaagggaagctcgatatcttaaggcgcgcgaagctttgaggcggattgggggtgaaaaactgacctgcggctgcggggcagcgcctgctggagcgcgtccatggtgtccaggggacccctgtacgagctctccacctcgccgtcgctctcctcctcctcccccgccgccgcggcgtcctcgcagtgcaccatccccacccggctgtcgctgccccaccccgccgacgacgccgccgccgaggccgccgcggggcggagagctcccccgaggccgaacagatcgccgccgccgccgccgtgcccgcgcccgctctccatggtgatcggcattgctccctaccccccactcctctctcgcgaggcgcgagctcacatgcgaagagaactagagaagagaagagaggagaggagaagcggagcggcgcctcggagacgagacgaagggtggggggctcgagtcgcgtggggctttgcgcttgcgacgggtgtttcgttgggatttggcaccatggccttgcacacactgacgtgtgggacccaccaagtataaggcagaaacacgctctgctttggtaaaaatgctctagaacgttataaaactggcaaaatatggaagacacaatgtaaagagtagtaccattttctagtgtggggtgcatgaagtagcattgtattgaaagtccagtctatgcagtggcattttagcggttttctcgttgtttaagtttgtggattctcctaatagacgagccacgaacttaaaacatagtctagctcattacttacgcgctctcctctttggtctcaaaatctagatctaggttagcttcaattccatgtctcctttgctgtcatcatctcactatgttgtcacctgacctcaccgacactgataggtgtcaatgtgctagtgcggcttgctcgatcgtcctcctctccgccccatttgtgtcgatgtgctcatgccaccaacattgccccaccgccctatactgaccctggctccggcgctaacgccacctcgccgcccacctttggtccgccgtctcctaggctagccctctaaacccaattccctatctcccccttcccagttccaacctccacttactcaccctcgaaaccctaacccagtacttattgtatgatgtcgcttatcagaaagcgttcacgtcacatacacgtggttgaggattaggacatcaataggtttgtgggaagagaggtttcgacttaggtgcttttcagagagctgggtattctatgcaaggtagtaatacctatttggagctctaagaaataattgatactcctatatatcaagtcgtttgatagtcaatgtgtattttttttccttttagtatccccttccggcaatgccaaaaatatatttggaaattggatgtggtgccatggtaagaaagatggttctatttgggccagtgcactgcattgtttaatttggcattaccgaaatgatttttgacaataataaatcacctaatcctacgtgggttatcttcaacttcaactagcacaacacttggttgttgatactatcacaagaggggaaggatattatgcgtaatgatgttatatttctagataaggtagctatggatcttttgttccgctttggatagtatagtacatataaaattacttgttagaatatatataagtaatttgtcttaatttttaattcagctggttatcttttttagaggagttaactattagaaaaagcattttcgtcgatgttgggcttttttttcggcaggcgggtatggccatcggagcgaaaaccccgccggcgagaatgattactggggaggagttggccgtccgcctgtgaagatagcatatcgcaggaggaccatataaggtgccgcctgcgtaaatgatctttgcaggcggaccacataatgcgccacctgcaataatcgcaggcgggctccttatgtgtgctgcctgcaaagatgtattttcgcaggcggccccttatgtggtccgcctgcgaaaatagccctataaagtcttcttctttctcgagccctgttcatttcatccgaggtttctctctcccctaacaccaaaaatatagggggggggaaggtttttgaacttcaaatcttagggggatttttctacggtggttagatctacacctttacactcttgttatgcatttttttttataattttagaactctctttgtgatgaatctatgcatgcaaaattgtgaagaaaagctcaatgttttttcttttcttttttctttttactttacggaccaaaattctttgcaactgtgcctggaaaagttccaacttggcaaagcatttttggtcagatcatgcacttgatgatggtccatggaagatgagaaggttacataagtggtacatggacgccagcaagaaaggcctaactaatttaacaattcgatcaccgcctgactgcttcgccggcgacggttacttctagctagatttcgctgatctgcacaccatctatcgtcgcgataagatggacgtaaacttcgtcggtgcatggtgcctgtgagtatgagtgcacatttattatataaataaattgatataatacatgtttacatgtgattattattaacaaactgcttttataggatgtaatacatggatgctgagaagacaaatcaatctatcggatatctggatccaacaaggatctgtcaagcacaacataccgtgacacaatcaccaaattccaagcagctcaaggacaagacgcctgaagagatagaatataagaagggcttacacaaacagaagttgattactgtcgcacaatacattggatgatccttcttacgctttcaaaataaaagagtcattctagccgcgtacaactttaaataagtctagtaggttttttttacatatctgtgttatctcatccgtaactaactgcaccttccttaccatgtagcgatcattacatatgtttcattatctacccgaagcacggctccgtgacagtcctcgacccccttgattatcatcacaagacgtacaaacaatttctaacaattttacaatagtaagtgattctgatactcttgcatgtctactattaatatattataattaaatctcctccttaatacgaaacggtaaagaatctgtacagtgtgtacaactactacaagaaaaagggtggagagcaaattcaaaccagggagaagctgctaatacatacatattggccggtaatagtccacacagttaatatatttcaattatttttctaattacaaaatttaacttttttccttctatgatatgccattaagtgtcacaagcaacctagagacatggtcctttgcagggattacgcatgcgaattcctcagggttaatgggagatacaaggttaacgcagaggatgtaattctctcgactcaacgtataagtgcattagagaactacgcatctagaacctactatatatatatatatatatatatatatatatatatatatatatatatatatatatatatatattgtgcaaattaattaagacaagaaagctcagggtaataaatgcaataattagatgtgaaatttgttgatttatactcgcccactagcgatcaacatatagtgcccatagaccatagtaaaagatcggtagcgtgtctcccatggtccattgctcggccaaacaaccaccgaccaactaactaacctacctagctaccaacaacaatacaagatcgatccttcaaatggttaatgaggatacactgcctgataaagcagttgatcctgtgggagtacacattattattagctcactcttgcagcccacagatatttatctatgatgcaatggatttaaggacccatgtggtatttatttggattttgtgcgtctttgacacacaatggtttggtatcttcttcttcttcttcttcttcttctactactactactactactactactactactactactactactactactactattttgctatttatcgtttctcaagaaattctacctatgtgggtatctcattgttcaggaatcaaactaccaacatgggcacttttgaatttagaaattttacatactaatttttatatgaattaatttgattcccatggcacttagaaaatcattctttccaaatataagacttcagtatatgttttaccggcttttcttaaaaaagttgtcttttgtgcaagcaaaatgattttggccgtgaaatagccgtagccatgggcggatccaggaacaaaaaattggagggggggggctcaattacgcagtttctttaacctctagccatttaggggccttaaatttcattaatggtgaaaaaatcgaagggggtgctccagggggtatccatgggtcttgtgggtgcagggaggacttggtgtaggggggactcaagtccccgctgcacccacgttggatccgcccctggccgtagctcaactagttaggtttctagtagtaaaatctgtacacctgagttcaagttctagacttggtacgggtgttcatatttatggctagttttttaggtggtagggcgatgtactcatcaatagcgagatatctacggtgactttatcaattttaaaacataccaatttagtttttggagttgttcataggaatggttttagctatcacaaagatgtactaggggcttgttcacttttaacacccatatgtttgatttaaattcttaccaaattttgatagaaatttttcagagtagaaatttctaaaattgtcaaaaactggtaggatgagattggtaaaaacatgtttggttccttgccatactaaaatttgataataccgaaacatggtaggattagaactgacagtaaagtaaacacgcgctagatcttggtagtggtgaggccaaatttggagaacaaacacatactacccacacaaagaatgtacatccaaaacttaccccaattcaggtccactgtccacatggcacatacatatatactcctaagagtaaatcataaatgtgtaacttttgcatggacaaaactaatcaaggatcatgtgacgatctgtcgcacgtactacgtgcagccgtacacccccacataaatagtcatcgcatttaccgaagatgatttaatttgctcaacccaagacgatgtactactgctaacagcaaagataatagtaaactatatactctctccatctaattttaatagtcatatttctaaatctaaaaaatttacttttgataggcatatttcaatacaacaccctatcctcttaataactttctcgaatttaatgcgtgactcttcattcatccacacaagattaacgacatgggcatcgagaaatgtaaatattaatgaatcgcttttttacgagaaataactagtagcatgtttaaatagatgataagtataattacttatccttggtcattataccaagataaaatatgactatcaaaagtagatggagagagtacaagctatatgtttacgtagaagagagatgaagaaaagtgaaaagtgttcgttctcaaaataagtttaatagtatagccaactattaactctaaatcatccactggttttcttctatctggaactcgcttttcttctatcttcttttatctcttccactggtttatgatttgttattgtacttgctcttatgcaaaagatagctctatacgtgcttaaaaatatgcattaaatttcagaaaaagagagaggaggaaaaacatagagctaatgttaaagctaaattagtatacatgctacttttaaaatgaatttcaaataattagtgagttttactattaaactagctctaaacatattgtggccgggtagcccggatcacgttgccccagccgccgacagacgctggggaagcaatgactaccaggtgatcgatccagttgatgtgaaccaatctttttgtcacctcgttaatcaatcgattcaacgtacagtagtacgagcaggtacatgtacacgtatcgagctgcacatgcttactccctcagtcaaaaaaaaaaaagacaaaccctgattttcgtgttcaacgtttgaccgtccgtcttatttaaaaaaaatatgaaaaaaattaaaaagataagtcacgcataaagtattaatcatgttttatcatctaacaacaatgaaaatactaattttaaaaaaatttcatataagacggacagtcaaacgttggcacgggaacccacggtttgtctttttttgagacggagggagtatttatgccagtgtccttgcttgggattaattgctgtacttaactaattacgaggcagctaacacatggttcagatagatatggttcaggcatgtactgttaatgttggttgatagaattcaactgtcaaaaaagcttcattacatacggatagatatggttcacacttcacaactatcagtaccacggacttagaaaaaaagggtccatgattatgttgcagtagtgtgagcaattctgaatggaagtgcactgatcagaatgcagtaaagtaaaactatcactctgtcatccatatgggcaaaaagatttgagaacttgtattatactcatggaagaggcatctgaatttctcatgtactatacaacctgtcactcctgtgtatgaaatggcagagggtccatccatccacatagaaaaaggaatgggtgcccttgcgccgtaaacagatgctaatcttccatatgtacattacgattttgctttttcttttttcactttacaagttacagatctctcgatgtatatacatactatgatcctcgcctaatctcttcaatgtgtgcttcctcttcttactgtatagaagaatgaaataattggccgactagctgcgtttggtttccagtttcttcagcatttacctatgagcccggctacgttttgggcaatatcttttttggcctgcaatgagaccggtgaatcgccaatgtacataccgaacagagcccctgttcaccaagcaagagttaagtacagttaaaaacaatgaactttatcgtaccataaagatgcactaggcaagaaagtacttatccagatgcaagtcatggacagtgatccaagtgaagcgggtggaaaatattgagaaagtgtgaagtaatgaagtaaatttgtataagttttggtgtgacaagtatacacttactgcagaggtctttgctcttaacagcaccaatttgtctgccatcaactgcatgaaaatgtttttttttgtcaaaatatgtggatgtggcagtagaaaactcactcctcaagacatacagaagattcagttacggtctacggtacttactttctgttattagctggccatcagaagtttggcagaagtcgatctttgtaccctgcagttatattaacagtgtttacttgtatctaaaagttataaacatacggtagccaaatcctgtgttcaaccttaccgcaggaataggaatgtcttcattgaagtaagaaccaaaagttttcaagcaatgataatcagtgttgggattcatctgttgaaaatacaaatacagaagtcacatcagtatgaagaactcgtaaaagaattaaaagtatcagctgaagcagcaaccaacaagtaccttctggaggcgcaggccaagtgacttctcaaatacactgcgagaaaaacacaaaaaggtaaaatgaaacgtcttgaatagactaaagtcatttttttttatgagaaagtaacaatcaaacagatctttacaaacatgacaaatcaaagaaacattcaagcagatctctgtaaacataaaatgagagtactacttactctcgcactgcaccaatgctaaggccgttgtagtgaagtaccaatctaactctcataggaaggttttccctggaaattgaagatacaaaacttcattagtccccggtgcacatgtaatcatccttttttggaaagaagtgtcacatgcacaagaagtatcaagttaagaatcacttttcataacaagtagattcatatagactttcataagatcaaaatatcaataatgtcatggatatatgtatggcacatgaatggacaagtgtgtacacatgttttgaaatgtacgtagatcaactagcacaataacacaaacagttcaatttttaatacatcctgtggatcttgtgagggaaactaaacttgtgcaaacagttgccaaaaaaaaggtgcaagcactaccacatttatgtgtgctaagcatatgaataggcagaattgtaacaacaggacaagactggagatatatatcgaggtcctacctcaaaagatcatcatagaaatctgggttgtccttcaagttgatggttggaacagaagcatacttaggtcccagcttctcagaaatagtattcggttgcagatctatcaagaaaaatgcatggtgcaccgttaaaaagaaatgatggaacatcagagaaacatttttttgtagaatgtacaggtaaacaacataatagaagcacaaaaaatatttactcacataaaccaaaagcgtacagatccaaatttttgaccctcattactttcacacctttgaaacccatcccaacaaggacctgcaattaattatcaataataatgttacatggagacgtcacactaagaattcagagaaaaatgatatgctgatagttcagaagtatcacattatatgtaaaatgaagactaaactgaactaactcaattcaattgtccacagatcatttgtagtagtgtacaattttctgtatacatattaaatcaacacataaaataaaactatgtgattcaaaattgtcagaaatgaattaatccagaggatttcatttccagttcataatacaagtatattggattttacatgactagcctgcacgcctattaaagaggaggtacacagagaagacattcatgataataattttacgacataacaaataagaaaagtgtaccaaaaggcagtacctgaaaaaataaggtaaagtatcccagcaaaataaggtaaattaccgttgtagatggactggagtcatcttcgagaaatgcaggaaacttgattccagtttttggttcaattgcatctccctgaaatattgtgcttggcactgcaacagatctactttttatgcatttgtcctccagataaggcttatccataggtctgctgacatagtccttgatatttcccagtgccattgactctgcgagcgtcttcagtgatctttttaattcatacagtgaaatgaacagtcagtgagatataagcatagagcccaagcaagagcagggcacaaataaagtgtcgtactgtgtgccttacatattttcaagagggggtacaatagccatggcaccagccagagtaagaacattgcaggcatgttgctgctgaaaatcattccagagtcgcccaagtgttgtgcttgcgaagttagctaaaagcagttgtacagcatgctcttctcttactagataaccaaactgcaatacagccaaattttgcatacgggagctcaaatgattgatatgtgactggcaagctccagagctagggccttccatactcattagcctacgtaaattcttgggattagacactctagaaagccagtagcagaaagctctggcaaacttgttgaggcgatcaaatgcttcctgaacaatcaaatttcctgaagaacagatctgcctgtgctgtcgcaaagaacttcccaccattgtaccggcatgcgtaaacaagctcaacccaagatcatgagacattggaaaatctgagggaaacttgtgtaggtatcccaaatcatggtcgagattggacaacattaaccgatcggccttcatgttaaaatgttattcccaatataatcttcagaatgtagaaagtcttcagagaaagcttttgaatgtacggcgaggaaaaactttgtgatctgaaaattttaacaaaactatggaagtcagctataaaacctcttttacaccgtgaattgcacaaacagcatctaataaggaggtgatacatattttgtgaaatttaaaaaaaaaacaaatttcacatcatctattgaaaatggacctgaaaatgagttgtccttcaaatttacccttacaattgccaggattaaatgataaaaaataacactagctttctttgttctcatatcagcaaatagaactttactttgggaatactaagaatgcccccattatatgaaatgcaaataccatttgcaaatattgacaaacagtatcaattcaatcaatctaatcggaccctgtaactacgccagcaaatgcacaaatttacgccctacaagccccggagaacaataataagcattcccgtaaaaaaagaaaagaggaaaaaagaaaatccaatttctcctgaactggatgcattcgcaacgatccaaacctggccgatagactataaatcgcgccgtgtccagatcagcgcactggaggaagaacacgagaggatccgcgagtgccaccccccctcgatcgatcggttgcggatcaaccaaccgaccgaccgaatccgaacccgggggagaagatgggggaggggaatgggatcaaaggcaaccgccctcctccgaatcgccctcctcctctcctcccgtgaggcgagagaggcgaggcgaagaacgcgtgctcctcctcctcctctctcctctcctctcctctcctctcctctcctctctctgttttgctcttcctaattcgaggagaaggcgacaaagagctcaataaaagttccctccctttttgttttccacaaaagttctagaacaaattgttatttacatataggtcctcgtcacgtgcgaactggtccaggggatggggaatagttttgtttttggataagtttagggggttatgcgtaagaatccccgatggtttcggagaaggtgcggtgcgggggggatattccggcgggggagatcggacggtggggagccgatggtggacggagatgcgacaggttaataataaggggaattgatccgcgtcgaccgtggagacggggcgtggacggcgcctgaaacacgtttaaaatggaccgttattttgtctttcttccttctggacacgtgttggcttctcctagtaatttgataatttgatttcacatattactttcccaaaatataaaaacctatgattagatagaacataccataaaattatgaatctagataggggcgtatccatattcgtagtatcatccggttttaggttgtaatattttggaatggatacagtaggactctacgtcacttttgacttctcgatttttaaatgcttcttcattcagacttaaagttaaacattttaattttcaccatcattttttttataaattcatatagtttaatatcgtaatatttgtatttcaagatttatataaaaaatattttcaacaattcatgtattatttaactacattaacttaaaaaattaatagttacagataagcatgtttgacttaaaataaacctaaaatgatagataatttgaaacatgggaaatcaaatcaattcaaaatcaatgcaccaaaatctcagcatttttagcaaatcaggtgcttaaaagggaaatcaaatcaattcaaaatttaaaatttaactaccaaggtgactcagagaatctttcgtctcatccttattttttgctaaacaattttataatgcttatattttagaaacagggagtagtaaaaaaaatatggcaattgagtaggcaagtgatattaaatgataagaaagtaataaattttgatttgtacgataggctaaaatttatgtatcatgtatatgtataaagttgatccccactaagtatagttaatgctaattctcttttctctcatgaagccacatcaacttaattgtttttagcttttggatgatttatcaagggtgtaaaatgcatctcttcacatcaccttaattgttttaagtcttttggatgattcatcaggagtgtaaattacatctcttcctcctaaaaggcacatcatacaacctaatcatttataacctatttataacctttggataattagtaaaggtaaagaaatatataaacacatgaaaaaaaatggtatagtaggtaacaaagaaaattttagaactcgtgtatactatattatcacacaattcttccgcagcaacacacgggatacccatctagttttaataagttttgaatgctagaagacaaagggaatagtatatacacccatactttaaccggatgatccatagtttggccctctttgtttaggcttaggcttattggcctagacttttaagtcagcttattggcttatatgatttataagccagtggatttaatgtcctaagtttagtggtggagtcatacatctatctcatataagcccaaaaaagcttctccaacctaacttttggcttaatagtgttagagtgacttatggcttaaaaaaaccaaatgaaaaggttgcttgtttgttttggcttagacttttcgacttataagttggcttaaaagcctaaacaaagagggcctttaactggttaagataaacaatagtaaacgaaaaagcttatccagattcatactattattagacgacgagcaccttatattttttggatggaggaagtattaggtatgattgttgagcccatcccttgttcctgtatttttattttctaccaagtcaaagcgatggctgcttatgtaccactcctaacaaacatgtcgagaatggaagttgacacctagccgctagtaggtactgcaagcctccaacagaagcggctacataccagccagcggggacgatgttccagatgacacaagaacaacaaaagctacataattcaggggaccaagcatttgctggctgcctggctccattgatccatacacaatcacacgcaacatgccagtcgatcattggaaggccagttttcagagaaaaacacagtaacaacagaaggttacagactacgggagactcgtccatgatcgcatcagcaagctgctgactcccaccctcaatatcaaaatcaggaaactaggtcagagatcatttgttgttcacagagaatgtgacatcagtttcagtttaagaactgatggaagtgcacagggcaacgacgagtgcacaaaaacactaggcatgtgctccggctccccagcacgaacaagaaacagatctacttatttcaggcaaaggattatctagtgacatgtcggcagcacatgagctttcggtgttaaaggcagagatagtctgcatgcgtacatgcttttctgagacacctgcaaaacgttaaggatgccatgagggcatgtctgttgatgatagatatgcatgatctgatcaatcattatgtgtattgatcaaaatttttaatcaagggcaacaactgtgtgcgagacattctgtatcctacttcaggaggaagattatctacctaagcaaatagcatggatttcacagcttctaatgcgacttgtttagacaattaattaggataaaaaatgaaatgatgacgaggagtggtataaggtgatacattgtgaacttcatccgtttgccatcctttctgatgaatctaagcagactgacagaaaaataacataatgttatggtctggagaaggatacgacttataaacaatcaaaattatattctacacagatgccaatgaaaattataatggcagatgttaagaagtcatgtagggtagtcatacaggaagtatccgtgtgcacggctgcatactagaggtgcacacagccacagggcaagagaagttgacatcttaccttcaagccatatgggtaaagatggctttcacatcttcaaacacctcaggggctggttttgtcgcatcaatctgatcaaacaatggattagctggaggtaataaaagcgcatgcgttgacaaaacataccaaccagaaactgatagagcacgtgcacaaaaatatggccatatctgatgatggtgatcgaagtagtctccaactgacagataccattttaacacaaagttcttgcacttacttaaccttcccctgtttgctgaactgaatatcatatttctttgtggcaatgggactctaatcatgcagcgcaaatttgttgctatatgtggagtttcagggcctttattgtacactttctgacatagcatttgcacaatgcaacaacttaatcgagtaatgaatcaagtgatgagaaaggatagaggccatatgttaattcaatcacaaacgatcaattaacataccctgaaaatgacaatctacatatatcagacttaagaaaacatccaatcagctcacaaatatgtgtgctctactcaagggttttatttttccccatggtccctgctaaggatatgatatgttgtgcatcactggctgattgcagtgcacaaaacgagatcagagtaaaccatgctttattccatgtgtactgtgaatttcaagttttgaccctgaaccatacagcagtttactatatgatattgtgtgattatcttaaatgatgacaagtctataaatccggtagggagaataaactgtactgcaagaagcatgcataaccattacaaatgtacacaccttcttaaccatgccttttgactcataatactcaatgacaggcaagctggattctacaaaaactttcaatcttttcctgatagtctcaatgttatcatcacttcttccctgcaaggcaacaagaaaaaaataatgtctgaagaaataaatactcaagtgattgtgtcaaaatttatttaacaaattaatatcagagaagaagcaaacctggttgcgacccaaaaggcgcctttccatttcttcctcagaacaatcgaaaaatagaacaaattcaggagatatgcttatctgaagcagttggaagtaagtaaccaaggtctgtaattgcttttaaaatgtaaaatatgaacactaacatacacataaataaaattctcctactgctctattcaaaacaatgaagactaagtaagcttacaacactctcaaatacaacacgattctcttcgttccgtggaaatccatcaatgatatacttgtcatttccaccttttattatggcttcttgcaaaagctttatggttatctcagatgggacgattttcccttccgttatgatagtgtcaatcatggttctgcaaaatatagaaccagtaactaagtgagtgaaacaataaatatggcatgtgtacatgggcaaatgcatgtgtgtgtttttacccgttctctgaaccagaattgatttctgcacgcaagagttcaccagcgctaagatggataaaaccaaaatgctctacaatattgctgcactgagttccttttccacttccaggaccacctgttcatggatgctacatcagattaaacaacacacacacataaatacagttatgaattaacaacagcataagaaggaactgacagcaagttcacttttcttctataaagtggcagtcaaaggcatgaaattacttctaaagaatagagaaaacaatacctagaacaaatataattttaactttcttgccacccaacatgttctcattaatatcctgcagaaggacaatttaacccatcagattgtatgaacacaaaaagataagcatgagggtcaaattcaggatccaaatcaaattggtaactgaaatggctggctgacttacaggttaaaagaacaagtatgcataaataaatactatgtaaaatacatatccatgggatgcatggatttaaccatattctctcacgatggaatgaactgcagatgaatcctccaggaatctgataagaactgcaaggtaatgtaagaaaaaactaccttcttttcagtaaggacgtctggatcatccatggctgtgctcatggctacaagaatacccccatgattcagactaaacatcaagttggtgcataagtattttgcaatagaaccaagaaatatgcatcattcagaagtataaagcaatagtgcaaatgtattcaacattgcacatgcatagcagaccacaaagtaagaactatccaattctaggttgatcatgaagtccagaccctttcatggtgcacagatgtgttggtttggtccaaatattgaatttagctcacggcgcaagagattatcccaccaatttcctgccaacaacagtacaccaatccccgaagaccactaaagacttcgttcgagggttttagtaaacctctcccccctagtaggttagaacttagaactaaataagcaaagcagtagttaaacatcgacgattctcacatcctgcgagaaattttcaatctaatctacggactacagcaaatcagatcgggaacaagaagcgtggcgcggagagagaagggccggaaaacacgcaccccctaattcctacctgctgagctcgtcgctggagaaaccaccggacgagagggcgagggagtagccgcgcagaggcgaccagacctccacgcatccgaggcaacctggcggcggccgggcggcgagccgcggcgaggggcggaggtcacttgccggtcacggtggcggtggcggcgacggcgaggggaacagagaaagtagtaaagaagaaaaaaaatgaatttcttttttggattttaaaaagtggccgacgaacaagtcaagtcggtgctcggggcttgctcgttttgattcgtcagacttggggtagacggttacgatttaagacaacaactagaaaaagcgcggctttgtcacgcatggtacagtgagcctggccaattgggcctgtaaaaaattaaaacacatatgtaaaagagccgtattaacagtaaagataactaagctgtttatattagagcttataagttggctataagattatctctatatttcgtttcctctctttatgttacttataagaatttaatatatttaccttaaagcatgtgtagagctagattttacttgaaagccaacaatattttttaaaaaaatctttatcctccacataagtttatagtccactattagtctattatctttgctctaagagcaaattttataagcaagttttatagcaaggtgattaagacctctaatttattcatatcatcaactaactaattaagatgtagcatactggtttcaatttgcatccaaaccacaccattcttttcttggagtttgtgaagaaattaccacttgcatgaggggtggttacttctcgtatactatcttagagctcatactacacctaactacaaatatgtagtctacttttgttctctcttcttcgttattcaatagctagcttattgctaataaagggacaaataaaggaaacgtccatcatttttcacccacatgtcggtgtgtttttacataaaaaaatctttagaaaagttaccttttaaagaaaatcatatttcaatttttttcatgtttgaaataattattagtcaattaatcatgcgataatggctcacctagttctatatatctccttaatatttttatctcctcttaaacatagcctaaggtatgtttggaactcagaaaaacaaaatacatgaaataaaatatttgaaatataaaacacataaatacgtgtgtaaaacagaggaataaaaaccatagaaagtttgaaaagatggatgtttggaacataggaaattttagtggatgatttaactatatcctgctaatccgtattattactttgatccacaagaaatagcggcctgcctgactaagctttgttgccagctgttcggtgggaatgtgagaaatcaacgtgtttgcactacaacatgtatgcataccatctcgtctcttccacgtaaaggcgacggattgggaagaaatttctggacgcgcacgcacgcaggcaagagcatttcatcgatccctgcacgcgcggacgcacgtttcgtcgtcgagcctgcaaaaccggtgttgccacgtggcaccattctccttccgttttttggcattgaattcgtattataagattctttcacagctatcggttcaagtggctaatatgtgagccagattattttaacttataaatagattcggggattagtcatttacatatttattattatgctagcttactgctctacgcacattgtgacagtgataagctccactagaacaaaagctttagttttgtgttgggtttcattgggattttaggtagatttggttcagtataatagttaagtttattcagggccacacaggcccccaatcttaaggggcccaaataacttaatacgtgtcacaggaccattagcccaatagattaaatctattgaaatgtgcaattggaaacaaaggctgagcgagcacgtcgattcgttttcggcgcgtgtgtcgatttgagcgtcctcccgtccgtctaccccaatccatacgctgcgccgctctcgcactcgcactcaccgtctcgctgtccagctcgacgctcggctgctcgtcgctcggcttttggccctcgtcgcttagagcaagataatagtataagataatagtatagctcactttttactattagactattttaaagctaacatacataatagattggctataaggttggctataattttcttcacttctctctatctctcacttatatatttaatgaatttgtcttggagattatgttaagctagctcttgcatgagagccaaccctcttgattttttgttacctctcttctccatataagtttatagtagatttatagctcactattattatacttgctcttaccgtctgcacgtctgctgacgtgccgcagtaaagcggcaaggtagcaaccagcgagcaacgtctttgggcgacctccccggcgatatggcagcgagcacaagcggcaagcttagctgccctgcacacaccagcaaggatgccgggtacatgacctaaatttttattctgatcgctaggtttatggtgtatctaatatgtatactagattaaattttattcatcttgtatctatatatgcatagatttaagtagtatttcaacttctaagaaatgtcatctgcaaatcattgaaaactttatttcaagaaatactaaaggaaaaagaaagatactttccaattggagattatgcacaaagacaatttctattaagtttatattgctaaaatatatcatggagtgtaagtttaccggtttattttatcgcttaagttagaagatttcacacggggcctccaaatttcatgggacggccctgagtttattaaggagactgttaatattatgtaattttggtcaagtaaagatatatggaataatatctattttggtttttatatacttttatagtgacattcgtgaaccaaacgagcgcctaagtcccaactcccaactagctaaaaaattgtcaaacaggcccatacactgctgctctagttagcagcctctggggctacatacacgacacgtcttaaggattacgaattacgatgaacaaataagtttccgccctctactgtcaacatgtatcaatacgatttgtctgctagacaactagagtatcaaatcaatgttagcatttcccaaccgatcaaagacaattagcagaagaatacttcgagtacgatggatttcttcgctattactgtactcgccgttgacatatgattccgtaagaaatctatgagctggacgcttgctcttgcgtcaagctttcttctttggtgccggaactccggcagctttacatgaatatatatatacactcatctgtttcaaaatgtatagcgttattgacttttcgcataacgttggactatttttttatttaaaagtttagtacaaatatgtaaaagtataataagttaatattatattatatttgaagataaaacaagccataacgaaataaatgatatttacataaacttttttaataaaacgaatggttaaacgattgtgtgaaaagttaacaacgtcatgcatttgaaatggtggaagtatatattaatgcattaggcagcttgtatatatcatgtgtttacgattgattgactgccatggagttgagtaagactctgttagtcaagcaagaaaactatggcacaaatggtatccatgcatgcacatatctcaagcgcgcgagtgccttggtgttcttgccagttgccacactccaagtgaaaaaattatgcaacgtacgaattgatggaggcgagcaaggcgaagcgcagcgtggccatcgtcggcgccggcgcgagcgggctggcggcgtgcaagcacctgctggcgaggggattccggccggtggtgttcgagtcgggggaggccgccggcggcgtgtggaggcggacgctggcgacgacgaggctgcaaacgccggcgcaggcgtacaggttctccgacttcccgtagccggcggcggcggcggcggaggagttcccgcggcacgacgaggtggccgcgtacctcgacgcgtacgcgcggcggttcggcgtgcgggagcgcgtccggttcggcagcaaggtggtgagcgccgagtacgccggcgtgccggaggaggaggcggcggcgtgggagaggtggtccggcaacggcgaggcgttcggcgacggcaggggtgagtggcttctcacggtgcagcaccgcgaatcggagaacctccaggttggtgaatacgtgacggcatgagcacacagaaaagtgtcattcctgtcggcttatcaccgtcagtttggcttgagccgacggggtttctcaatcactgtcggttcagcaggttgatcgaattttcccgcccaacccacttgataatcgaaactggatgtcaaataatcgaaacccattttaatgagtgttaaattatcaatctctcgcatagtatggtaacaaatgacttgtcaacggattcacctcgcttatcaatccacagacatataagttcgacttcgtgatcctttgcattggacggtatggcgttgcgagcgttccaacatttccacccaaaggagtacctgaagcgttccatggacaagtgctccactccatggactactctagcatggaccatacggccgcggccgagctgattcgcgacaagcgcatagccgtggttggttctggcaaatcggccttcgacaccgttgcgcaatgtgccgatgtaaacggtgagattgctgcaacagaacatgttcaccttgatcacattttccaaattgaatttgaatttgttatgacaatttttaccgtatgatatataatctatctatctattatattattaaaacagccttgaaagaaggcaccacattcgctgtgggggctagaaattcccacattaatcgaagaaaaagaaaaaaagaaaaagaagagtccaagtagaagtccaatttaaaaatagctgaaattcggaattaaaaataagcaatattgaaagaagtttccatataagaacccaatacgatattaaccaaaattcgaaataaaaaaaaataaaatccaaaattagaaaaggaaaggagagtccaagtagaagtccaatttaaaaatagctaaaattcggaattaaaaataaggaatatcaaaagaagagtccatataagaacccaatacgagattaattaaaatttaaaataaaaataaaaataaatccgaaattataaaaggaaaggagagcccaagtagaaatacaatttaaaaatagctgaaattcagaattaaaaataagcaatattgaaagaagtttccatataagaacccaatacgagattaaccaaaattcgaaataaaaataaaataaaatccaaaattagaaaaggaaaggagagttcaagtaggaatacaatttaaaaatagctgaaatttggaattaaaaataaggaatattaaaagaagagtccatataagaacccaatacgagattaattaaaattcggaataaaaataaaaataaatcagaaattagcaaaagaaaataaaagaagagttcaagtaggaatacaatttaaaattagctgaaattcggaattaaaaataagcaatattaaaagaagaatcaatatatgaacccaatacgagattaattaaaatttcaaataaaaaataaaataatatccaataaaataacaaaattagaaaaaaataaaagagagtttaagtaggaatacaattttgaaacaactgaaattaaaaaaaataaaaacattaaaagaacacaatacggtattaactatttttttaaaaaaataaattatgaaattagaaaaggaaaaataatatttaaattagaaatacaatttataaataactaaaatttgtgataaaaataaagactattgaaagaaaaaaccatctaaaacacataacgagataaattaagtaacaggcctataaaagagtagagtgatggcggttgatacgccatataaaaaatgttaataaaacaacaaatagaatcctaatgacgattataaggagggacgtcgggcatgccgtgaagcaaacaagtaaggcagtagccgggacttctagaaagtaaaaaaataaacccattgataatcatattcgatttttaaaatctcaatgacaataaaaaggagaagaagcgggcgggcgtataagagtatggttgcagagccgccgacggttgacgggacttctagaaaataaaaaatgaattccaacgatagttatgttcgatttttagaatcacaatgacaataaagagtaggcgacggacgggctgtagaggggcatagtggcatcgttcaaattttaaaggttcggaacttccaaaaagtaaaaaaaacctaatgataatcatgttcgattttaaaatctcaatgacaataaagaagagaggcagcgagcgagccgtagaagagtacaatggcaaagccgctgatggtttgacgggacttaaagtaaaaatgaacccaaacgataattatgttcgatttttaaaatctcaatgacaataaagagaagagacagtggacgggtcgtagaggagtataatggcaacgtttgacgggacatctagaaattataaaaacgaaacccaatgtgacaataaactctaaaactataaaatacaaattttaaaggttccaaaaagaatgaatagaaatagtgatagatcgagtaagcaaataaagaaagagatgacataaggggtagcaattggtgtgacttttaaaaactatataattagaaacacgaggatgataatggtgtgacttttaaaaactatataattagaaacacgaggatgataatgtttggtctttcaaagtcttaagacaatgagatagctatttaataaattttaagtaaaatcatactaaaaatatattattttgtttgggtgctagccgcataattacgcggccacccattctctattaaaaggacaaatttatcattttttataagttactcactttctaagtatctcacatacgtggttgtcagggagcaagtacccatgtacaatggtgtacaggagcccacagtggatggtggatgcagggcttgtgtggggtgtgaacctccagaaccttaccacgtcacggctggccgaggtgatggttcacaagcctggtgaaggcctcctcctgagtcttctcgccacaatgctgacaccactggtagcactcaaccacagttaatccatcttgtaagaagaaacgctaaatagatcgtcactaatcgttaacagttcaatttcacaacccattgattccttcagagatggttattgtcgaagctaacggagatgtactacaagaggcacacaccgatgcagaggcatggcatggtgccaggctacagcttctcacagtcaatcttggcttgccggctcggcatcctcccgaagagattctacgaccgggtggacgatggcagcatcgtgctcaggaggtgtgacccgtctttcagcttctgcgccggcgggctggtgctggacgtcgccaccggcgaccacatcgtcgacgccgacgtggtcatcctcgccactggcttccaggcggaccggcagcttagggatatattcgtgtcgccgtggttcagcaagatcgtcgcagaatcttcagacgccactgtacctctgtacaggtcattgcgtttcaccaatcactatgtatcgcagaatttaactatgtcagtactttcttaaaaaccataaaattactgtaatatatttttttcttttgaatcatctctgagtggtgtgatttattgatcgacagacggtgcgtgcaccctcgtataccacagatggcgatcattgtttacgcggagagcgcggcgaacatctacccgtacgagatgatggccaagtgggtggcgcaccttctcgatggtgcattccagctaccgagcattgcacgtatggagaagagcgtggtggagtgggtttgttgggcgcatgatatgaggaggtgtagcggcaactacttccgcaagtcatgtattggcaccatcacaacgtgggataatgatcagttatgccgcaatatgggatacaacccaagaagaaagaaagggatagttgcggagtggatagagccctatggagccgctgactatgctgatatctagtcaccatgtgtcacaaactgaataataataataataataataataataataataataataataataataataataagtggagagttaattgtatttcaaatgttgcacatatagaccatgacaaacatgtggcagcaatggtgaaatttcaagtataacttaaaagggataattgaagagagtacttttcatccgttctataatataaacatttctggttataaatctatacggaagctttgtcagtgcttaaaagtggaatatcgttatcccatcccagttaaaggaagagatgtgtaaaagtacccaaaactgttgcttgccagtttatgagcgctgcacgaggaagcatgttgttgtgaaccttttcagcttggtctagagcatggtgcttagggctgtgtttgcaatcctggatttccaacccctctccatcatattccgcgcgcatgtttttcaaactgctatgttttcataaaatgtttctatacgaaagttgtttaaaaaaaatcatattaatctatttttgaaaaaaaattagctaatatttaattaatcacacgctaataaatgtacactgtacatgttgggaacttaggattgcaaacacagcccggtggtaacggagccaaactttttaacctacaaaatataaagaatgggtccaaagagattggagtaagatttaatagatttttaaacttcccagaagtacggatttaaagtattgagatgggttctgaaagggcccgtgacccattaccacctactgatgctcgatggatgatagagttgttgtcctcattgtttatccgtagctttctgtaagacattattcaattattaatccccaaaaaaataagaaggatatggtgtaaaataattctcccttaatgccctctaatcccttctctaaggggattaaccccaacaagggcttaggccatgttacattactactatatatctactccctccgttttacgatgtaagtcattctagcatatctcacattcatattgatattgatgaatctagacatatatatctatttagattcattaacatcaatataaacatgaaaaatattagaatgaataacattgtgaaacggatgaagtatataaatgttcaggctggctagcgcttcaatattctatcgatggatgcgaccaagaagcgtgtggccatcgtcggcgccggcgccagcggcctgacggcgtgcaagcacgcgctggcgaagggcttccggccggtggtcttcgaggccgccggcgacggcgtcggcggcgtgtggaggcgcacgctggcgtcgacgaggctgcagacgccggcgttcgcctaccggttctccgacttcccgtggccggcggacgtgtcgggcgccgaggtgttcccgcggcacgaccaggtggtcgaatacctcgccgcctacgcgcggcgccacggcgtgacggagtgcgtccggttcggctgcaaggtgctcgccgccgagtacgccggggtgcccgatgaggaggcggcggcgtgggaccggtggtcggggaatggcgaggccttcggcgacggctccggcgagtggcttctcacggtgcagcaccctggatccgaagctacccaggtaattaagttcacgtgctacttgaatttttttgtcaaatttatttatgtttgatttgatcaattttatagaaatatttttaacacaaaacaaacatatattcaacgttacatttaatgaaactaggttggtattgtagatgtttctaattttctcatcaaattaagaaaatgactacgaaaagttaaaacgatttataattaatatgaaatggagagggtagctaccaatttcaagctcatttcaattggtttatcacaaattgcacacgtacagttaaattacagtaacatttcaaacggaacttgaaatatatgatcagaatatttcaaagagaaatatatgatcagaatatttcaaagagaggtatcttggtgtacagatacacagggtcgatttcctgatactctgcactgggagattcagtggagttgcccacaccccaacatttccacccaaccgaggccccgaagtgttccacggccaagtgcttcactccatggactactccaacatgggccacgccgccgccgacgagctgatcagaggcaagcgcgtcgccgtcgtcggctccggcaagtcggccttcgacacggtggcggagtgcgccgctgcaaacggtaagatccacatttcgcggcgagagtaattaatcgatctgtgatgaactgttgagcgtgcgtgctgcctgccatggatcaggtggcaggtatccgtgcgccatgatctgccggagcgggcggtggatggtgaacggcgggttcgtgtggggcgtcagccttggacacctcttctgcaaccggctggccgagctcaccgttcacaagcccggcgaggggcttgcattggccctcctcgcaattctgctcacccctttggtttgtgatgttacacgtttgtgaagtgatagatcgtacattaatttatacggttgatttttttaatttttttaattatttaggtgacatacatccctcgataatttagaataattttcccaattcaacttgattatgtatgcatttttacgatggtatttatatcggtatagtagaaaaaatttagatctttcgtcttttcttttttatttgactggttactagtattaccgtagctattgcttgtaaataaataacctcatcttttcgcttatgcttatactcagccaaaatttaaatctttagccttaaatttggagttgattttgaggtttttttcatcgaagtttatttttcagcctttgattttggatcgctaaggacacatatataaaagttttactcataaattatttttcgtatacaaatatgtcgtttggattattccatgaataaaccaaacgatggagccaaaagtagttggacctttttaagggacaacaaactattttggaccatttacggaacatcgatccaactaggcggcggaaagatatattgatattgaaagcatactagtatcaattattgcatcccaattatggaagaaacaatgtttccttattttaatgtgtacacattcgaattatgtataacagacaagtaaattcgaaaatttcaatatccatgttgtaattttaaaatgaatttcaaatttgtaattgaatttttagcatagttggaattattttactttattttttttagaactactactctatcaaaaaaaaatcaaaccctccgtccaaaaaaaaaaagacaaaccgtagatttccgtgccaacgtttgactgtccgtattatatgaaatttttttataattagtattttcattgttgttagatgataaaacataattaatactttatgcgtgacttatctttttaattgttttataatttttttaaataagacggacagtcaaacgttggacatagaaaccatggtttgttttttttttttgacagagggagtaggttatatcaatagtagtagtgtatttttcaccgggcatttcttcgatataatagtgatgataggattctactaagaccagaaaagtgctcacgaattttaactatatcaagtactagctgttttgatactgaaaatgcttttttttgtttcagagatggctgctgtcgaagctggcagagacctacttcaagatgcagatcccgatggagaagcacgggatggtgccggaggagagcttcgcgggatcaatgtcgggctgccggctcggagtcctccccgacaagttctacgacagggtggaggaaggcagcatcctgatcaagagggcaagatctttcagcttctgcacggacggcttggtgctcgacgacgacgacaccggcgagcgcgtcgacgccgacgtcgtcgtgctcgccaccggcttccgtggcgaccagaagctcacggacatgttcgtctcggcgacgttcaagcagcagatagtagcagctcctctgtacaggtgatactccgcacatcgccgtcaacgatccgttcgccggcgagccggccagcgtctcgccgccgatgagcattcattcgttcgtgcaggcagtgcgtgcacccgcggatcccgcagatggcggtgatcgggtacaccgagaacctgacgagcatctacaccttcgagatgatggccaagtgggtggcgcacctcctcgccggcgcgttccggctgccgagcgtcgtgcggatggaggcgagcgcggcggagtgggacgaacacctggcgatgaggaggcacggcgagggcggcggcggcaagccgtgcctcggcggcgttagcacgtggtacaacgacgagatgtgccgggacatggggtacgagccgaggaggaagaaagggattcttgcagctacgctggtatcctctgaagtctgaactcaagtgaaactgatcagtgatcgatcgatcactgatgtgttgatcacgagtatacgataaaaaagaacatgaactttggaattgttgggctttcagaaaggggaaaataagttgggctgcgatatgaagaggaaaataagtcgaggaaataagcgttgttccaaaactttgttgcatcgcccatcgttcttctgcaaaacattgttcgtgtatatctatttccgtctggctaaaatctaacagagagcacgataccttttcgagatatacatgtgtgatgtgtctgaaaaaaacaagagtatatggcctcatttgatttaaaggaaattcataaaaattttagagaatttcattcctatagaaaattttcctatagtgctttgaattaaagaaataaatcttatgaaatcctatgatttcctatgtaatgcctaatggcatgtaaattttgttggaaatctaacatgaggtagaatctcatggaaactttcctttgagttttttatttctcatctaattcctgcattttttcttacggtccgatgaaacggtcatttctatgttttgcaatcttctgttttacactcacattcatattaaaatcctatgtttttcatatttttatgttttcttaatcctactattcaaatgagcccaaaatggtgagtcaacagtgctgaatatccgtacgtgaatgactgcagaaacaaccggaagaagatcgttgattcttcgcctcttcggatcaaaaccaccctattgctcaacttgtcgcagcttgtgctgactgccgacatatgcattggaattgaatccatgaagagagactgtaatttgcatcagctctttgctatccgattgaaaatgcacagtcaagaaacacaactggtacttatactttttcctttttttgggggaaactggtgtcatctttgtgctttataaaatgtgtaatgtatcacatggaatctagacaacagatggtgcagctcaagaacggccatccaaagtgtctgaaagttttacatttagatcattccactataactatagtatactcccaaatcaactcctgctacagccaaatcgactctcaccacgtcggtgggagagaaggaaaagagacgatgattaagaggaccaaagttggtccccgtgtcaagagagatggcgtggtagggagaagatcatgggtggacctagggggtgtgcctggttggcaccggtatacccaatttttttggaaaaatactaggatgtagtacgtaatcagaggacataaaaatagaattctctcataaaatagaatataacaatgatcatggtttgcctggagatcttttaatcatcaaaaaatcaaatcaggagaagaggaaaggacttgatgaaaagaaacagtggaggaaaaaaagaaaaatatctagatagattaggatatgggattgattgttctgagtcttacagatatttactgaatgggagaatagctaatacggtccctaaagtttcgcttcgggctcaatttagtccttgaggtttcaaaacgtccaaataagtcctcgaaattaatcatttgggttaatatagtccttggacccacaaaaaatgccacatgagcatgccaagtcattcttgcatgcaacaatacaaatgaaatgaccattatagccttaccatataaaaagaaagaaaagaaaaaaataaaggaaaagaaaaggaaacaacaggaaggaacgaacaaaaagaccggcccattactctatctgtttgttttctccatctaaaccctgattataatgtgtgaaccatttatattatgtcatgcacaattatgtcatgcatgttggctataacttttatattgcaatttgagttgattgggtaaaatatagttgctacttttacctacttacacggttttgttatttctaggattttgataattccgtgcagtacagagttgaattgttctatatctgtttgcgtgcacgtttaactactcacaataaataaataatatatattattagatacaatacatgcaaaagaagataaatggttcacacattataatcagggtttagatggagaaaacaaacagatagagtaatgggccggcctttttgttcgttccttcctattgtccttttttttcctttattttttcttttctttcttttttatatgataagggtagaatggtcatttcatttgtattgttgcatgcaagaatgacttggcatgcttatgtggcatttttttgggtccaaggactatgttaacccaaatgactaatttggaggatttgtttggacgttttgaaacctcagggactaaactgagcccgaaacaaaacttcagggaccgtattagctattctcccttcatgaattatggacgacatttgaatagaattttcaaaaatccgaccaaaatttgccatcggaattgggttttttttttaaaaaaaaatggtggagtgatcgctagaatgggcacaccaagtgtaattttttttgggtccgccacgagagaagatgatccatgcatccggtgcaatgttattgtcaccgtgatccacgcacaatccgagatccaccgtccatcttcaagatcacaatcacgccacacaaaacttgcgagatcactctctccctatcgcatcttctatctcggctctaagaaactcctatccccaacgattgttgctatctaatcgtcagctcttcgcctcatttttcacgggcacagtggaagtggcggcagtcgaattaggggcataaagtagcaaagtggcctaagtgcaaaactttcatcatgccatgctggatagccacgtcaactcctgatccatctcatttgtattttgaacttcggatgatatattaaactatgattaaataagcatatgtgtatttacgcttttatatatctttcttttataaaataggataaacccggcctctacaacgcctttacgtatctagatgacacatagtctaagtttaatcgtccgaatatttcagttggtttagcgcaccagattgtactgttcacaggatttatttattgttctccttgcatccacagtgtttgtccgcggtacgatggaacatgatccggatccatgcgtgttatcctatatttctagtcgtccaattactactccatatcctaccagaaaactgtgacacatcattattcaaccgttgcacagaacgctgctcgcaaagccgaaacttgtaaaatgggggccagaaagaagcagtgccagaggaagaaaaagtctgtgccccaaatgtggagcatatggcctatatcgcaccgaagtagtaccatgtaaagttacatatgaagtcaactattgcaacaacccaacccacctgtcctacgttaaattcagcacacctgaagtccccaactttacgttatcccctctgtaatagcaatacacgttgtctttgctcagaaagaaaaaaaaaacccaccacagtatgataaaacacggtcaaaacagcacagaaaacgtgccaatttgaaagattagtcagccctggccagagtccggacacgaaccgcgatctcggtcaaggccgtcaagcgaggccccggctcgcgcaggcgcaggccgcgcggctgacggaggaggagtcgcggctagtccctccgctctcggcacgtgagtcgtgacgcgagaaggctcgcggcgcggagcgaaggagagatccatgtctgtttagcgtcggttagatagagctccaattataaatttagcttcaggatttggatctgaaataaagttgtggagcttcatctcattttgtaagagagctctaccaagcttcgctcttattttaggtggagctgtttggctgagctctagctccactatgccaaacagacctttagtagagctttaactcttaaatttaactttaaaagttgaatttgaagtggggttgtggagctgcctaaacccagtttcatatttctagttttattttataaaagagttttacctaactcaactcttatttgagattaagttaaaactgtttggctgacctctaatttgatgagaactagagctagagctagtcctgtgtcaaacagctcggacaacgcatcgcgagagtcgcgcgcgtcgcttgcgcccgttttgtcgtgtggcgccgcggcacggctcctgcctgcgtggctgcgcgcgcgcctggatcgatcgggttgagcacgtgtgcgtcggctgcgttgcgtgcggcggggactctgctttattcgatgggtttggcgcgagcgccgagcgagcgagcgatcgcgacggcgggacgccgacgcgcgtgtgccgggcgacggcgttttttcgttgtgaagtgtgaacacggtgctggtgctacgttttcaccggttcaccacgatttcggtgtggaaactgcgagcggtgcaacgttttcaccacgtgcgatcgatcacttcgctttccaggtttcgctgcccctgaatatgtgaattcatgaaccaaattctattgagaacgaagggtttcctaacgtgcctcaaagacaacatgtaactcccaattcgtctcagcctggtctaaatttgttaaaatttgaatcaaacttcgttcgaaacttttcaaactcatatattttggcgggttcttattatttttttcctttttccttttgcaatcggatcccagaaccctagccacacggtcagcacactgacagtggttcaattttttttttcattttacaatcgttcaattttatctgcttaaaggaaaaagaaagctcgattggtggtttaccaatccattaaactgtgaagctctccttgaattgtcaagcaattttgctaaaaatatgcaatcacattttcaatattattttcttgccttttcctaatgtgattgttcttgtacgattgtctggtttaatctaatttaggtggggatttcccccgtgttccttaaaaaaaatgtgattgctatatctcacctatatcctcttatatctcagctatttttggtgggtccgacgtttttaggtgtgaattgtgaacagtgctctcgttttcaccacgattttctgtgtgagtgtgagcagtgcttcgttttcaccacgtgctctgaaaatttgaatactccacttcactttgcaagtttcgctgctctgaaaatttgaattaatgaatcaaattcttttgaaaaggaccgaaagggttttcctaacatgcctcaaaagttttatctattggtgcacaagtcacaaacgcggtcaggcagacagtcgttcaagatttacgaacgttcaaagattttgtgctacctaaaagggacaaagaaaactccattagcctacgattgtacagattgagctctccttgtcgttcagttatactaaacactttaccaccggcataaattgccaagacatgcaacggtcatatagcttttcgtcaatttcggttggagattcatatatgggattcaataattaaggggtctttattttgtgtgagcgattattagcttgcgtttgcttcaattatttgggtgtgtttttttagacttgatgatgtgcgctggttttgcacgaatttatgtaataattggttgtagctcgttgagtaaagattggagttctattctactccctctattccataatataaggcatggtcaaatttgacacggttttcaaaactaatgtttatcttataatttcttatatattataaggtttgtagtagcaaaattataatcatatgaaaggaaattcaaatgtcaatccaatgatataatttttagcaagtaaaattaaatttatattgtactaaatgttggtcaaaatgttttgaaggtggaatcttgaaatacgtgaacgcattatatttgggatggagagagtattatcttaagaaaaatgccaagacatgaggaccaagcaaaagaatatgacattcccacttacttccttcgtttcacaatgtaagtcattctaatatttcttatatttatattggtgttaataaatctagatagatatatatgtcttgatacattaacaccaatataaatgtaggatatgctagagtaacttacattgtgaaatgaagagtgtacaacctaactatgctatcaacatgtttgataactttaccagttggcatatacttgcttggctacttcgacgaaatacaaggtggcctaaaagttgaagtgcagaaagcacgatcgcctctgttgttcttatttgtgggaagccactttctacccgtatatatatttgctaaagaaatgtgaaagtaaaactcgtacggagactgaacagaggcatgtgagaaacactctggaatggaaagtgtcaacgtgttaacggagtgcatcaagctgtcgtgtaatctgtacatttctgtcagaaaaaaaaaacttcacattgtttttcaaaagaattatgatctgtacattcctgtgatccgtttgacccggtcgtaaaagaatcatgcattttttttctcgacatgtgggcatgaagcatgcaggttatattaggtcattcccaacccaaaacactagacatagtttccataaactccatatcataaaaaaaaactagtactagacactactctttcaatgcaaacaccattatttcatacttgaatttaatgctacttatctcatatgatatcttatctcatatgatatcttgaatattgtgtagaaatcatgtctcatgcaagacatggtttccttctctttcctcatttattcacttgccgcatcatttttcattctagatggcagcttatttaatgctatggacactatcctaattattgggttgagaatagccttactacaccagatgcaataaactaccgagtcacattttaaatagaacagatagaacagtgaaaaaaccccaagatatacgaaccataattctcttaccccacgacactacgtggtgcctattccactgctcatccagccactcatgtgaaaggatcatcgatgttagatttgagaaccgacattgatggctttccacgagtaaaaaaaaaaagcactgagtcagatccatgaatcaagttaatatgattgtattaactaaattaatggaactgttaaaaaactaaatgaatggaagaatgacaaatcattcacataatatcccagaatatgtgcatgcttcgagccaaaagaaaacctaaatcacactataaattcaacatcattgtctagagccaagtggaggggaacacaatgaggtatctatgggtgaagtggagacaacgtcgctcatccatcgagctagagttgagcttgtagatttgctcctagcctctgtcaccccgccgcccacaccctatgcgtctcccttccccagctatcaaaaaaggttatcacttctctatctttgcttcgttgtttcatcgagctatgtagatggtaggatctggcctcttcgagcgtagcgaggatgaaggggaggcgatcaggatggatctagtcttgttgtcactacctctccccataccttgacgatgacaaaggcggatctgaccgctccccaagttcgagataactggatttggtggccacccgtcgaggagaggtggatttgttggccccattgctcgttggccaggattaggtggttgggagaaaatggagagagtagagagagagagagagagcaagagaggaggagagacgtatgcgctcggagtctcgagtggttgcaaatgaaactgatcggtttgatatatttttctagctcactaaaaactaggcactattttttttgttgtgttttaatagaaaaccaacatatataactattatcagtgccaaatttttttacagaatcagcatttataattatcattcgtgtcacggtgccagtttttatcagtcaggaaaacccttagcgccggcttttttttttcttcttcaactaaccggggtacgtttgggcgtttggctgcctggctgggtcatggaacggaacggaacgtgtcaacgagttggcatcaagttttgtcatgtactgtaatctgtacttttcggtcagaaaaaaaactgaacattgtttttcataaagaattgtgatctgtacagtacattcctgtgatccatttgacccggtcgtggaagaatccgtgcgttttttttttcgacttgtgcgcatgaagcatgcagaactgaacaagtatgcaagatgcaataaacggcggcgtcacattttgaatagaactgtaaaaaaaaaacccaacatattggaacaataattccattatgaataagattttatttacacagcttcagatctaaagtttttaaactgggtatttctaaccttataatttcatagatttagatctatgatcacgttaataacattttgacaaatcattttgtttctattttgatgaaatttaaagttttaaagcactataatttaatatacaaacttcaaatcaaacgtgaaccgaagtctataataacatgcctaaacttattacaagtatgaatggagtattcaaagtaccctatgtttacagtttgggagttcaatgcgttactcccctgggtaaaaaaaaaaaagaaaaaaaatcatgtttgaaccttttaacggttctttcagttgtggttttgaccacaatattttttataaaataaagttaaagattatcaaagtacttttcaacacaaatttacacaagacatttttatgttcgttaaactatgtatttcaaacttcattgatagtccaaagttaaaaatttggtcaaatctaatctaaaacatcatataaccaaagggaatatttgaaaagccgaacatactttttaccacccatactagaatttatttgggaaaaaaaatagccatgtttaaaaaatagttgccactaattttttttcctttattacaaagacttcagtcccggaggaaaaaaaaacaaaacggagtacgaaaaattggtgaggcctgtaacaattctaaacacccagccagccaatcatgttcgtctcctgttggaacttgtaacatcagtagatcacctaatatgatcttattatccatgtatattaagttgaagggccaggatcactcacctaaaacacagcaatcaactcccctaaaaattgataagaacaaaccactcctcttgttcctttccaccaaggaagtttcagtgggtgttagtgtgtcaccatccatggcaagccatccatccatggatgcaactcacatacatcacccatcaccaaagccattggtcccatattatgctttccaagtagctttcacccactaactaactgggaggaaaattcaagtacagcatcgccaatgattcaatgataaacacggttaaaaaaatgaaagcatagtcgattaattaattgtaagcccatcgaattacaccacctgctggaattaactttgagtaatcaggtcaaatgaagaggacatcccatctctttcctgacgagttattattaacccacccacccggaagccactgattcacgcagccacaagctgattagagtagcatctgatccaatccaaagccacccacttcttctttatatacctcccgcgccatctctccttctcccagctcgaatcggaggaccagctccgccgccgacgattcttgacttgccttcttctccggcggcgacgattcttggcttctttggttgattggtcgggcggagcagcggtcgaacagcttgcgggcatcaacaggcgaggcatggcgagggggctgtttgcgtgctttgggaggggaggggaggaggcggaggaggaagcagggaagaggccggcgctgcggcggcggaggacggtgaacctcaggtcgctgtcgctggaggacctgtcgcggacgctggcgaagacgaacctgcacgccttcaccctggacgagctcaaggcggcgaccaagaacttctccaccagcaacttcctcggcgagggcgggttcgggccggtgtacaagggcttcgtcgacggcgagctccgccccggcgccctcgagtcgcagcacgtcgccgtcaagtacctcgacagcgacggcgtccagggccaccgcgagtggctggtgagtttgccgctgtctcttctgctgccgaatcatacatccagctcgtctgatgtgatgatgaactgataataatgattttctcgttaatttttgtgatcaggctgaggtggtgtatctggggatgctgagccatcctcatctggtgaagctggtaggattctgcaaccaagatgatcacaggatgctggtctacgagtacatgccaagaggcagcctcgagaaccacctgttcaagagtaagtagttactaattaccacatgatttggggttaattaccgtgtgttagctgttgcagcttttgctaatcgagtgtgtgattcattgggtgtgcagatcttcttgcttcgttgccatggtcgacgcggctgaagatcgccgtcggcgcggcgaaggggctcgccttcctgcacgaggccgagacgccggtgatctaccgcgacttcaaggcctccaacattcttctcgacaaggtaaatcacacagcaagcttaatttacagcaaaattcgttggtgttgaccacatgatttgtgttgcaatttggggggattacaatttgagagcacagtttaaaaattgaatcattgttaagctgcagagtgtagggcaagtaggatgaattgagaatgtagtagtggttgtttattttgtatacgcgacacgcccaatcaggcgaatggatcgcacgttgtcaactgtttccagccgggtcaaaaatcgtagcttccaacagtaggattaattaaaataatgcgacaaataatgcgacaaattagcagcaaaacctttgattgtttattacacaagccggtcgttgggcgtagaactgattggctttgtctggttcgttaggaacccacggtttttttaagttcaacgatccaaactgccatactggctttgtcgtgtcagtacggtacatgccaaccactaccacaacgccacagcaacatcaatgaaatcaaaatgcacaacaaaatcacaagttctttttagttttgaacgaagttgcaagaatatttatgatcttaggtcccatttggcataactacagctttcaactctaacttacgtagagttagagctgtcaaacggtacagattcttcaattttagagcggagttagcggagctgctccataaatttatactatagaggtgtagctgggtttttgtcgctccacaactccactccatcttaatagacccattaaaataggcacactttgatgccaaatttgctgacttgtcaaatgggaaaaatttgcaggattacacggcgaagctgtcggactttgggctggcgaaggaggggccgcagggggacgcgacgcacgtgacgacgcgggtgatgggcacgcacgggtacgcggcgccggagtacatcctgacgggccacctgacggcgaggagcgacgtgtacagcttcggcgtcgttctgctggagctgctcaccggccgccgctccgtcgacaagcggcggcgcggccgggagcagaacctcgtggactgggcgcgcccctacctccgccgcgccgaccggctgcaccgcatcatggaccccagcctcgagctgcagtactcggcgcgcgccgcgcacgccgccgcgaaggtggcgcaccagtgcctgcagagcgtgcccaagtcgcgcccctgcatgcgcgacgtcgtcgacgcgctcgagccgctgctcgccgtcgacgacgacgtgcccatgggcccgttcgtgttcacggtcggcggcgaggaggcggcggcggcggcggccgggagtagcgccgccggcgacgccggcgacgacgagccggcgagggggagccggcggggaaagaagcacgtcacgtcggccgtgcacgcggagagcccgctgcgcgacggccggtacgcgagcagggtgaaacgaccggagagcccaccgagtgtgatctgatgagtacatagaacaaacaaactgaatttgtacatagcaaaactacatggtccttgattcatttgtattatactacctttgttcgtgatgttttttgtctaaagaatttgctaagggaaacgttgattaatagagttgtttaactccctttgtaacttgtaagaaagaaaaggggagtatttttctagattttaggcgcatatgcaatgtgcaacttttgttcattttaactacgatttatctaactttaaagacttttaatgtttatgcctgtaattttgtaaatgttatgaacggtaagtttattacatgtaattagttttttttgctacaataatttaatgctcaactttttttatctacaaaaactttgtttaaataagtaacaagggactttcctaaaagaaatccacatatatctagcaattctttgggaacttactagtattttatatttgaaaaactctaacccttggtttcaatccaaagggccaaatgttcctatcaggtttacatcgtacagaattcctccccaagtttttttttaaaaaaagctgaatgctcgttctttgttgcggataaaatatatattataattttaataggtaccagaaataacatgtgttttgccataaaatgtgttacctatcatttttcaatagatcaaatctattgatagatttgattgatttttagtaaatagaagtttacgggggtaatttacaaaactacaatgagagcagatggtggtgtcagccagacaaccaccaccgctacttcttttaaagtacttccttcatttcatattacaagtcgtttgacttttttcttagtcaagcttatttaggtttgactaactttatagaaaaatataggaacatttttaatacaaaacaaatatattatcaaaatatattcaatggtaactccccgtcaagatggcgacaatgacgtcgagcgcggcagcaacggcggagggacgatgagccatcttctggagacccgattagagcaccgcccgccgccaccgccgccgccaccaccaccgattccccagtatggcatagtcacggtacagagtgcacaggatgtcgacgcagccataccttcaacccttgttggtgaggttgttcggatttgggtgccgttcgatatgcccagcttcaacccttgttggtgaggttgttcggattcgggtgccgttcaatatatcattgggcacagtgttggatataggtgaaattctcaaggacaatgttcttgggcagtccctggtggaggacccagctctgctggctgcgaagctaagccaagcgaattggcttagcaatgagctccgtttagtgcgatttcgtgtcgagcagctgcagcatgcagatactgcatctgtctgcctgactccctcctcatcagggaatctgaaactttggatagtttacctttttttgttgttcctgtaaagaggagagcttcatatgtctggcccccattttgctgtgtggcccccattttcctattgggaggagtagttcatttctatatagatagttgaagagaaatatcaatgtctcccttagttaaggatttggcaaatatactcattttaaattgaatttccattccttttagctccagatactagtatccctcttattcatctcacctctgttttggaataaaggaggtacaatcgatgtaataattagctaaagcctacctcttattcatctcacctctgttttgaaataaaggaggtataatcgatgtaataattagctaaagcctaaggcaacaaaggttcaggttgtcaacatgttcatattcacaccggcattatgaagttatcattaaatcgatgacttttacaatgggacctttaatatagatagactgaaccatatggtaataactcaagtgcaaagatgccattcagatacataaatttatacttatttgttttttaaatgtcactcatctcctttatggggtagcgatgctttataaggttctgaattatctatattttagaaagagaaaatgaattctttttaaagtagattttaaaaaagcatctgacaaaattaaattgcctttcatctatcagatgatggaatcaaaaagatttcctaacaaaaactagtgatccgatatttcccttgctatctagctatagaaaaaagagttatagaaaggagatacggaagatagggtagctattatgcaatatgcatatgcctctgaggagtcagcaaaaaacataaaattcatactttgcctcttttgaaaatatgtctggcttaaaaatcaactttgataagaatgagctgattattgttggacttgaaaaagaaaaggaactaaattctgttctatattgacttgtaaaatgtagtgccccgttcaatctcccgtttgggagggtggatttttgttgcatgcaaaacgagaaacatcattagcacataatcaattaagtattaattattataaatttgaaaaatggatttatttgcttttttaaacaacttctatatttttttaaaaaaatacaccatttaaccgtttgaaaagcatgctaaaggaaaacgagtaagttgaagtttgcagtggaagttgaagtttggagttgaatatatagggctaagtagtatacctctatacatgttgtctttttatagactaccaaaaggtgtatacctctatacattatagaactagatttttatggtagaaatatcaaggcataaggaaatatcacttagtccagtggccaatgatttgtaggccaaaagatcagggtggcctggggattcttgatttatttagatactatgaaagtagcattattggggaagtggctttgaaagctggagaatgatgagggtcttcggcagagtatgttgtatgacaagtacttgaagaacaaaactttgtgtttagataaacacaaaacaggagactcacaattttggtctgggctacttgagagatgagatacaagattttttttttctgaaatattgtagaaaggaagtaaggaatggcactatgactttgatttgcgaagacatatggataggagacaggactttggctgaacaattccgagagttatttaaggaggggactacgcatcggtcacccgatccggagtggccaaaatcggccgctgacgtcagcatgatccgattgcatcattaaattcgttacaattaaatcttcaaaacaagaccacacatggatatattctgacgaacatttttttagcttattattgaattatttttaaatattgcacgatgttccaccaagtatatcggaattgtttcactgagtagatcgaaaatgtttcaatcgtttaaatcgggcgttgtttcaccttatataaaaaaatattttagcaaatagagaaagaatatttcagttcactgcaacattagatctatacatagtgaaacattgtaagtacactaggtgaaacatttttggtggaacaaaaaataaaacgaattccctcgaattcccttaatagagggtttgcaaaatatgtgggtgatttgttgcaaaagaatgtttcgttcactgcaacattagatctatcaatagtgaaacattatgagtacactaggtgaaacatatttggtggaacaaaaaatgaaacgaattcccttaatagagggtttccaaaatatatgggtgatttattgcaaaagaatgtttcgttcactacaacattagatttatacatagtgaaacattgtaagtacactaggtgaaacattttttgtggaacaaaaaatgaaacgaatttccttaatagagggtttccaaaatactatgtgggtgatttgttgcaatggagtatatagtggagacacatgacaggtgggggcagaaaacatggtggggcccaggcgcctgcatgcacccgtgtgggggacggggcgcgcggggggagcgcccgatctgctccacccccgtcgggcgcccggcctgcagcattttcggttatataatataactttcactaaaatagtaacaatagcaaaggtctttgagatgggttgggatgcctttgaattcagaaggacactaggtggggatatggctgtgaaatgagaacattaataaaagctttgtaatgggaaaattttgcaaaatgggaaagacaagctcatttggacacttacaaaaagtggggtttttactgtcaaatctttttactatgcaatgaagggacacaggtcgtgcaatactgcaggctgacatgtgggccctgtcagcctacagtactgcacatgcagtactgcaggggatctcaattggcaatgaagttgcaagatagtggttatccctttaagaaaatctggagattcaagattcctattaaaattaaagtgctcatttggttagctctaaaaaatagtattttgacaaaagacaatcttataaaaagaggatggaggaagggtactgcaaaatgtcagttctgcaacaaacatgaaagcataaatcacttgttttttttagtgcagtttagcacgttttgtgtggcataccatgcattgtgtttttgcatgttctatacctggggggttaaaagaagtaatgggtggatggttaagcaagttctctaaaaagaataggagcctgctttcaataggaatagctgctattttgtggagtatctggaaaatcagaaacagggcttgcttggataatataattccaaatgatctgtggaagtgatttttcagattgcacataatatatcaaatcgggctattttggagaacaaggaggaagaggcaagaagcttgctggagggggccagggtgttaaagcaggtagccgctgaattctacagtgctcggcatggctggagcttcagagctggaaggatccaaggatgacagaaggaagacgacgtctctcaagcatggagggtttggaatatgagcaaaaatggctgagtttttttgggtgctattaggaaagtatggactgttaagttcttagatgtagaatggctgaaatggcgttttgaatgtgtgttgagcaggttaagggactatgtataaggggatggcacctagattaggtgggaggaggttgtggtcgtctcctgttatgctcttttttcgcttttgtaatgaaaaaaaaatcttgcagattatgttcagtggcatgtctcgcgacaccaagaatcgcagtggctcggtcgctggctggcgccaaggatgatgccaatatcctccggcccgctgatagtcacaactctgaacggcggcggcggaggcggcaacaaggcagcgaggacttcaagaatggattatgtgaccaacatgttctttgccgcctgaacgccatcttcaacagcagtcgcggccgcactcgtggactcgacgatcagatcgccatggcaggcgggaccgcccactgcgacgcgttcttgctcaccgccagcctcctcggcggattcttgcggcttgtcatggaagcccccggtgcgcgcccggcatgtcgttgacgctcgcgtcctggcccgccatgtgctggacgcccgcgtccgcttccacgcccacggcggcgacgccttcttgcgagttgccggcactttcttgcggcgcctgcgcctgcgcctgaagactccatggttcttgaggaacgtcacgaaagcccgcggccatgcacagcaggtgttcgacgcctgctcccgcgggcatgtcccggccggccacgccttgttgagcctgagacacgtcgtcgaaggcgctcgcctcatcttgcatgttgccccgtatgcccgcgccctgtcgcgccatcttccctccgcacaacatcttgttgtggtcgcctcccacgtggccgaccccgacgccgacggcgctgctgctggtcgctgcctccgctccaagaaaggaagcaactccctccggaaacaatggaacggggagagcctccaacgccttggaggcgagaggaccgtacgccgcccccgacctcgatcttgtgagtcttgtcgtcctctgctccccggcggctgcctccactgctttcttgaagacccgaggaatccgcacccggggcgttctgttcttaggtgcgggatcgaggggattctttcggagaggagccattgaggcggggaggaagggggcggaccggaggcggggagccggggaacggggaaggagtggaggcgccggagttggggaagaagagttcaggtgagcgaagcgggtgggggaagacgacgccgagaagattgaaaatcgactctttcagtggtttggaaagtggttctctgatgttggcaggttgattgtggttgacccgttgaggatcagaaaagatgctgtacacacagaaaaaaagcatttccgcataagcgaggttttttttctatggcaggtatgacttttggagtcaaatggccgctaatgaaaataaaaaccggggtgaagctcgccacccgcttgcaaaaattaatttttccacctttatttttgcagctctcctccctctcctctctctcagctctactctccctccgcggccggtcgcgatgacgctgacgccgactgcgccaacaatgctgacgatgacaccgcctggatctaggaggagaggggaggcggcggcgacgaggagctgaggctgcggtgcggccggagggggtgcggcggtggtggagcggctccccttcctcttctctccctccgcggccagccgcgacgacgccgacgccgacgatgacgctgccttgatctagggaggggaggggagcggaggcggcggtgtggccgaagacggcgtcggcggtaatgcggccggaggggaggtgtggctcccctccctctcctatccctccgtggccggccacgacgacgccgacgccgactgcaacaacaacaccgacgatgacaccacctggatccggggaggggaggggaggcggcggcgcggctgaaggagaggtgcggctcccctccctctgctctctggcagctctactcctccgcgcccggcagtgacaacgacgaccaccgcgactgcaacgaccgcctggatccggggaggggagggtaggcagccatcggctagagggggaggccggcagagccgctggcaggttgggggtggtggcggcggattttattttattcgctaaaaatattttcgcaagcgggtggttctaccgtctatgaaaatagatgccgcctggaaaaatgagtttcacaggcggaccgctgagccgcctgcaaaaatcatctatttttcgtaggcctttgcgtgccggtggtcctttccccgtatgaaaaagctatttttggccgtctggaaaaacgatttttctagtagtgacacatttcgcccagggtttacgattccgacaagcccttccgtttcgggcgctggcggaattcggaatttcgcgaaatccggtggaaaactgttaaattctgaacaaatttaataaatcaaaatttgaatacaaattccctgaatttgccgacaagttctcgaaaaccggtcggttttggtaaaattccgatcaaattcatcgaaatttcgaccagtaagtatttttctttttttcttaattccggtcggttttggcccatgtaagtgtttccttttttttttgccagtaataataaaatccccaccgtcaatcgggcaagaaaagaaattacagcccgagtcgtgcatgttgaaaatgatcgcgagttaattttctttcgatgaaaagataaaaaaaaaaaaacaagaagggagcccacccagctaccctgagcgctccgtcctccggctcgtcgcgccaagtgaagtacacactgtacactcttccgccgccacttaagaaagaggggggcgagcgccccccccccccccccccccccgcgccgccggttcatacccctgccaccttggtccgtccggagattcgcgcgtcatcagcctccttctcaggtactatctctcggctcattctccctctcagttatttgcaccagggaaagacccggaaggagaggaacatctctgtggttgctctcgttttcgggtgaaatttttttgtctttccgattatactgggagtaacgatgaggattcgattatctctgtagaataggatccgattccggctaggtttcggggtgaaccaatccttgtttccggacactgcttgcctactatatatgttggattgcagcagattgattgctttatttatctgcagagttcagaggagtccggttgccagctcggagagcagctagaggatcgcaggtaatctctctctgccagccacaattatgctctgatttctcccccaaacctatctgcatatcagtatatggaacaatctttttttttttgttgttgttttgctagaaattgttttatttgattagggggaaattgaaaagaaaatgctaaggttgaaacacatcagtgagttatgatctttttacaatagtcaataggtactaggcaggatattaatgattacaataggtactaggcaggaagtttgagtaggatttctcttaatcttgatttttctctctcctcccttccagtctgcgcccttactaaatctggccatctatgttgttgcagaacaggaatggagaacaatctgattcgtagaacaaaaaggctgaagcgatgccatcagcagcccttcaaacaaagcagggcaaaagttcagtttgcagatcttcctgaggtgtgtttagaaacgagaaaccttcttcaggtttctgttttcaaaaaatagcttatcgaaaataacttctaccatgtccctcttgtgcaggatttgctgtgcacaattttctcaaaaattgccactgaaggatgttgtgaggaccagtgttttgtcaagaaattggaggcacatgtggacttgttgcacaaaactaagattcgatggtgttatggtatccagggataatattaatgcaatcttgcagcagcactctggcaagattgttgaagagtttgaggtgaagtttgaattcgacagcaagctagttgatcacctcaatggtttggttgattttgttgtatcatcacagacaaaaaaaatggcttttgatttagtgccaaccaatcctgttggtcttcttgatcgatacagatttccctttgagcgtttcgacaatggaagcatctcccgtctacagcatattcagcttagctttgcatctttggaactacctccccatttcagtggttttctaaacctaaggaatcttgaccttcacttaatacgatctactcagaaggatcttcaagatttgttatcacaatgctttaatattgaatggttgagtttagttagatgccatattggtggtgaaataaaggtgacacatccattgccgcgccttctatacttacgagtcacatactgtgatataaccaagttataacttaatgccatcaacctcaaagcttttatgtatgatgggatgcgacatcctattgatcttgggcatgctctggtactgaaggaagcaagccttcatttttttggctctgtacatcttgaggatgctcttactacactcccaagtatgcttccatgtgttcagtccctcagtttggatgcctatgtacctctgactactctcccaagtgtgcctccttgtgttcagccgctctgtttggatgtctatgttcctctcgaggtttgttgctacacctttgaagtcatatgcaattctttgctcaattctttcttactatcaccttttcaggtgtcctcgctgctgaagaacacgtgcaagttttctcatctgaaatatttacaactaaaattacgtctatattatcatgattcgggcaacatcctctctttggcctcttttctcagggccagtccttgcatagagaagttagaaatacatgtgagtactatatgttttcctatttgcaggaaatgcgtttattccatatttcttctttaatcattctggctgttagcaatgcagtactaagattttgatgatctgtcaattaattatccatgcaatacaagtcttcttatcaattcccattttcactcattgcagttcaattcgtatgctttgtcacacttgtattatcagcctatcaggaggcttccacaaggtgaatacggctatctaaagaacatgcatattactggatttgttgcatcgacaggcgagcttgaatctctgctacatgtcgtggaaagtgcctctatacttgaagttttgactattgaggcggctggcatgttagggaaagatatagattatgaaggaagattaaaagttgaggaattgacaagaagataccttgatgggataatgttacgaaatacaaagctctatatggcataagttattgtagtatagaagaggtgtgcttgagatgtatttgaggattcctgtgtgcaaggatctgttgttagctgtgtgcatgtattccatggatcattagtaattttcgcaggccatatccttgataactctatcagctgatggatcatttttgatagctaattgtctaattgattagaaatatatagccataattggaaatgatgcgatatttgttttttttaatattaaatgatgtgttgtttgtaaaatgctatattttgacctacttaattatgttaatggcgtaagaaaattaactcaatgcatgaatttgaagggattggtgagaagatcaatgaacatatttggagggatcgatgattatagatttaagatccttcaaaatttacttggtgcagttcaaatcatttggcctcagtaattttgttgaccccatagttcgttgatgtcttgcttatcacttgttctgcttcatcttttgcttataagaaatgtctttgtgcctgtcggtggatggcgagcgaaaaaagaagttatgtttttcaactgagaaaaatctttgtgcatcttttgctgtccttttggatttaggatctgagttgtgctaaactctaaaacccaagaaatccatttgataaagctggttattttatctttctggaaactgtcaaagaactgactatcttgtgcaggttacttgcctttagtttggtgaaggatcgatacttgcactttggtttaaaatgttctatatattgttgtctcacttgatttattgtgtaaccatagctgctttcagtttttgtaagtgctaatctgtaaccttgctttgcagttcctgaagttgtgagtcatggctgccaagctggcttgcctccatagtctccatgaacgccttggtaccaccttctcatctcatcctaataagttgattgcagtcttttctaggtgaagatctcctttgaatctgctcctggaaatggttgagttcttattgatctttatccgcataattggttagttcttagtaaattgagtagtgaaatgagagcatgttactgactcttagctgacaaggtgatccattcctttgggtttatatagtttttcctgagattgttatgatggtgtatgtaatgatctttgatgagatgtaacatattgattatgagtcatggatcttggatgatgttaaaaatattgtttttagctagaatcagtaagaatctggtctatatggtaatgccatcaacacagttcagccacaggaaggatgtgagatcgaagcattcgttctatttctcaaatatcactctatgcaggtatgttaacaagggaaagggagtgctgtagcatcaccagttgcttgctgagtttgatgaattgatgccttgatcgaagctgacaaagagaaatgtgcttcatttgaagacgttctgcgtgctgcccaagtatatttggcaatgtgcctactccagcatggcgacgatagtcaaatcgaagtcatctaccagcttttctaatttaatttccttgactgcatgtaggaagccattgtgctgcccccatgtgttgcactggccatcaggcggccaaggtctggtgtctgggactacatttgggtgaatgtgagtgagttggctgtggaggagctgagtgttcctgagtacttggaattcatggaacagcttgttgatggacagtaagttccagaaagacgatatgcacattataactgaagcaacataacagtctgaattcaacctctccttttcttaaacagcaccaacagttgttctcgagcttgattttgagcccttcaatgcctccttcccgtgcctgttcatgtccaagtccatcggagatgggtgcagttccttaaccgtcacttgtcgtccaagttgttccaggacaaagagagcctctaccccttgctgaacttcctggaagaccatgaccactgtgggcacggtcagaacctaccaaatgcttttctactgcatattttttcttgtttgaattgcctgttgttagtcctttagaaagctgacattctctgaagttggcgccggacaaaggtggcgccggagccagagcggcagcgtttcccgcgttggcgcgggtctagatggtagtgcaaagggagctggcggcggtgggtcgtcttcctcgttgccggtcggcaccctcgcccttcctggagctcctccccttctttgtggggagtttctaggctggattgaggcggcaacttgtcagcgggggaagcctaggttgctgaagcaatgccacccagtcccgggttctccttcagctagatttggcgaggagactggcgggtggtggatcggaggggtcctgggccagctctcagggatggaggttcgttgaagtcagccgatggcggggcgtcggtgcggtgtggtggtagtcctgtcgttggcaggactggaagctggccggcggaggggcgtcggtcgggtgtggcggaagccatgtgccgccgatgtttagatggtggattcggattgggcgatggaccacggcggtaggggattccgagcgaaagcttagcccaattttttttgggccaacagtgacttcgctttcgggcgtggtaaccctcctgagggcactgttgaggtacccctcctccctcggcaaggagctctgggtgaaaaccttgtccaaggatgacgacggcgtctttcggcgtcgcaaccctcgtgagggcgttgttttagagtcttcgtgtcgtggtggtgttgttggcccggtggcgatcggtctcgcatagcgatggccggttcggtgcttggcttccctctctgtagcatgtgtttgggcggttggcacatggttcggggcgtgtgctctggtgcatatccttcctcgacagccagctgtcgatgtaaaacttttcttgtaaccttttcttcctatcttaattacattgaatgacctccttcggtcattccggcaaaaacattctctgaagttccactaaacgataggatctgaatttcctcaatcataatatattgttttctgttacagaccatgatgctgaatgacagaattcagagtgtacatatgaattatagagtaatgtgcagacatgattttacttgatgcaggtaaccaggttgttgcctgatgttattgggactacatgcagccagtggctggagaaggttattggaactgagcacactgacattcttcgtgttccattcagaattcatctttctttttttctttctttttttgctgcaggatgttgcaaacgaaattatgagggaaatgcaggccaaatataccatttttcgtgccaattaactgctgatcatgccatgacacacagacttcacatcatgaccagcacattccaagaaattgctagaaggtaaaattttactattgagcagtagaatatcgctgcattgtggcaacaactgaaggagtatatgatgtttgattcctctgtttcttcagcaaggacactgttcggcagtatgaatcacacattgcattcacccttcctgctcttgcaataagacagtcagactcggaccatcgcatattacgctggaagttcacaagagaatgcaaacaatccgatgaaaatggctttcataaagcatatcatatttcaattggcatcaacttgcaaacccattgtaggcttccatcggatggcctaatcagccaaagaaaaagccaaattttgaattttcaaacttaattttgagatatttttaacgtagtttcttttacaacattggcttttaagtcaccaagaacacatttataaaagtttcacgtacaaattcatttttatttcctaataagccgttttggcttattatggggaccgcagtaaccatgtctagagcattttgtaacactagaacaaatttgattggtactaggatatggtgaagaacaatggatcgagtagcttctgaccaatgacattttctatgcagtctcaaaaaaataaaaaagggtctcttcggagacatccgataaaaaaatgaaaaggaaaaaaaaatgaaggaatcgaaaacgacacttgattttggattgatgatctggacttaaatggcagcacccatttcagtggatctgatcaaccaactcttcacagacgcctggattgatgactgatttctctctttccaaatttcttagacgatgagtaggattagggtcagcataatgccattcaagaatcatcctaagccattgtgtgaagagcggaattcattgacagcttcatgtagtttgatccacctcaaatcatctctgcgaatgcaccaactgaatttggcagtgggaaatctaaagagaatatgtactgcatcatcatgcgaagcacatacagcacaaagatcttacccaatccaattctcaacaacgtagactgaattctttctctccaacctctaaccacaaaaaatgcttaatttccataggaatgagtgctttccagacatcagacgagatataagatgaaaacgctaatgctctgtacattgatttagatgaaaaacatgtattactctctaaagccccataagatctggtaactattcttacagaaagaaactgatggagtaaaaacgatcaagtaatcaacctaataatttcattctaatagatcatgagagccaaaagatcttcagaaagacagattctctgctcgcctttctaacatctcagagtaagaacatcaaatgttcaagattctgcaaacctgaagcattactggttgcctctcacatggtaagaacatcaagcggtcaagattctgcaaacctgaagcattatttttccgtggtggctagtatgaagaacccaagattgggggaaaaaagagtctaaactgctagcaatgcacatgctcattttcctaaaggctactccctccgtttcataatataagtcattttagcatttttcacattcatattaatgttaataaatctagacatatatatctatctagattcattaacatcaatatgaatgtgggaaatgctagaatgacttacattataaaacggagggagtaacattttttgtggccaacagagaaattagtgacatcagactgtcaaagcacatcgtttggagaagtgaaaccagttttcacgaaatgttcaatgatctcagtctgagtctcaggtgatcaaacattcaaacctatatcttaatcgtacgcaagggataaatggaattacatacataggcacgtagctaagcatcctgaacttacacccatggcacaaatcctgaactaacacatgccataaatccttatatattggctgtgtttagatccaaagtttggtgtcaaactttagtccttttccatcacatcaatctgtcgtacacacacaatttttcagtcacatcatctccaatttcaaccaaaatccaaactttacgctgaactaaacacagccattgtttccttcagattaaaaaaaaatgtaagatgcctgcatacatggctgcatctaccatttggataacatctgaaaataatattttttttaaaaaaaagcaaatacattctacatagaggagatggattttcatgacctatcttctttctatataaaaaaaatataaccatttgggtgggccaaatgcaaaaataaagggatagtgtgttcttaattaagggatgaaaatactttcccctacatatagaacacattgtacacatccattgaccacaaatcttaactagtacacacgaaaagtacgaaagaaagatacccacatcaccatcaaaaattaagcaaacggagcgacgaaccagacacgatataatgctactgcaacatagtgtgcgctataccacaacacgagtccatcaaatccacaagccattaataagtatcgaagagttgcagctggtcacatacaaaatgaccagaaaagcacacttgcagcacatataatccgatcttgttacagcacaggatgaacactaactctcggacaagtctgaacattgtcgatcccataaccagcacagatgactcaagaaaaatggctcaaatcgcttaccagcagtaggaagaaactcagctcgtcgatcagtcggcgtaggagtcagcaagaacggtggaagtgagggtaagaacgaccgtgacaagcgcagcggcgaggaccagcttggcgaggagctccacggtggtcgtcgcgatcggcacgttcccggcggnggtggcngnggngccggctcccctttcaccgcggccaacagcacgaacatgggtgtagatgagcgtcatggagaggaaaaacgtcgtcgctgaagcagctggacggagcacgtggacaaccgcgacggcgaggggtagcaaatcttggccgccgtcgatggcgcctggctgaggagccaagaagacgtgaagcacgccggaagacaagaacaggatgaggtaaacgacctgcgggcggatcatcctgtccacggcaccgccgcctccgccgccgatacgggcgtagatgagtgcgacggatgtgtggaaggcaaccatcgccgccgccgccgccagcagcatcgtgtggaccgcggcgtcaagcggcggagctcgaacgaagcaactctcgccacccgactgcaggtcgacgtaggggaagaatccggtggcgtacatggacaccagcagcccgaagaaggcggtgaccgagggggcgctcgccatgggggatgagcacttgagcagcttgggaggatcaagattctagagaggtgcggggttgcacgagtggagaacggtttggatcggggtaaggttcgcggaggaaggaagaagaaatttaaagtgaagggtctcccacaaaaagcacaagaagaaatcgcgagcggcaataaggcatccgcggcctggaggcaaatattgcggcaaaaatcctctctcaagttaaagccagaggaattgaaagggacgggttgttccgtcgttgggtggggtgccgtgcaacattgcactgcagccagcaggtcggctgcattttcaggcagtggctttatttttctaatttttttatggaatactactattattgcatggcaaccatgataaggttatgctatctttgaccaacacttttgtagtatccatccacttattagatttaagcaaaatttgacagtaacagttaattttggagatttaattgagtctttttctactgtagaacataagcttattactcagatgtacacccttcgttaaaaaaaaaaaacaaatcctgagagtacacagaggcagagtcctagaagatggaatgtgctctttttacacatatatatatatataggcacacctgttttttttttatatatatagagtatacaggctctttttactttggttgtggcttgtttttttctccacgtgtggaaaaatcaattgatgctccgagaaatgactccacagcaatacaacagtacataaagttgttatttcttcccaatacattgacgctcccctttatatgttgggtaattggcctcactacatttaggggttcgtttcgagaagcttttatctttcatccatattaactgagataatactacccgtatgaccactagagatgggtgtaaataactaacttaaagtgattgtgatccactaatatcaacttgtcaattttggctttgttctgacggatttttactccatgaaccggtcactgttctttcgcagaaaggcgcatgacacggtacaccgtacacatcaattgcatctacatgattcgcgtgagaaaggagcgcctggattgagagattcttccatttcactgccgcagaagacatacggcagcaacaaattcctcgttttaaatcagggctatgcaccatgtacgagtacttgacgtttttatcagagcaattggccggatctaaaaggcaactactctccatttccccagctgaatcgtgtcgcatggcagaaagccaggaaggcaaggcaaatcttaacacaggtagaaccgtagaagtactagaaaacgagcaggagatgcagagcgaaaggagcactgaaatccagagaccagagaaagggcactgcactgacctgaaatgtctgcacacgtaacggctgcagggcacgcacggtcagctcagctatagctccggccatggaaaccggctccaaatctgcaaccgagctcgcagattggcgaccccggaacatggagaggcgagagctaggggaaagctcgattgagcagcagccagtggttgacctgaagaagtggtctctcctcctagattaaggtatttagtaaagcaaatggtcaggacgagagcggcagccatctttccccaccacaagcacaccccactgcaccatggcaccacctaggacgcagacagctcagaagacatatagtatgacaaagcatgtgtattttttcagagatccaagtagtagcatcgtactagttcactttagcttacagacaggcagctaaagttcgtttgttaagtttggaacctagaacaaactcatctgggtgaaacacacggagtttcactggagttttacaggcagacatgtcacatgtcatcgcactaggagcagttcttggcaagggacaatcaagcatcagggggacgttcaaacggaagaaggtttcgccaaaaactcattttgctctgctcatctcactttctcacttgacaaaaaacggtggtggtgtccaatcaccatgtgagcatacgaacccaaacgaaaaggagaatctgcaacttttgaagggcctactccgtacatcaatggggggaaaaagaacaaaactaacacgaaagaggcggcgtcgcggcgatggacgctgtcaaagtcgtcctcactcctcagcgcgaagagctctctgaccggatcagggcggcgcggccgtgcagtggtcaatttgcgacacggtctccgcatcaaatcatcttgtgagtgaggactactgtaaccaaccagatgaactttaggattccttcgggggaaaaaatacagaaatttcaaaggatttaaaatcctatagaaaaaaattcctacaagataaagaattgagttcctaaaattcctttaaaaattcctatatatagattggcatgtatcatgaaaattttggagaattcttagcatgtgctgtaacctcttgggattttttgtctacctctcttccaaattccgtgattttcttgtgcttcactcaaactgttttctatgtacgtagttctcctatggttttcattcttttagaatccaaggaccataatattttaaatcaggtgttttatttattctcgtgttttgagaattgagaatcttacgtttttcaagaagtttgtaaaagctagtactccttccgtgtttatttgtatgatgttgtttttcttttaagcaaaggggcaaagccctccatttctattatagaaatggtgcagctattacagagagtcatcccattaaacactagtgaagaaaccatatttggtgggtcgaccagatttcacaaatagtcccggttgtattaaaaacagggactaaaaacacctggtttaaaagctacagggtacttttcaaactttagtaccggttggtgttaccaaccgggactaaagatatatttgtagtcccggttgataacaccaatcggaaaaaaagatcgccatacgctctactcaccaaccgggactaaagatctatttatagtcccggttggtaataccaaccgggaaaaagatcgacccggagatcggagaggcgtgcgcgatcggatcgaggaatcttcttctctgctttaactagagtatagtgcttttctcaaacttatcttctcctctcctttttaactcctctcctcaaccttatctattattcaacctatctctatttctctgcttctttctactgacaagaccgcgggagg

SEQ ID NO: 21867 - DNA, 11094 bp, Oryza sativa
  unsure (1)..(11094): unsure at all n locations
ccccatttcgtagggcgatggcgcctttcggattgagngaaattcctaccttcccttataagttatacctttgggacatttcgttaaccttaatctcctcccaagctttttaactccctccccccaaacttagaccactattccccgaaatctcaattgcctctccatattttgaactacaagaccctggtaaggcaagccagggcttaaagtgtccgtccggcccaggcaaacgtgcacggttgaccggccgtccggccccacggttcgacggctttattgaaagcaaccggcttcggttttttcctatttcttttttgaagaatctgagattggtgtgtgatgtatttgattggatatgagattgttgtgtgatgtatttgacttatgtgtgatgtgaatatgtgatgaattttgtagaagttgtgatgtaattttttttaagattttgtgatgaacttgagtatttgagatgatcgatttgtggatttggaggcaatttgaggatgtttgatttgggattttggggacaggatggggtgaaatcaatatatttaaaaacaatgaagaaaagaaaagaataaagagcaaccggatctagcctctttagttccgattgataacactaaccgggactaaaaatgctttatctttagtccaggttagtgttaccaaccgggactaaaaatggatttttactttcggttttttcacccgagactaaagataacgatctttagtttctggattcgtagtcccggttagaaaatcggaactaaggggaattacgaacgggggaccctaatgggcgatcgctcgcctggagatgggggtagcgatcaattcgcccccctccctctcccttcctccctctacctgatttccttttttgtcaccgcattactttcctattttagtaaatttatgcacctaaaatttatacacctcaagtttacacatctaaagtttagagacccaaagtttagaagttaaaagtttatatatccgattcaaatttgaatttgaattcaaatatttttcatatatagtatttctatacatataaagtttatacacctaaagtttatatacctaaagtttataagtcaaaagtttacagacataaagtttataagtcaaaagtttataaacctaaagtttatatacccgtttcaaatttgaatttgaattatatgtgattcaaattgaattcaaatattttctatatatagtatttctatacacccaaagtttatagacgtaaagtttataagtcaaaagtttacgtacccgattcaaatttgaatttgaattcaaatattttttatatatagtatttctatacataaatatttctaactttttgtttttttaatttttttttgtgatgtactataataggaagagaagaagaggaggagaaaggggaagaagagagaggagcatagggggaggcgtggggtgatcgctagggcagcgcgggggcgatcacccgcgcgttaggatttctgattacgaaccggaagtaaaaaccctttctctactagtcctttctccactagtgaaaggttcaaatataattgttggttagttaaaaatgtattaaccaacgtcatatatttcgagaaggagctgtattactaaatttatgggacaaaggatgaccagctgtacatcttccaccggtcgaaaatgatatccgtgttaccgagtatgatgtaacaacccaagagatggcaaaaactaatattgttttgtcatgtattagagccaggctatttttttccagagaaggttttttttacctggtctttatatccaaccggatatatgtgacctttttaaatttagaacttagccctcaaataataaatttgttcctatgaagatttaaattcacaaccttaggatactattttggtcactgcaatctctaggctatattctcttttgcactggagcccgtccatatcgctgcttaccgtctatatagtactgtcccttatttgcctacttgtgttcacttgatgtactactgtttacgcttggaccggccggatgtgtgtaatctgccgacaacatctcattttcacaagaatttcttagcagcgattagggactcacaagtcacaatgcgacgccttagctgagacacccgcatcatatcatactctctctatctcataatataagagattttaagcttttacttacactgtttgaccactcgtcttattcaaaaaatatttggaattattattttatttttgtgtgacttactttattatccaaagtactttaagcacaactttttattttttatatttacataaattttttaaataagacgagtgatcaaacaataaaaaaactcaaaatcccttatattatgagatagagggagtagttgttagtaaccccggcgggatcagctttgttgaatcgtgttctcgacttctggtgatcagaagactgaatttaatccacatggtgcagacaagagtgtccccggccttacatatatacggagtatttgagtctctatatattttcctccatttgtattacgaaacgggggagtagcatacaccgtactccctccgtccaaaaaaagacaaacactgagtttccatgtccaacgtttgactgtctgtcttatatgaaatttttttataattactatttttattgttgttagatgataaaatataattaatattttatacgtgacttgtctttttaaatttttttttataattttttaaataagacggacggttggaaactcaagatttgtctttttttttttaaggatggatggagtatttaatttgtgaaatcgacaagatgaatgtgaagggagctggccgtcatcctgtatccggttcgtgctcgtcacatcatcagatgaggtctccattggctgcctaggatctgcgctaatgattccatgattgaaaagagggggcaaaaaaaagaaaaaacttcgaccccattatgctgtcacacgtcactgctgcagtgacagatgactcaatatcatccgcgtcactcaaacgtcaatactacaattacaaagggttcgcaaaccaaacattttcaacttatcccatcgaatatttgaacatatgtatagagtattaaatgtaaaaaaaataattacacatattacgtgtaaattatgaggcgaatcttttaagtctaattacgccatgatttgacaatatggtgctacagtaagcatttgctaacgatgaattaattaggcttaataaatttgtctcacagttttctggtggaatctgtaatttgttttgttattaggctacgtttaatacttcaaatgtatatccgtatatccgatgtgacaaccaaatttaaaaaattttcccaactaaacaaggccaaaatataacaacatgttgctctctctctctatcctaaaataatatcattttgcatccaacccacacatatcaatacaaaataaaaatactatattatcctcacttttatcaaatgctaatataattattgcttactttatctactcccagttacaattattttctaatttcacaaaatctgatataataattactaaaaataaagttatttgaggacaaaccgtaagagccaaaaataaatttattttgaaacggatagagtatttaattagacacaatatagtaaaacaaatctacacattgagtattttttgttaggttgctatattttggaatggttcatcttaaaatattctcttcatgtcaaaataactttatttttcattatcatatttggtccaaaataatttaatattttgagtaatcatttcatggaagtttttggaaacgagggacacagacattgaggtttgtaaaaatggggccaattatactgaggcttgttgaagtgatggacattgtagtctttttctatatccttgtatttgtattcgtttaatgtggaactgatgaaaaatgaagttactttttgatggaggaagtagaaaatagagagatagatggtgacgttcaaatttgtttctaaagtatactcattcacatactttttttatgagatataaaccaatcataatcatatctacttaatttctccgtattctttaatcttaaccaattataactatctccttttagtttcacatttatccttaatcctcatgaacaactactctctccattcacaaatatacacatttctagaatttgatatttattcacaagtataagtattttaggagtattatttttcataaatgttcactagttgcatcaatactcgggaccttttctaattaagtaaactctcgtaagcatcaaagtaattgtaactcatccttaaattttgttaaaaactctaacaatacttatatttatgaacgggggaagtaacaaaccagctatcttccataccagtataccaccgttacttgtcagggctagcggtgcagattgtagaaaaatttccgtgccatctttaactagtgctatttttgttgttttcctctcttggtgcagtcacaaactaacaacacattgattaagatggagtgcttgatgaacaattaacacctacaccgttcatgtattttgggattgagatgcagtacatttgctactatggctacagaataagttactgtacacaatttgagccctctattttattgatctaatggttcaaattgtttgctacagtaaattgctataatattttactaatgtacctaagtcatctattttgaatccagtgatactcgtgttattgcttaccttgtaggcacactagccactgcatcttaaccagatccatgtatttgataatacagcgtactaagtgtgtttataatactacttgttaatattgctgataatttagttttatgaatgcgctgcaaatatataacgattggcaaaaagtcgagtgaattttcccttctggtgataatatcatgtgtcccgtcccgtgccttctgggcgaaggtagcaaaggcagatgtggacggcgtgtttttcagcacggggtggaaggaacagatcaacagattctatagagtgctgattgactctggctggcaagcagaattcctctccccactctcccgcggtacaatgcacnnnnnnnnnnnnnnnnnnnnnnnnccccgattttagaaatcgaaaatttttaatgtttatcagtaccaatcccatcagtagtcggtacatatatatagccgaatcacaaatatcacgaataaattcaggctaagagaaacatatcacgaatgaattcaggctaagagagttaaatgcttacattagagccaggcaggccaacaactatcagaggacaacagcagaagacaaaataatacaagggcccggttgacatgccacaagcagtcgactggggaacgagacctagattagaaccgcactccgatcatcttgttaggtacgcaagcgtacaaacaagggcttctcttcaacactctactaaaagatatatatagagtaacaatgagtacaaaagtactcagcaagccaccacacaaaatgcagtaatgtacaggacaatacaaggagtggctatggttactttgcataaagctgagttttcaaatatcatttcacaaacctaagacctaacataaaccgatcaagttttatctccattattcattaaacagcgacggttctgtccaccatccattgtgttcccaaggatagcttcccgccactggtcgtcatggttttctggggtctaccccttctcgcctctcgagaaaagttgattcaccaatacaaaatcatcatgcatatcccatcccaatcagattaagaaattagagtctagccaagtgtaatacatatctcggtgctcaatatccgcgagcacggctattcgaatagattggtttactcatactgtagtggatgtacactttacccatactccgcgacttgcccaacacataagcctacgtcccaacgaatgagacttgccacgacaaagcctttcaataacctcactttggcagtacccgctccatgaactttagtcctcatgcactctaggcgtccaaggtttctagcagtgagaggagttctggcgctcctgagggggaaagactcacacattcattaagttatagttaagtttaggtttgcacatggcaatcctaccaatggcgacaccactgtaggcacccgcccctcgcggtcctaccaatggctgccccaccgtaggccctgcctcacacacaacaagaaaaccactacggcttgggtaccgcctccgctcggctatttactccgctaggtctatacccacacgagaagtacggttgtacgggggtcgtttcatgcttaacttcatggctcggtccttaactgactagggacgccactagccttttccggacaccacccaagtcctccagccgccccagtcgaaaacatttgtttagttttaattttctttcacaaatcatctcatcaatgtcatggcaatgtggcgctcatgtctccacatgcagtacctcaactaccttccccaaggtagttgcccaagcataaagcatttgataaatatgagaatgcatgaatctaaattagcattactaagcatttgtcataagtgactagggactcatacgtaattatgggtacacgggaataatgagataagcaataatcaaaggcatggcataataacaagtaggatattcatcactgcatgcaattttatttgtaaacaaaacaatttcacgattgggatcaacatgctcaagggatggggtgatgacttgcctgctcagggtagttcttattcttgatataatcttgatcaaccttcacctcctggaagctgtatacgctccctcacgactaaccgatatacagtttctataatacatgagaaaaaccaatattcaacaacaagcaaatatgcacaagcaaaatataattgttgaggtcgaacctagggctgcttatactactcgtgtttgctaatggattctaatcaagctaagagccaaggtttcttagtattttatattgtcccgatggctctattggtactaactagcacaatacatacacattttgctaatctgtggtttagtctagctattggcttatggaagagatctgttatgaaggtaaaatggtcaggtccctaaggttatagcatggctatgtcgatggggagattaaggataaaccatatcatcaccatgattcacctacattattattttatcaatgaagctattattcgaattatccacatgatgtatatatatggattttatccgttttcataaaaggttgacaattatgcgctctgtactttagatttatggtttaataatattatagttactgattatgttattgtataactttataaattaataatgaacaatcctcaggtgtggttgaactaaaattaaaattatgtgtggtcaagatttataactagcactagtatttagctaatatactggttcttcatttattacctagtttaatatatgcaactagtaggttatctaaaaggttatgtgtatgcaacagtatattaatattgaaccatttactgaatataggcaaccgacaacataactagtcacactagctctgttatattcctcctaatcaagctaaagatattcatccatatgtgtttatattttagttacaaaatgtgaggctaaacttttatgtaaataatttataagtcatggatttaattgaacattaaatagtgtaaatagtgctagtgtcttgctatacatccgttcatttgagacatcactgtacttaatttacatggttgctactgtgacaaaacatgctagaaacaaatattattacatctactctactgtataataccaattttatttattagcataattttaagttgaccataatctaatcatttgatattaattatttaataattataaatatattttattaaatagtgagttatataccattggaaagcttatgaatttagatgaaattaggttcaagtttcactcaaatccgagttaaaatgagcaagttatactagtttaaagattcaatttcgaattaatccgagaaattgtgaaaagctactgttcataattcatttatttttaatctaaaatatatccttatccctaaccgctgctgacatgtggggtcaaagctttgattttctttttcacaggattaagtttctaaaggaaataggaggagtgggggacagcttgtcagtggctcggctgaaggtcgtctttaaccttcgtcttcttcctctcgaccgagcgggagcagcaggggaacacggcgcgcacggaaggccggccgagggcgacccggcggcggccaggggaggtgcggagaagctccggcgaccacccaccggctgcggcggcgcttggagggacggggcgcatggccgccatggctgcgccatagccgagctcggctacaagtggctaggacgacaggaagggtttccgaccaaattgatgagtgcgtgagcatatacggcgtacgggcgttctatttctccagaaagatgggaggaagagcaccggggatggcctgtccacggtgagctcgtcggcggcggaacggcggctggggcagcacagccataggcattaatcctacaaactggagccgacgctagatattagaggtgtagaggatgctataggctcgaggttttaccccgggatggagagacggcgaagggcggtgacgcgtggtgcggtgcggacgaagcagaggcggctagctgttggtgacgcccgaaagtgttcgacgcgtggttcccggtgtccagcggtcctctgctcccccaatggcgatggcggcagcacggaacctcccccactccctccaacctccagctctggccggggagcctcacaatggtgatctctagcggtggtgagagagtgatagcaaggtgttcgatgaaatgcatgactagagaaaggcagagggggatggggttttgatggcctggcttggcttaggatgtaagaaaactatggaggataaggatgccaacacacaatagctgagctagagccctaatggcaatcggataagggcattgaggttttgtggctccatcatcaccctatatcctatagtctgcgagttttagccctagctggggaaggggacttcgttttacccaccggatacaaagaagggcgccgggacatcattggtgacggacgtggccatggcgatgcgcgcacatgggagctgtggcagagtggcggcttggtgagggcggttctcctgtccaaaggtagttggctagggctaggggtgacgcgggatggcgcagtggccgttatccatctgctccgaggcgacgcgcgatggcgacggcgatgacgcgcgcgcgtggagccgcagcttttgcgcgggatttcggcggctcggtcggcggcgggcccgcgcggcgtggcgtgacgcgatgcggcgcacgggcacgcataatgtggcgcacgaatagggaaggcaggcacgcggcatagcagcgaccggaggggcggcgcggcgcacgggagagaggcgcgaggttgggccgagatcgaacggttggcggacaatgaatagtgcgccaaaagaaagaaaaggggaatagagggagagggtggggctaaactgtaaaagtgaatgtgattgggtttgaattgaaatgtcatctatacattttgggttttgagaattcaaatgttttatttaaatatttatttggttattcattagttcccaaatgaatttgctttccattaaattatccaatataacatataggctttgatatttcttaaaaaaactaattaaatattctaatgtgacctttaataatacaatagcacattggtcaagtttatttgtataacaatgtattttacatggacatgtttaatctattattccataaaattaaattgagacttggtgcaatattaatctagaacgcattttatatataaagctcaatttatttgcatgacaaattattttacatgagtgaatccatcccatgagagacttgatgaacatataaatattaatttaattattctagtgaaacactcctttatatatagggtcgttgtagtggcgactattttcctagttacttagatgtcatgacacttgtcaacatggttcaagtatttaacattcaatttgtaatctacattatagaaactaataattggcttgtgctttatttggctttgcgttcttgtgcataaatacttatagggttaacaatatattgtcgtaaactttagttattacttagatgtgcatcttttaatttgatttttctattgagacgatttacagtttggcaagcaataacaaccataacatccagtatgatgtaaaagttttaaaaagtttaaaattttagtgatttttattatcgggaatttttagggtgttacacgcgtgcactgcaccgatcttgtgtatgcagtgtgtacggtggccgatagctagggtgtgccaagaagtcaagaatatgatgtgccgttcgttaattcgagagcagatcaataaagaaaacaaatacttccaccttctttaaacaagaagactattcctaacattctaacgatggaattagtggagccttaaaaaaattccatataaaccggtgattaaaggtggaaatgaaaacccatggtgtggttaaaatgggatgggggggagtaggtttttactcatgttgagttcctagggctagttaagaacctatattttgtggttgtgaaaccggagccatttttatcgccgggatgtaattaaaactctgatttttttccaaaaaggggtccaattttatacgggtttccctaatgaacactttaaaaaaataaaccttttacaccttgaaaaccacgccacctggttattttttagtggccacaatatattgggggaaaaggggatatctgttcccggggaaaagtgttcctcaaattccccaacaaataacggggaataaaaaaaaacgcgggcgcatggggagacaaca

SEQ ID NO: 21868 - DNA, 739 bp, Oryza sativa
  unsure (1)..(739): unsure at all n locations
cgcacgttgatgacangcgcctgcgncnnnnnnnnnnnnnnnnnnnnnnnnnnnnnnnnnnctggttttgctaattctttctccgcttttcactaggagaaatcacatcagtcaactccgccacttcattgagactaatcgcgacaagtttcgtctgaactgaggttagttcaggtagaagtgcaataggtggagaagcaaaggcatccattacattgatgctttttgtctgcaggcaatggcaaggccggtttttacagcactcacgctcgtcgtagcccctgttcttgcctggagaactgtctacaacagccggatacaatgccttcctgcagtttgttgggctgctggtggaatttgttgggctgctggtggcatcgtcaacagggctcagttctttactctgtgacttgttcttgtcgacagagcttggaagaagacccttgcgcttcttaggggatggaacttccggtttagtatgttgagaagacaacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21869 - DNA, 966 bp, Oryza sativa
  unsure (1)..(966): unsure at all n locations
naggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtaagttactctagcatatcctacatttatattggtgttaatgtatcaagacatatatatctatctagatttattaacaccaatataaatataagaaatattagaatgacttacattgtgaaacgaaggaagtaagtgggaatgtcatattcttttgcttggtcctcatgtcttggcatttttcttaagataatactctctccatcccaaatataatgcgttcacgtatttcaagattccaccttcaaaacattttgaccaacatttagtacaatataaatttaattttacttgctaaaaattatatcattggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21870 - DNA, 967 bp, Oryza sativa
  unsure (1)..(967): unsure at all n locations
aaagctagatttttgacccggctggaaacagttgacaacgtgcgatccattcgcctgattgggcgtgtcgcgtatcaaaataaacaaccactaatacattctcaaatcatcctacttgccctacactntgcagctaacaatgattcatttttaaactgtgctctcaaattgtaatccccccaaattgcaacacaaatcatgtggtcaacaccaacgaattntgctgtaaattaagcntgctgtgtgatttaccttgtcgagaagaatgttggaggccttgaagtcgcggtagatcaccggcgtctcggcctcgtgcaggaaggcgagccccttcgccgcgccgacggcgatcttcagccgcgtcgaccatggcaacgaagcaagaagatctgcacacccaatgaatcacacactcgattagcaaaagctgcaacagctaacacacggtaattaaccccaaatcatgtggtaattagtaactacttactcttgaacaggtggttctcgaggctgcctcttggcatgtactcgtagaccagcatcctgtgatcatcttggttgcagaatcctaccagcttcaccagatgaggatggctcagcatccccagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 21871 - DNA, 753 bp, Oryza sativa
  unsure (1)..(753): unsure at all n locations
agtatttcaggaatttagacattctccacatatttgagtataaccctttatttatcttcagaatgtacaacaaatgtctgtccaaagagaaaatttgggttggataggtcagtcaatggagcagaaacacatcagccggtaaagttctcctgcagcaatattataattttcagtttagtcaattctcaattaattgtaaagcgaaatttgtactaattaacagcacaaaaatattgtacgcgagctccccgtcgtcggacagcacgctggtgatgccgccgctgctcttcttcctctcagaagaaatttccagcaagccgatgcggatgctgttctgctgccctcatatgccccttttctttatgaagatagctcagagctgcaggactaaagagagtaaattttcagtccatttttgattcattagctaaccaaaggtaggaataaggaggaaaagctcagagttgtaggagcttaactgtctgcaaagatgacattttgattcgtatgatgatctgatctcctagtaggtcatgaaaaatgaagttattttttgatggaggaagtagaaaatagagagatagatggtgatgtaaaaatttgtttttaaagtatactcattcacatactttttttatgagatataaaccaataataatcatgggttccaaatcataagcttgtnccgnnnnctcccnnnngangannntgcntnccaggtttnnnggcattaatggngatcattaaccactn

SEQ ID NO: 21872 - DNA, 927 bp, Oryza sativa
  unsure (1)..(927): unsure at all n locations
agtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttgacccggctggaaacagttgacaacgtgcgatccattcgcctgattgggcgtgtcgcgtatacaaaataaacaaccactactacattctcaattcatcctacttgccctacactctgcagcttaacaatgattcaatttttaaactgtgctctcaaattgtcatccccccaaattgcaacacaaatcatgtggtcaacaccaacgaattttgctgtaaattaagcttgctgtgtgatttaccttgtcgagaagaatgttggaggccttgaagtcgcggtagatcaccggcgtctcggcctcgtgcaggaaggcgagccccttcgccgcgccgacggcgatcttcagccgcgtcgaccatggcaacgaagcaagaagatctgcacacccaatgaatcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21873 - DNA, 1243 bp, Oryza sativa
  unsure (1)..(1243): unsure at all n locations
actgtcacgttgactacttgctncncacgcncgcnnnnnnnnnnnnnnnnnnnnnnnnnacattatgagtacactaggtgaaacatatttggtggaacaaaaaatgaaacgaattcccttaatagagggtttccaaaatatatgggtgatttattgcaaaagaatgtttcgttcactacaacattagatttatacatagtgaaacattgtaagtacactaggtgaaacattttttgtggaacaaaaaatgaaacgaatttccttaatagagggtttccaaaatactatgtgggtgatttgttgcaatggagtatatagtggagacacatgacaggtgggggcagaaaacatggtggggcccaggcgcctgcatgcacccgtgtgggggacggggcgcgcggggggagcgcccgatctgctccacccccgtcgggcgcccggcctgcagcattttcggttatataatataactttcactaaaatagtaacaatagcaaaggtctttgagatgggttgggatgcctttgaattcagaaggacactaggtggggatatggctgtgaaatgagaacattaataaaagctttgtaatgggaaaattttgcaaaatgggaaagacaagctcatttggacacttacaaaaagtggggtttttactgtcaaatctttttactatgcaatgaagggacacaggtcgtgcaatactgcaggctgacatgtgggccctgtcagcctacagtactgcacatgcagtactgcaggggnnnnnnnnnnnnnnnnnnnnnnnnnnnnnnnnnnnnnnnnnnnnnnnnnnnnnnnagcttgagtattttataagggcaccctaaatagactggcggaaacaatggcaatagctgtttcttgggtgaaattgttttccgcttacaattcccacaacatacgagcccggagcataaatggtaaggccggggtggctaatgagtgggctacctccattaatggggtgcgctaatgtcccttttcaagcgggaaaccggtgtgccacttgattatggaatgccacccccggggggagggggttgcgtatgggcttttccctttctcgtcaataaaccttggctcgggcntgggtgcgggggcgattaccttctcaagggggtatcggtttccacaataggggaccccggaataaattggtcaagagcccaaggccgaccctaaaggcggtgttgggtttttagttccccctcgagagtaaaaa

SEQ ID NO: 21874 - DNA, 1342 bp, Oryza sativa
  unsure (1)..(1342): unsure at all n locations
atcaggtagcacagtccttcngttagtgtgaacactggatcttgtatacctacagattccaccacaaaccaggaaatatcagaggctttccaggactgtaggaacagattgtcgaaaaacaaaataggtcatctttcaatagaaacanaaatagagccaaacagggacactatcagaaagggcaaaggcatgaaacacgcactataactacaggcagaaagaaaagaaccatcaatgtgttgaaatttagcttgacgccataaaaagatgcattcttttatgctctggcatcattcttgaaggaacagataatgctactcctagcatagaaacacctcggcgtcatttccatagaatgatcgtgaggaaaacagtagatattctatttatctataagtagccaccgtatttgttctacgccaagaaattcccacgctaatcaaagatgagaaagatttgcgtctccaagtggaacaaagcattcatttccatagaatgattgtatttgccacaaagaaagcaatgcacttcttgtggaaatacatacagctatattccacttgcttattaaggatgaaggtgactatttcactattctgcggaccaagaaacggaagctaaaggttttctcatgcccatttctcgatctccctctttctccattgatgaaaccgtttcttaatcccttttttatttccttatcaggtgactttagtaacatgggctgaatatctctgtgatttcttggaaatgacaaaaactgaagaactcaccagaaacattgcaacagtaagaaagggttattatagtcttattgatactgatatcaaacttaagattctccgggaactagtagaagaagctattacaacttctcctgtaagagagaaactaagtgaacgggtggaccagcggcaagcgctcgctgcgactaaaagagagagtactagaaaggcaaaggatgagcagaactcaagcattgatggattgcaagatgacaatgagagtgttgatgagcagggtaaggggaaagaagaaaaggataagaacaatatctctcgaagcaagacagaagggaaacgccatggggtgagcatctgttctcaatccatgtacttgcatgtgatggacctttctctgtatttaacccatgttctgttattgtttaccacaattggtagtgagcctgattattatgcttactccctactttttgtaggtacagcacctcgaaacagagattgaaaaattatccatccgttccagcccccttggaaaagacagacactataacaggtattggtttttcaggcgtgaaggaaggctttttgttgaaagtgca

SEQ ID NO: 21875 - DNA, 1730 bp, Oryza sativa
  unsure (1)..(1730): unsure at all n locations
aaattcattgatttatggaccaaagatagaaattactttgtttttgaccaaatgacaagaggataaaaataaacccacttattttagaatggagttagaatggagaaagcatatcattcaactggcgatggcatgaggacatttttcattagcttacatgcatttcaacgagaagaagaaagggcgaggaagttgaggtaagatagtgtgattgatagatggccgagtgaaatgagagaggtgataatggtcgctcaaagtggaaagctaagcttagctggagagagtgagaggggaggagagttttgagatggaaagaggtaggtggattagaagggaagtgtgagatatgttatagaatcccaagtcatgtgcttacgagaagaatcaagcaacttaaaagagtaaattgcatatagggccacttctttttacccatgtggcaagttggaataggagcagcacaacatttttagtttgaaccgggaaagattacatatagtttcactttgggacactttgcttcttctccatctttccctctcttcccttgcgctctctctctccttgagctcgctaggctgatgtgaaagctcaaacatgcaataactaacagagcactttgaagtgccaccctccgtcgcattgttcgcatctcgtcaaattgctcctgcaccacatagcccctaagcttgagcggatctgcgcttgcgtcgatttgaggcggccatctcgacggtttatggttgacgatgagcaagcctagctccatccttccttcgtgcaaccatgtttcagtttgaggacatggagaagagctcatcaagtggctcatgcatcaatcaggtccaaattgcaacaatttgtaagtccatctggtttaaagtgaaaatatgagatgagacctagtccattatgcaactttgataaagaaatccagtccaaaccgcaattaactcaacattaaatttcaagttttgaccaataagacaatgaaggataaaaagtttcttttattctaaacaacctaaaaatatttatatttagaaacaaagggacatatgcgaaatattaacataagaaaccttcgccttgccttgtaccggtgaacgaaggaaagaaagtaaaaaaacaagtcctgtatagggtgcttttgattccgagggaagctcttgtagacaattctacttttttatctagattgtgagaagttatagttgtataatcgagaaaaacaagaagtttattcttcagattctctccggtcaaatttccacccacaatttctcatgatctaaaagctatccaaatatacctcctaaggtcggaaccaaagaagtcagtaaggaacatcaagcaagaaaacactgatggtgtgtttggaaaataaaaacgaatggaggtataggataaaacggggtgagaagaatggatgaagattcaaacatgccctttgaggggtgggaaatcatatccaaacccattttctaaacatggcatgatagtacgagcatcataattttctaataaaagtgttttacaaaaatacaggtgcactttagctagtacggagtgttggacacgagtataataaaaaggttggtagaattaaatggaggaatgctgttattggttaagaaaaggatgcatnnnnnnnnnnnnnnnnnnnnnnnnnnnnnnnnnnnnnnnnnnnnnnnnnnngtccaataggatgtgcaaccaaggccgcg

SEQ ID NO: 21876 - DNA, 743 bp, Oryza sativa
  unsure (1)..(743): unsure at all n locations
naggggttgaacnntcgnttgnnanganncnncanantngaggaattcggaaccccccaggcgccatcgacggcggccaagatttgctacccctcgccgtcgcggttgtccacgtgctccgtccagctgctgcagcgacgacgttcttcctctccatgacgctcatctacacccatgtccgtgctgttggccgcggtgaagggggagccggtgccgccgccaccgccgccgggaacgtgccgatcgcgacgaccaccgtggagctcctcgccaagctggtcctcgccgctgcgcttgtcacggtcgttcttaccctcacttccaccgtccttgctgcctcctacgccgactgatcgacgagctgagtttcttcctactgctggtaagcgatttgagccatttttcttgagtcatctgtgctggttatgggatcgacaatgttcagacttgtccgagagttagtgttcatcctgtgctgtaacaagatcggattatatgtgctgcaagtgtgcttttctggtcattttgtatgtgaccagctgcaactcttcgatacttattaatggcttgtggatttgatggactcgtgttgtggtatagcgcacactatgttgcagtagcattatatcgtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21877 - DNA, 727 bp, Oryza sativa
  unsure (1)..(727): unsure at all n locations
agtgtgccttttgagtgactaactcctnnnnnnnnnnnnnnnnnnnnnnnnnnnnnnnnnnnnnnnnnnnnnnnnnnnnnnnnnnnnnnnnnccagtaaattgattctccactctctgaaggtactcagtgggtggtacaagctgggattgctcagtactatttttcatgaggtgtttggaatggatagtggagatatggagccaacaattcctttgaaaactttccatgaaatcaagaatttttttgtgactatagatttacactgaagtgtaaattaaagttgaagtgaaaaactgaaaactgaagtggcagtatcaatttggttaaaattgcaggcgttaggcccagacagcaacctgctgggtggcgcgaagggcgggtcgtcgccggtgaggtcggtggggatgcactccatcggcgaccacaccgccatcgagctcaaggggcccgaccggacgggcctcctctccgaggtcttcgccgtgctcgccgagctcggctgcaacgtgctcgccgccgaggtgtggacgcaccgcgcccgcgtcgcctgcgtcgtgtacgtgaacgacgtcgcgtcggggcaggccgtcggcgacccgtgccgcctgtcccggatcgagcaccgncttcgcctcgtnctcccgggccacgccggcggcgacgacggcgacggcgacgacggcccggcgcacgccaacttcttcttcttcggcggcgccgggtcg

SEQ ID NO: 21878 - DNA, 727 bp, Oryza sativa
  unsure (1)..(727): unsure at all n locations
ccgcgcccngtggagtactcgnnnnnnnnnnnnnnnnnnnnnnnnnnnnnnnnnnnnnnnnnnnnnnnnnnnnnnnnnnnnnnnnnactattcacgatatcggctacgtgacaatggaattaggggagattggcccattagccccaactccatcacgtttttcgtgaaaaatctccattagccctaactgcacgtgggacctacctgtcacttccatctatacctccctcccttctcttctctttcccctctcctctctctccaccaccgtcgcaaccgccgtcatcgaccacctccgtggtgggaggcctcgggagccgccgccgccaccatcctcgacccatccgacgtgggagggctcgggagacaacaccgtcctgaacgctattcacgacaggaggttcgggagccgccatcctcaacgccatctgcaagagagggctcgggagccaccgctatcgctgtcctcgaccccatccgtgacgggagggctctggagccgccgccgccactgtcgtcgctgtcctcgacgccatttgcgacgggagggctcgggggacgccgccagcatcgccaccttcgtcctcgacgccatccgcgagagagggctcgggaaccgncgncgccttccttgacaccatncgcgcgggagggttcgggagccaccgccggcgagccatccgacgcgggagggctcgggagccaacaccgtacctgacgctattcc

SEQ ID NO: 21879 - DNA, 850 bp, Oryza sativa
  unsure (1)..(850): unsure at all n locations
ccgcgccagtgaatgtccactttnnnnnnnnnnnnnnnnnnnnnnnnnnnnnnnnnnnnnnnnnnnnnnnnnnnnnnnnnnnnnnnnataagcgaggttttttttctatggcaggtatgacttttggagtcaaatggccgctaatgaaaataaaaaccggggtgaattgctgagtttgatgaattgatgccttgatcgaagctgacaaagagaaatgtgcttcatttgaagacgttctgcgtgctgcccaagtatatttggcaatgtgcctactccagcatggcgacgatagtcaaatcgaagtcatctaccagcttttctaatttaatttccttgactgcatgtaggaagccattgtgctgcccccatgtgttgcactggccatcaggcggccaaggtctggtgtctgggactacatttgggtgaatgtgagtgagttggctgtggaggagctgagtgttcctgagtacttggaattcatggaacagcttgttgatggacagtaagttccagaaagacgatatgcacattataactgaagcaacataacagtctgaattcaacctctccttttcttaaacagcaccaacagttgttctcgagcttgattttgagcccttcaatgccttcttcccgtgcctgttcatgtccaagtccatcggagatgggtgcagttccttaaccgtcacttgtcgtccaagttgttccaggacaaagagagcctctaccccttgctgaacttcctggaagaccatgaccactgtgggcacggtcaggacctaccaaatgcttttctactgcatattttttcttggtttgaaattgctgctgttagtnctttagaaagctn

SEQ ID NO: 21880 - DNA, 648 bp, Oryza sativa
cccccatggattttagacaaaccggaaacgggaagaaaattcccgaaaacgggaataatccttcccgaaatcaggaataaccttcccgaaaacggtagacacccaatacaagaacaagaacagtattaaaagatcttcgtccgagaattctgacgaatcctctgacgcacgtctgaagaaatttttatcaactcatcctgaagctgcggtctacacaccatccggtgcgaagtggggctctgctgaagacctcgagacagctaagtggatttcctccagggtgaagctgattaacccaacctgcaaagccccggacatgacctcctggtctaacactgttcgcctgatgcgccagatagacaaccggtcgcaccaggacatctgcgcgctgtatgactgggctagcaaacaccacttctggcagaccaacatcctgagtcccgaaagcctgcgtaagcagtgggacaagctgacaatgcagcgtaacgccggaggtgagcagcgcgctgtcaagccagatctggacttcaacaacactgactgggcctatggggggatccgatgaaatctcttgcagagcagatgcgtaaccacgaccgcgagcagatgagccgcatggtccataacctgccagagcagtaccaggag

SEQ ID NO: 21881 - DNA, 731 bp, Oryza sativa
  unsure (1)..(731): unsure at all n locations
ccgtgcagtgattcctgatagcactncacnnnnnnnnnnngnnnnnnnnnnnnggggggggggnngggaangggggcccccgaagtttccatataagaacccaatacgatattaaccaaaattcgaaatagggaaaaataaaatccaaaattagaaaaggaaaggagagtccaagtagaagtccaatttaaaaatagctaaaattcggaattaaaaataaggaatatcaaaagaagagtccatataagaacccaatacgagattaattaaaatttaaaataaaaataaaaataaatccgaaattataaaaggatatatgtatggcacatgaatggacaagtgtgtacacatgttttgaaatgtacgtagatcaactagcacaataacacaaacagttcaatttttaatacatcctgtggatcttgtgagggaaactaaacttgtgcaaacagttgccaaaaaaaaggtgcaagcactaccacatttatgtgtgctaagcatatgaataggcagaattgtaacaacaggacaagactggagatatatatcgaggtcctacctcaaaagatcatcatagaaatctgggttgtccttcaagttgatggttggaacagaagcatacttaggtcccagcttctcagaaatagtattcggctgcagatctatcaagaaaaatgcatggtgcaccgttaaaaagaaatgatggaacatcagagaaacattnttttgta

SEQ ID NO: 21882 - DNA, 912 bp, Oryza sativa
  unsure (1)..(912): unsure at all n locations
nannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaattaattcatagacttaacatgatcggtttctggcagagctgaaaaagagctgacatgctcattccattctacttccacggtatcttttgatgtggaaatccactgagcagttgaacggagagcaactgatgcattggacgggaatccatagcgatcagcaaaagccttctgcaggtattccactccacctgagccctttataattggttctaatagttggatacgtgctctactgacttctgtcttcagagcctgtttattttacaaaaaaaataaaaaaaatggaggctgttataggttcacaatgtatattccatgaagtttatttaagaactcaaggagttcacaaacctttagttcttccatggtgaagcgcaaacctttgaatacagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 21883 - DNA, 722 bp, Oryza sativa
  unsure (1)..(722): unsure at all n locations
ggtattgaatcaccatagtatatgccctgcaacgacgcnccttagactcgggaattcggtacccccatttggggccggtccaattttccggatgtgctcatagggataggatgtgtgtagagatggcaatggggacccataacccgagacccgacgggtttttactctattaggagctaatcgtgttcttactgttatacccatgggtctactaacgggcgaaaactcttacccattgggtacgtgggtatgggtctgttctttacccacccgtacccaccaacccgtgggtaaaaaaaacccgttgattgaacctaaaactatgagcaatataagtttcaacgactactaaatcatagcataaaacttctttcacatcttaagcattgttctatactagttatgtgaaattattattagatttattgattatgtattgtggttgtataatttttttactcgcctttgaacactaatattaatagcattgttgctagagaaaatattgatagtttagaactctaatatggctaattagagtacaaaactataaatgctacaagtcaattatatgggtatgggtacccgttagatacccgttacccgcatgggtatgggtatggggacgattttgtacccgcgacgggtgtgggtatttaagtaggaatattttaacatcatgggtgtagggctgtgaacgagccaagctcgagcgagtttga

SEQ ID NO: 21884 - DNA, 863 bp, Oryza sativa
  unsure (1)..(863): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtagtaagtagttcttaccttcactaaggtgcagtcgctgcaggtgctgttgtcaatgcataccctgcagaaaattatcagcttgttagctacagaaagtagcggagcttccgacaatagcctgaaatgaaacaggataatgatatgaggagctctggaatttagatgtttaaattagagatccacctaggagggttgatgcgctgactgaagttctcatactccggatcaaagtaaggcagcatatcttccaaggttacgaatcttccctctgaaagaattacgagttgaaaaccagcactgtcatgatgcgaggtatgcagatatatataagcaaacagaagtacacagtttcgtcttgtgaaccatctgtgatagaatccaatcatgagggtagaaacttcgatcttaaaatcatcaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21885 - DNA, 991 bp, Oryza sativa
  unsure (1)..(991): unsure at all n locations
ccgccgaagcgcacgaagtcattaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagataaatatgctctgctaggtgactaggtccctctttctgttaccttttctgctcggcagccacaagctttgcttcaaggcgcttcttaggatcctcctcctgagatggacacgaagggtatctgactgtgcacctcgctttgcacgataacgcttcatgaaattgctggaggaatagaatacacatgagttaacaagccacagtgatcgtacttttttctgccagtccttcaaatgaacttggcaacaacaccaattttaattgttgtttgtagaacccattttacaggctgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21886 - DNA, 731 bp, Oryza sativa
  unsure (1)..(731): unsure at all n locations
gcgcgttgtattatcctnnnnnnnnnnnnnnnnnnnnnnnnnnnnnnnnnnnnnnnnnnnnnnnnnnnnnnnnnnntgatttattataagcagcgacggatggacatgccgatcgtgttctgggaaaaagacttatccatgtgccggtggttgcggttctctaggctattgaaaaacaacctactgatcggggtgattccatccgctgctctcacagtttccaaatttgaagattttcgtttttgcgcgaaacttcttatttttgtggacggtaattaccgagctcccagctgtataattgatgcgtgccctggaaggacttggcacataacaaactgagtggaacggatcctacactggtatatggggacgacgttcttcaatacttgtgagttatccatattcagcgctgccagttccaaaattgtgcacaatgtctagcttatgacgcttttaatgccttgcaggtttgtacctacttgcatgccattgcttttttactgtttttttggaaaatcattcgaatctctttaaaaacatgttttaagcttttttacgctgctcaaatgtatattgactttatgttgactcactaccattgtacgcaggccgcgttatgtcaaatactgacatctcttatctgaattgtggctgaactaacattgtccctacgggattacgcgctcttaacttgatacggcagtgattgccaccgatatatgcccagctga

SEQ ID NO: 21887 - DNA, 1015 bp, Oryza sativa
  unsure (1)..(1015): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtgaaatggtatgcctcaagatatcatagaaatttgcagtgatatgattaatagttagttggtagtatctgaactgcgatcgccaagtagcacgacatgcctgtcttatcttccaggttaacatgtcaaaatgattagtacattaaattgaattgattctcttgtacttgttaggtgttgcatgaaaacaatgtcaagaaagaggatctcaaggctcgtgcaatggcactgaaaattcttgggaagatattccaggtatatgttacttggccttttcattaggataattcataccgctacatgagatttattttatcataatttgcaaataccatattaattcaattggactacaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttagggaaagg

SEQ ID NO: 21888 - DNA, 1410 bp, Oryza sativa
  unsure (1)..(1410): unsure at all n locations
gcgtgaggtagaacacatgtctnnnnnnnnnnnnnnnnnnnnnnnnnnnnnnnnnnnnnnnnnnnnnnnnnnnnntctctgcaatcgattttattgtccatcatttcatgtggttgccagtattcatggttcttgttgcagcacacgattccacgataaagaggccaaaccaccaaatttcttcgcaacaagaggacaatggccaatgattgttgcagctaattaactttaaacactcaggtagttgatgcattgccctcaagcacattaggaagcactgttacagcccttccagtggaaagtacaggtccataatgtcaaggcgtaagctagataacttgactgtgcacaccgtaatgggcaactgttgttaggattctaatatcattcggtgcggatctaggggttgaactacctcatggagataaagatgattgacttagggagtgaacggggaaggggagagagagagacataccggcgtcggtctttgagcttgatgcggccatggcgacggtgtggcggcgtcggtgtgaacgatgacggtggtggtggtgcggctgtgaggaatccccccacttcaacgccttcccggatcggagggttctagggttttgtggggagtgcgtgtgcgccgtcaaacgtttcttttagtgtgccggccactcccccctttttatttggcactgcgtgagagggaccacagccatcgtacggctggcgccccagatcagggcgtgtgagtgcggagtggggaatcggtttcctgattccccaggagattgcaactaacattctcccctttgatctccgcctttcttacttctcatactcaatattcacttctaaatagattgatgtatagagcacgcttcatcatgacagtcaccactgagccatcagacgcaacaactacaatacctccctatttcgaaataaacactaggcccttttaagccaaggatcataggctttcccgtaagccatggatcctagacttcgtatggctcctttctttatttgtttaacatactttcctttaatacaatcgatgcaatattcggaatccataaagtctaacggatacaaaatttcttctttaattaatcgttcaattatccccttcgaaatgtggcctaaatgacagtgccacaatttcgcagatgtttcgtcattgcatcgtttgcgcttatttcttacattcgtagacggggaagacatactattgcacgcaacattctcttcattgcatacaacattctcattctcatgtttaggcaacatataaagcttgccttgttatatggcaagacccacacacttattcttgaatataattgaacataattggtgatcgaaaaagcaattatatccatcatccgctaaacatgaaacataaaccaaattttn

SEQ ID NO: 21889 - DNA, 15234 bp, Oryza sativa
  unsure (1)..(15234): unsure at all n locations
cgcgccnggataagcactgcgcctnnnnnnnnnnnnnnnnnnnnnnnnnnnnnnnnnnnnnnnnctagttcaccttatttttgcctccttgctttcagattttgaggcttttgttgtcaactacaactcacagctagaaaactgggacattgagaagctcattgccatatgtgtgcaagaagaggatagacccaaggctcgtggtgattccgccaactatgtgaagcacaacaagaagaggaacaactacaaccagaatgctgcctctcctaaggcaccacaaagtgatccacatcacgaccaagcaatgtagaagtggacaaggacacttgcaagtggtgcaagaagaaggggcactatcagaaagattgccctgatttcctaaagcatctcataaagaagggtgaggacattattacatttgaagatgaatccctgtacataagttatttaaaatccacttggtgggttgattcaggtgcgatcattcatgttgcaaattcattacagagattccatacgaggaggatgctaacaagaggagaaagatgcattagagtggcaaatggagttgaggctgaagttgaagcaattggagaacatccattagaattgaataatagcttcacacttcatttacacaatgttctctatgtaccctttttgagtagaaatttggtgctgccatgctccacatcattgcgagtggcgtggccaaatctttgcaacgccatgatctcttcccaacatgacagtattgccctgtagcaccagctataacggaattgcaaatagccaaatacattcagatttggaaatgggaggtgtagaggtttatcttaaacttaagtttcaaaaattcgtgatcagtaaccagtatcggacctgatataacaccacatataccatggagtaagcggcaatatggctgtacttaacaaagaaataccagttcagaggctctggcaatggcccctgctcgtgcggggcctgtgtttccttgtcctcaactcctaattgtttttattggattcttattgattgctgctcaagcaccctatgccatgaggtgcatataggctgccaattgtgtggatagttcttgatggtgccattgatactccatctctgcaatcaattttatactccatcatttcaagtggttgccagtattccatggttcttgttgcagcatagctgacaacacgattccacgataaagaggacaaatcaccaaatttcttcgcaacaagagaacaatggccaatgattgttgcagctaattaactttaaacactcaggtgatgcatcgccctcaagcacattaggaagcaccattacagcccttctagtggaaaggacaggaccataatatcaaggcgtaagctagataacttggctgtgcacaccgcaatgggcaactgtctcatgccttagtgtttctctcatatatattgcaactgtctcatgccttagtgtttctctcatatatattgcttgaagccatgggttgttccagtttgcttgtctataagaaatggaatatacctaattttctctatactgtttttgagaaggtttccagtgctaatcggttatgtgtacatattatatgtccatactaggacatcaatggaaatgtgttagaatattggcttcaaatagccaaacttggagtaaccagtaaaaaccaatttgattttgctaaaattatttctgatgctatgtgcgatgatagccttgaatcagcatgtattgaaatcactatattagtgtgagcaagttcatagctaccactccattactcgtgagccacttatgtccgtcccgtaatataagggattttaggtggatgtgacacatcctagtacaatgaatctggacagacggtctatccagattcatgtgtcacatccacccaaaattccttatattatgggacggagcaagtatttgttggtcttacattgctggaatactttggataactggagtacatatatgagggactgggttctaaaacctttttctcgagttgtcttctaaattcttagggcccttgctccaatcttgttccccctgtgtgaaagcggctggttctgtagtttgagaattctgctgattccaactattccattattattatcatgtaataagagtagaaaaactaaagagaaggcataaccagaagaattgtgactttgtgagaagtttatttatcatttcaatttggattttaattcaatggcacttgagatgactttggacacaattatcctctcaataagtatttctagcccaagttttatatcaattttttacatatttttcaggagtgattttgaggcctggttttattcatggaactcgccgtgtcggtagcgtaaaaatacctcttggacttgttggttctcctatgcaaatggtaaaagtctcttcattctgtttttgcaagccttgcaacacagttatttttgctcttattccaaatgtaaagttgtttttaagacttaatttgaagatctccctgtgcactgcaggttctccaaagtgcgaagccgttgacgagattgccgctggttggcccactgttgacccctccagtgagtgttgcctccgtggcgaaggtcgctgtaagagcagcaactgatccagtgtttcctccgggtattgttgatgtgtacggcatcatgcgatacagtgaccagaagtagaagtaataaatattacaccggatcatacaaattctatctccgaatgaataagcagatgtggctggcacgttagacttttgcgcttgtttcgttttcatagatttttacagttagtaggggaaccttatttaactgatccatgtcaatcagtggtgaagatgtatatagtaaataaatcgtatcatgctcaccatgtttgattgcagtcaatgatctgctctcgtccatgttgcatctgaagttttttaagtggctacattttaaagcatccatcagttctaagatatcccttctaaattataaaatataaaacatactcagtccgttttaaattgctagtttgttccaagttaaacattttaatctttgaccatcgattcctataattttacaataatttaacatcgtacgatttatattttatttttagatttaccatgagcactacttttataatatataatttacatataatttacatgtttctaaactccaggcttttaaaaactgatggttgtgttacctggagtagaatgatatggagagtattagacttttacacggtcttcatgttatctttgatcgttaatttcttttataatatagcaataaaaggtatacccccaaaactttgattgaaagttcatctagcacctctgaactttgaagcccagacatccaacccccaaacataccttttatataacaccttaatatagttttacaaagtggtttttatctatgttgaataagttttgctaggtgacatatgcattagataagttaaaatctccacctaaatctttcgttttaacaacatatttttgctctcatttacaaacagttgacaatattataatactaatatgacatcactagagtataatttaaaatttaatgatcaatgatcgacgatatgtaaacatgctatattagccattcaaaattgctgatttaagctttcaaatatgcaaaaccactatcttaaacaaccttaggatgtgagtggtatcgtaaagtttatatatccttttccaaccatcatataaaaaatataatttttaacgactactacaataccatcatataaaaatataattttagttcaattagcacgattctcagttctgataaaccaaaacactactagtacaaatagatagataattcaatagggcaaatcctcatcatcgaccaaatgaattagcagcctcgtatcatctcagaaatggtacatcatagtacagcagcacctgcactaatttatgctctaaaaatcggctgatccaaagcctccgggctctcttaagctgaaggatacacgaccacatgacatcgacaaaattgttcgttacagcgtcagaaaaattttcagacaaaaagttcagcgtctctcacctgcctacacctacacatacttgcctctgtacttaggcttggagtccctgtctatggccggcttcccgtcggcggcggcggcggcctgatcggcggggctgaacacggcggagtggaggttcccctcctccatccacttatggtggttctccctgaactcgcggcgccgctcctccgccgccttctcgacctcctcggtgtagggcccgaccttcaccatggtcagcaggacccggctgtacctcatgctcaggatctgctcgcaggaggcaagcagcctgaagcaggggtgctccgggtacttggccgggttggcgacgccgtcctcgcggacgacggggaagaagaagaccagccggccacccatgaccagcatcctcgcggcgaggtggaggaggtcgtggacgcactccgcgaggctgtacggcgcggtggatgggatgtggctgtccctcttctcgtccggaaccgtgtacggagcgacggtgccctttatgagcttccggccaccggacttgcggcctccagcccggactccgtatggtggatcacagatgatggcatcgaaaacctgattgatcgcaagcatcaatagtgtgtttatcatatcttgtcgaaaaaattgaaacaacggagtaaatcagtaactttccagagtatcttgtagcatacaagcagaagatatatcaagccaatggttatggaaagttttattaaaaaaaaaagctatggaaattaaggcccatgcgcttgtaggctacaatagcttcatatggaaattcagttgtaggaaatatttcatcagttaaaaagctacgtgagaattcaattacttcagcatcaaccattttctcaagcaatgtcaaccaaataaagcaatgcaagaatgtaaataacaaatccaagatttcaagcacaactaaaatattgcatgaatgtacaggaatcactttatgcgttcctcacatttgtttcagtttttagtcgcgcatatagtacaagcttacactgtcaaaactgtaaaattcaaaaaaatacaacaatgtataaaccgcacaacagagtattacctccttcaatcctggacgccaaggtgggacgttgttatccgctcttagtatacataatggttccggcaatttgtactgaagaagacaatataattagtacttcacacgaacctcgggtgttttactaacaagtgataaatgccgaaatgtcactatagttagtacacataatctgcataagctatatgataccaagtcaaaaactaggcaagaacagcgtttaagaactaactgtcataagagaattgcagctcacacagaatcaagcagatcacaacaggatggaagaatctaagcaaaaaataatagctaacttcaatcaatcacctgctcaaagttgctccaaatattgcaatctggaccacgaccgtcccgcacaacccttatatcaatatctgcaccctgaaaggctctttatcagtaagacatactcacaagcagaatgaaaattattcgttatccgtgcaataagcacaaaccattgtcatggctccaaaatgcgcggctgcaaccaaaatactcccagtcccaacaaaagggtcatatacgagcttcccggggcgcgccagcccttgattcgccataagaaatgccatttcagcatccattgcggtcgggccaatatacttcctgctcttcagctgatatgtcggcaggagatgcctatccgccgctccaacctcgcggccaaagaataccgtcctctgagcaaccggcgggaggccattgttgcagccatagtcatcagtctccatgacaaagaacttatgatcgggcttcttcaaattaacacggccctggaaatgaggaacagcaccaattacacacaagagaaaataaatgcatctgacatccacaaattcgtgatccgaactactccatgaactcccttcgtcccaaaataagttcatttttcaccaatccaataccaatacaacataaaaaagactataatacctactttatcaaatcccaacgcaattattcctcactttatctactcctaacatatttatcttctattttcataaactccgatgcagtggttactcaaaaatgaacttattttgggacaaactggggaggctaaaattgaacttattatggctcaaaaatgaatttaccttgaaggggatgtaggtgaggctcttcatgatgtcgttctgctcctggaagctgatgaccttgccgaagctgtcgacgacgatcttgaaggtgctctccggcgtcaggtacggcagcttcctctcctcggggtacgccatgaccaccctctccagctcctcgtaggtggtgccttgcccccacagctcgtagatccccttcaccagcaagcctacaaacacacacatggcgtcgcggcgccccccaagattaacccgcaagaagaagcttagccagcgaatggtggtgaatcaatcgatcaggcgaggcgcttttactgcggttggcgatctgcgcggcgaggcgctcgtcgcccgggaggcggacgaggtggaagggggagtcgacgtggtggttctccggcatgcgccactcgacggcgtccccggcgccaggcccgccgaagagctcggcgagggactgcacctcgggccgccggtagtcgaggagcctgtggtagaagacgcagaggtaccacatcctgtcggctcggcgtgtggccctaccgggctcagctccggcgagtcgacgcgggcggcggcggcggcgagcgggcggagaggaggggagaggagggaatcgaagctgcgaagaaaatgaaaacctacttaaaccgcccgagggacagtggccgacatgtggggcccatcgaatgtatgggcttgattgtgaatgggctgggccttgattgtgaaaatgctccctgcctctcctcttccaaaaggaatgcagtgatctccttgaatttaaaagtactgtttgtgaaagaaccaaaaatacttcaagtggaatttaaaatactgtttgtgaaagaaccaaaactaattcacaaattatatatgtggagatgcgggggatcgaaccccgtgcctctcgcatgcaaagcgagcgctctaccatttgagctacatcccctttagttgttttgttttcatgaagagttccataaagaggtgcggtgaaatagatgtggtttaaaacgttctagcagtatttcccacgcaaattgcaggccatgtaggattgcatttgctataagcctatagctagtacggagtagccctttctaagggcatgtttggttgaaagcactaccaaaatatttgtagtgtcaaaccttgagcaagtttgagtactatcatttttcctttttataggaaagagtagtatcaactctattgactttgataaaaattggtatcaatccaaatagctagtgtatactattgaagttaccaaataagtaattggtaaggtaaaatttgacttcaaaccattcagaccaaacagaccctaaaaatacaggtgaatttctcgtacagttatagtagcactagcgtacccctttttttcttagccggttaacttctctaatgatctaaaattcaaaagaagctgctttgattttttttcttttttagaataaattcattattctccagcagcttcttttcactatttactaaaactacaatgaagcaattaagaccgaaaacagacagattgactaggaatacatgaatgatccatgagtgaaaattcaccaataggcagaagcagaggacgagatttcaaaacaaagaaagggcagagtgccattaactccagagatggactggttcttgcaaatggtttatcatttcaagtaaacatatactcgagcgcaaccaagacattgcaattgaatgtatcaatgaattagaatgaaccacaaggttaaagggcaactcgatttcatttacacaaatcttattgtttttctcttctcatttcacattcagaatgtctaccagctcaaagcttccgagtttatggaaacagagatgtttaaggccatgtgtgaatgtaagttttcagattacagggaaggagctgctgccaaatttcccagcagttaggcgttcaccttgtggagagtatactgcgaaacttcaagaatcaaagtatctgtgattgcgcatggatcatggtctacatctccgctccgaggtgaatccctttccttccaagaggggcacaaagtctcatctctgagttcactgctcagatgcaggtgcaacttgaatgctttgatgcctaggaacacctggatctatcgcaggactgcacttctttatgtagtaagaatgcatccccttggtctccgctgaatgcacgtcgctcgaagctgcatactgtgagctgcctcagtagtttctcgagacatgagtaaaggcaactctcagggtccttcatgttcgggttcgttgacaggacagctgcattcactgcatccgctacaaattcccgctgtggagagtctagcagatatccaatgcacgattcggcaggcttttcatatgcaagcagggccacgctctcctgcaagtagatttgttcactttttagctcagaaattgcaaagcttatatagatgtgaagccttaaaacactttgctattgcaagtaaaattggacgcattacaaatgacccatcaacatctaaaaagccattgcattacctttagcaacccatcaaaagctttatgtgtcaagaagttggccaggttagagcgagcatattttacagcatcctccagttgtccagcctaatgcaagagaaactgagattatatcattatgaaacaggatatagtgtaataatgcaacatgtccaagtgcccatcaccaccagtgagcatgcaaacgaaagccctaggtgggcaacatcaaacagaaccacatgccaatttgaccagatgtcaaaataagttgatctcacatatgctccctccagtcaaaaacaaatgtgtgttttggggtgcatcagccaaactccatttactactgttttttttagattggacaatttatcataatcttacatgtgtgttgtattttattttattaaagtacgtagtgtattatttttcatgtgtgtataagtagtttgtcagttgatgatatgcttatttgcatgcaattttgtagcttcgatctctagagtataatatacatatttaaccaaatagctgaatgttaggagttcagataattaccccgataaattcaatgaatctttgggaatggagtaagaagcaaataattgatgtttcatcctgcaaaaaagaaatgatttcttagtggtgaactaactctttgcggaaagtacatcatggcaactgaaaatgctaggataaacatagtatttgactaatcgtaatgcaagcaggttattaaacttgcaaagcgtacaactttcctcccaaaacttgtgttacaaagtaaaatgcaagttcagggatgaaagtggagccacctcataaacttgtattacaaagtaaaatgcaagttcagggacgaaattggagtctgcacctatcaattcacattagaagtttgtggaaactgcaatgagtaaatgaataattaattatcagatagaagactgtacctttatcacctgtggataccattctccaagttttttgaatgcagaatcaatatctccactcatgataagcttcacgaaatcaaacaaactgttttcagaaggcagaaaccacaccaaaaggggggaaaatcgaaaggggccaattctatgaattatgtagtatctgcacagtatagcagacaaatggaatagctgcacacaacggtgtgcaaccaaaaatatggaagagattaagtgcagtgcagtccaaatacagccgagctgtgataaaaccttgttttacttcagggaaaaagatatctgcctatgaagcttgcattaataaatcgtaacatctcaaaaggttaatgaaatctaaaaaaaaacataaacactaaaaaatagtggacgtgagctggagcctttaagactgaaaacaaatgtcaggttagtccactcacaacactacagtctacaggtggtgaccacaacaaaaatcaatatggatacttggcacaaagatgctctaatcatcagtgggtagtaactggtatttaactgattaactactgtaaagccctggtttcaagagaatatgtatgatcttgtaaaaatcttataaatactaacaattgactccccagtgttgcttattagtagattagaaaaatggttcaacagcaataacaattcagtttcaaataagttttccttagctcacctgacgcagcaattttctgtggctaagaccatacatttcaggaggttccccataaccattttgatgattggatggaggatcagtttcacttgccatatcaaaagaatttaatgtatcttggtagccgtaatgtaggagatatgaacgaacaatcctgttacaagtgcacagtacatgtacataaggcggcaaagtataaaagatttaatgtcaatataggtacaattaaagattgagacaaggtaggaatgaagggcggagtgaatatggtatcaaatgtagattacgtaatatggtaaatttcacataaacataacaggagcagacaaataattgacagcacaagtcagtgattatcaaacataactcgctaacctatctcacaagatacagaatgatctcaagatgaaacagtgatggattcttaacatgagaaagcataccaatgactgatgtctggttgcaaatccaatttgtcgctgacagattgttgcttcattttctcttcaaaaatatagccctgccaataagaatcatacttagtgttatatcatgtgtgcatgaactaaacaccaaataggtaaatatacatgaaaagaatgagctgagtgataattgtaggctataattccataatgaaaaccaattggttcttatggcaccatacaccatattttggtggcctgattactacctaaaaggatgcatgcaaccaaaagttctttcaattatatgaaaggagctgcgcttaagatgcaatgcatctgaatttggaaaactaagatggataatctataagacattatgatatatgtttaattgatgcagcaaactgtggaatggaaaacatggaatttgaaataatactccataaggaaatcatgacaatattacatttttgtgtgaggtccttaataggtgaataggaatatctagatctattggctcacctcaatgtcaaaacagaatggttcttttccaaagtttactgtcaccctgatttgcaaaaatgaacaatcagatccattgaaaagctgaaaattaatataataatttatgagttatggcacataacgcatgcaattccaagcctaaataatatattaacacaagcaaataatttcacttaacaccatttttcagcaacttaggtttaactgtcttggttaaaatgcaattttccatatttggaatgtctattttcattgaaataatcacttaggcagcattcttgctgttaggttggagagagtttttcagcgcacgcaaaacgagaaagctcattagcatggattaattaagtattaattattgtaaacttgaaaaatgaattcatttgaattttttaaacagcttctatatagaattttttttttgtaaaagatacatcatttgacagtttgaaaagcgtgcaaatggaaaaccaggaagttgaagtttggagttgaagaaaagaactaagtcttaggaacgggtatcttactcttcatcttgactatggactgcaatggtaggatatagtgggcctttaatttctttttgaaaggatccaactagagatccatttttcctgcaaaatggtacatgtaattagattaaagtgcagaatgatatcctgagatgaataagcatggtcaaggcttctgaaggagaaaaagaaacaagcacatggaaagttaagccagtaccagaggcgtagtggcagatgcaaatgcaactgatttccaaattcaatatttaacagccaacagctgtagtgaagacaactcttgcgaatttcaaaatattaatgaaagcagcaacaaagcacagcattcatctcaagttaagaaaaaaactcacaagacaaaggatgaaagctatgaactttaagaaagtctaaaatatgacgactaaaaggctaatatagaatagctaatcggagaagcagacgctgccatgccaatttagaaagaatgacagaacttacgtgaagaaaaattcttgtgagaaatagttgatgccagcaccaattgtgtcaccagaagtgaatttgggaccaaatgactcacttttcccaggaccacggtaaagatagccatcatcgccatgatatccacagctgttagactcccagctggaatgaatatagaacaaacatgataaatttaaaaatgtcatcaaaaggaaaaaaaataatatactttagtggtaaaatttgaagtccactcaaagaaagaaatggtgggccatactatttgctaactatttctctgaatgtctgtctattaaattattaaaattaggtgaaaaggagtctccatgtttgccaaaaacctagaaagtgccacgttggtcccagacaaagaaaaagatctgcaccattgattctatatgggtttggtttataaaggcatggtctaaaataatgagcctacaccaaaacaccatttagaaacaactgaaatttggattgaaaaatataagataaagagtccatatgaaatacaatctagaaaaactgaatctccattgaaacataaaatcaaactgatagtttgattccatacaaattccaatgttaaatgtcaaatccctatataactacaactcggaataaaactaaagttgcctgaagcaaatgtacctgtgcaagtgtcagggtatttgagacaaagaaaaatatttacactgttgattatattgtgggtttgggttttaaaggcatggactaaaagaaaagagtctacagaaaaacaccattttgaaacaactgaaatttggagtgacagatataagataaagagtccacgtgtaatacaatatataaaaacctaaatctcaattaaaacataaaatcaaactggcgatttgattccatacaagtttcaatgtaaatccctacaaaactacgattcagaataaaaactaaggtagactgaagtaaatttacccgtggaaatgtcagggtatccggctaatttatagaaattaagataacttcagccaacattaccacaagttagccaggaaatcttcctcaatagggccaatattagaaacttcgatgcattgaaacaaactgaaatggcatcctacctctttagcatgataaacctagcctatgcaacaaatagtccaattcaaccagtgcactacatgtacttaggtttcctcgtagtaattttaaatgaatttgtgatccccacacattatcttaggttcttaggcaggaaactcaaccagctaaaactcggttgctaccataaaactgtggcattttctcaaaacgaggatatacacatttctgattgccaacaacatcgtagacgaactaacagcggaaccaagcgacagcaagggcagaggggatgctaacccgggctggcggcgcatcttgaaattctcggtggtgaagccgatggaggtctgccccttctggccggcgttcttgacgcccatctcgaagtagtagacggcgcggcgcgtgggggcggggcggttggcctgcacgacgccgacgtcgtggccgtgctggttgacgccgaggtacctgacggacatccggtcggtagagacgacggcgaagaggcccgagctgttggtggtgttgagctcggacggcgccggctccgcctccatctcggccgccgcggccccccactccgccggcgaccgccaccgcgacgccagcctcatcgggtcaaccgcccccgccgacgcgggcgccggttcttccaccaccgccgccgccgcaaccacctcgttcgccaccattcgccaattccaaaaccccccctggtagcagcagaaacggcaccaagttagggattcgattcgtccgaccaaaaccgaaacggcgatccatccgggaagccctagcacgagtggcggggaaggatcggcggggagcttaccgagtgcgggggatcgagctgccggcggtgncggtgccggtgccgccggatcggcggccgctgcggttgcgggaggtcggagtcggaggagaggatggatgggggaagggaagggaagggaagcgtgaggagttgggcgtcgcgtcgtcgcgtgtcgtgtcgtgtggcgtcgcggcgagagagagggggaggggggtaacgtactcgtgtactttccggcgttttcgcgacggctgtgcttgcgttgcagtgtggatgaatgaactgtagagacggcccgtgttgttcagcgggtgaacagtttgggctttcgcagggagaggcgacgcaggttcgaattttttttcatttttaatttttttttcttttaatatttacagaaataatccatcggcacaaaaaaaattacaaaaatagaccatgccgccctccactagggcggcaagctgacgtggcaaacgggggagggacgggcggtgacggcagacgggagagggagcacggaaaccctagggcggcaaggggcccccatgcaaaaaagccagcccgggcctagtacttttttgctggtacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21890 - DNA, 2120 bp, Oryza sativa
  unsure (1)..(2120): unsure at all n locations
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaccagccaaatgctctttagggctgcgaaaattgcatttagcccagagggcagcaaagggctaaatgcaattttcacagacggcggcggacggcgccgtcgagccgccgtctaccacgtcagcttgccgccctccattagggcggtatggtctatttttgtaatttttttcgccaatagattatttctgtaaatattaaaagaaaaaaattaaaaaatgaaaaaaattcacgcaggttcactggttcagtgaaaaggaaaaaaaaatttcaacatggcctgttctaataacttcgtaaacatacaaaactttcctcgttttcaaactaataaatggttatcttatacgaaaattttctacataaaaattgttttgaaatatcagataaatttatttttctaagtttttaataattaaaacttaattaatcgcgtggctttctcattttgtgtgcccgcttttaatcttcatccttagaagattcgaatggggccttacacaacactttgcgtagttgcgtcggagtatataatatgcatttatttttatataaaagccaaataagattttctatgggggtttttaaggcagaaaatatggttgtaaatgcaagtgtatcccctgacccatcgtcacgaatgaacggttttctcacttttacaatgagatttcctctttttacaaggaggagtgttgcagttttcaacttgaagtagagaaacggatgcttgaatcatgggtttttctaactctgtaaattcttgaagttggagttgttgaggtgagacattaaaaattataatttaacctagaaattctatgattttacaattcaggaattagaagcataccaaaacaataccagggcaattgatcagccctatccctcaatttagcacgcaatttttgttgcacgcaaaacaagaaacctcattagcacataattaattaagtattaactattataaatttaaaaaatatttgtatttactttttaaaacaacttctatatagaaactattttaaaaagcaccaattaacagtttgaaaagtgtgctagcagaaaacgatgaagttgaagtctggagttgaagaatagaatatggccttagttgtaaacgcttaatccataaaaccatgcccctttattttgaaattgaagcatcagactagaatattagaaaatatttctgtctaacattatacttttataaggatatacaaatagggacaagcgtgattttatccatatactgatgtattatgggttgacacctttcaacatcaatatcctacttttttcagttgctacaaatgctctaataagtttatttacaaataatatgtgaagcatcgtacagttctgtttggtgcaaaatacctgtaattattgttggcacatcgcatcaaagaattggtcacttctaaaatactactccatcaaatcaaaccataatgcagtgttttttcaacgaccacttagccatcaaatcaaaccagtaaattcttgttgatgtagtactaaacggtagctccatagtgcagtgttttctacttgatgcacaacaactattctagcctttttaacttttaatgtgagtattagtgcatcgtctaaaagccttaggtatatgaatcatgacccttataaaaaccagaacataacctataaatctacacattttccaggtacacatatatttaaaaaacataaaaaaaaatagaaagaagtatgnnnnnnnnnnnnnnnnnnnnnnnnnnnnnnnnnnnnnnnnnnnnnnnaattcgccctatagtgagtcgagtagtcaacaagcc

SEQ ID NO: 21891 - DNA, 4229 bp, Oryza sativa
  unsure (1)..(4229): unsure at all n locations
ngaatgaagcctctgcagcttttctcatgaatacatggctttgaaacgttgcaattaacaaaagctagctactacatctaataggaatagtagtactattactagcagccgaataattactttattgataagcattgatggggtcttgagacttgagcaggtcaagcacaatgacaagtatatattggcccatcaaaaatatcttcctacatgcaatgcatattatactaatcaagccttgtcgagctattcgagctcgagcttgctaggcttgcgagcctcagcctacgcttgagcttggcttgtctagtattcgagccgagctcgaatcaagcctgtaacgaatcaaactcgagcagcttgcgagctccaaacttttttgacagccctacgtgggtgtgggtatggggcaagggaacccgatgggtatgcacccgttgccatctctagatgtgtgtccgtattcatatgggtgagtatatatatgtcttgtgtgtgcatgtggatgagtacgcaatgcgagtgtatgcatgtgtactgtgttgctaaaaaattgagaataatttacttttaaaaaagaagaaatggcatcaattttctttttttgaaaaaaaaaaaggaatcgacaacaatacttcagaaccaaggaaggaccgtaacggccgtccgatcaccgccccagccgcggaatccaacggccaaacttccatccatccacccgttgcccacccccaaaactcaaaatcaccgaaacacccttacccccgcacgccccctccctcactgacacgtgggccccacgcctcctctctctctctctccccagatccgcgcctcgaaacattcatctcgtctcgtcgggcgaagaagcccgacttcccacccactctccccgtctccagaagcagcagccgagccgccgccgacgagcggcgatcgccggcggtgggttgggctggcggctagcggcggaatgggggtgccggaggcggtggcgctggagatacctgcggcggcggaggccgaggaggaggttgaggaggaggaggggtcgccttcgcctccggtggtggccagggtgccgccgcggatcaggaggcggctcctcctccggcaccgcgggggagcgccggccaccgcggaggagatcgaggccaagctccgcgatgcggacctccggaggcaggtgggtcgctgtgatctctcggcgcacccggcgcggcgctttcgagatttagttttatggttttttttttcgtgtttctgggtgatttggttgtggttttggtcggtggattaggggcatctgtgcaattcatgtcaatatacgtttcatcaggttggtagttagtgaattgggagtagcattccggagtgcagattttagtcacgtagctggattactgaatggtttgtgttagaagcaattggccatcacatgatttgctgggagttgattatcaaggtaacgctgttcttgatcaaacccgggagccacaatataacttggggtttatctcaaccatgtcaaaatgggagcccagattcattttaggatgattgatatttgaaggcttccaattttgctgtcagcctgtaaaatgggttctacaaacaacaattaaaattggtgttgttgccaagttcatttgaaggactggcagaaaaaagtacgatcactgtggcttgttaactcatgtgtattctattcctccagcaatttcatgaagcgttatcgtgcaaagcgaggtgcacagtcagatacccttcgtgtccatctcaggaggaggatcctaagaagcgccttgaagcaaagcttgtggctgccgagcagaaaaggtaacagaaagagggacctagtcacctagcagagcatatttatctgatcggatattaagatagggaacagtgagaagtgatttctgattgcaggttaagcctcctggctaaggaacaaagtcggcttgctaagttggacgagctgcgtcaggctgctaagaatgatgcggagttgaggttcaagaaggagagggaggaacttggcatgaaagttgaatctagagttcggcaagcgggggagaaacgtacacaactcatgcatgctcgttcgcagaggagggctgcactggaggaaagaacaacaaagtaccttgtgcagagagtggcgtgggaaaacaagtacagggagcgtgtacattcagcgatcctgcagaagcgcactgcagctgagaagagaaggacggggctattggaaggtgagaaaaggagagcccagggtaggttttcacaggtccaacttgctgccaggactttatcttgccagagagaagctgacaggagcaagttaaaagaacaactagaagacaaacttcagagggtattcctttttatgctgcagagttggtataattgttttagtagctctttgacttacattgcaaactatttatgcaaaacaggcaaagcggcagagagctgagtatttgaagcagcgaggaagtactcacagctttacatacaccgcttcagttaaacacggtgattttctttcaagaaatctggcaaggtatggtagacttatacagtcaactttctcgcaattgtttggcttgtgtgtatactttaaattttattgattattctattcgatttgatgcttcagatgctggagaagattcataacatctaggaagacaacagtggtgttggctagggcctttgacatgctaagaataaatgaggaatctgttaagcctatgccatttgaaaaactagctctttgcattgaatctcccacagttcttcagaccacaagggcatttcttgatcgcttggagagtcgttttactttatctcagtcatcaagtccatcatcaccagaaaatattgatcatctgctcaagcatctgggatcaccaaagaggactctatcaaaaagtgggggaagaactagagtgacaccaacaaaggcagctagaaattcagatgttagcaagttacctagatattcaccgaggatagttctttgtgcttacatgatactaggtcacccaagtgttgtttttaatgaacgaggtgagcgagagaaactacttgtggagtcagcagaaaactttgtgaaggaattcgaactgctgattaagacaatacttgatgggtcaagtggtgcatgcatactgaaacagccaatactagatgatctgtctcctggatcttctaattatcaggaatcttctgccgttgttgctgatcggaagaaattcagatctcagttggcttcttttgacaaagcttggtgtgcctatctttaccacttcgtggtgtggaaagcaaaagatgcaaagtcactagaggaagatcttgtcagagctgcatgcaaacttgagctatcaatgatgcaaacatgtaaatttaccgctgaaggccaaccagagaaccttaatgataatttaaaggccatccagaaagaggtatggttatatacctggtgccttttcctttgtttttttcttttacctatttccctgacattagtaattgagaagtattttaagtgcataaaatcccgctattcagctattgcaggaagcagtccattcctacaactttgcacttagtttatttattttgattatagttttcttttgtctagtcaaaactttactatctgttgaaattgtttctgttcatcacccaggttatggtagaccagacacttctaagggagaaggttcggcacttgggtggtgaagctggtattgagcggatggaagttgctttatcagaagcaaggacaaagttttttgaagcaaagggaaacaggagccccttggcaacaactataaaaaatgtagcagctacatgttcttctggagaatctcctatttctgacatgaaggagaattccaacattaatgataaaaggccaagtcaggctgtccaatctatgttcagagttccctcttcaccatctgaaagtaacacagcaggcatcaccatgagtaatccaatgacagtgagcagcactctgtcagaaaaacggccaacagagaacgagcagatggtcaatgagattcttcatggttttctagctgacagctctagtaatattgggactgttgagggtggtttcaaggttagatcctatgttacatttatactaggattatattggaaagtttcatattgctggggtgcagacaataataaccaaaaatgtattacatgag

SEQ ID NO: 21892 - DNA, 4008 bp, Oryza sativa
  unsure (1)..(4008): unsure at all n locations
cgaagatgnnttagtagacctccgataggcgnatcgnnnnnnnnnnnnnnnnnnnnnnnnnnnnntcttttttttctcaggaaaaagtaagggaaacaatggagaaagctttctgggatgtggttgtggattcacttagaggagacatgccagactacagctatctggttcagctggtaaaggaagtcagggatacattgtatgagatggttcctaaaggttggaaagaagaaataatcaacaatattgaccttgaaattttgttgcaggtaagaagagcttgagtgattttatcatgaatctacagaatatatctgataccagttttgttgttttttggttgaaaggtacttgaatcgggcacccaggacatgcaatatttgggacagattttgcagtactctctgggtatgctgcgaaaactatcctctcctgcaaaggaagacgaaatgaagagaagccatgacaaattattgggtgaattaactgaacactctgagtgtaataacagtggttcaaattcatttgtaattgctgttatcaaaggtttgcgcttcaccatggaagaactaaaggtttgtgaactccttgagttcttaaataaacttcatggaatatacattgtgaacctataacagcctccattttttttattttttttgtaaaataaacaggctctgaagacagaagtcagtagagcacgtatccaactattagaaccaattataaagggctcaggtggagtggaatacctgcagaaggcttttgctgatcgctatggattcccgtccaatgcatcagttgctctccgttcaactgctcagtggatttccacatcaaaagataccgtggaagtagaatggaatgagcatgtcagctctttttcagctctgccagaaaccgatcatgttaagtctatgaattaattttatgcagtagtcacagcagtacacaaccgctgtttgtagcaatagtagttcaagtatctattattttcacctgctgttgattttacttacacatccctcgtaacaggctcagccatttgttgccaccctccgatcaggtcatggagttccagatcagcgacagtctacaatacctgtgtcaggtatttattcttttttccccttgtatggccattgttctgaactccttaatcatttagtgtcatgataagcagatgatacggggctaccagagtgcacggggcaaaggcttgaccagctaataaggattgggttgttacagctcatcagtggcatagagggtgtgcaaatgcagtcagtaactgagaccttcaagctcaattggttgaggctgaggtctgtacagagtcaattccagcaagtgattgtaattgcaacaaggtgaaacattactcaattttttcactttattcacttcactgctctgagtatcagcagttagctagaatggtataaccaaacccaattacgcctcttttttttcctcgcagcatgcttgtgcagcgtcaagttttggcgaccgacgacccaaacatcactcccacagagctggaaagcgcgacatcacaactgttcaacactctcgcagagctactggacaacttccccgacgttagcaccgccaagatcatggaggtgatgctccgttcgtcgtcgtcgtcgtcatcaggctcgacaaccggctctccatcagatgaaagaaccgagagcaggaagcagatactggccagggtcttcctcaagagcctccagaccgatgaccccgtcttcaagaaggtctcccggtccgtctactgtgcgttccgcgcgatcaccctcggtggcagcggtgccaggggacggaagctcgccgacgccgccctgaggcgcatcggcgcgacgaagctcaccgaccgggtggtgagatcggccgaaatcctcatcagggccgcgtccatttcacagcaggtccacggcccttggtacaatcacttggtgtgattcatggtggaaaagctagtgaaaacggcgtcgtttgagcaatctgaaccgctaagcgttcgtgtgaagaaccgaagatctcgtcttgtttacttgttagtagtggcaaggcagatggtagattggtacgtgagcaatgccctgctgctttgtgtgaataaataaaagagatggtactgtactatgcttgtatctgaaatcctgaacaatgtgtgcgtgtgtggtggtgttcatacgtgtgatcaaatctatgcttgtatatatacgaaacttaaaaatggtttcatcaatctaccatgtagtgtatacgtgcatatccttcatcagtacatttgaatctttgtgaactgtgatgatacgtatacaagcatcatgtctgaagtcacagacatttctgatcttctcttcttcttctctatctgcagcagcagcagttcaggaggagagctggtcctctgcggcggcggcggcgggggacgccggcgccggcgacgaggcgtcctctgtggcgggcgcgtcgacggcgggctgctgctggagcgcgaccgcggcgagggacggctggaacttggcgacgtagtagctgagcggcgggccggagtagacggtggcctgcggcggcggctggttcttgccgacctggatgaggatggacgacacgccggcgacgaaaacgagggcgaggccgccggcgatcgccgccgtgttctccgacccgtccgncgccgcgcccgccgcccccgagctgatggcgctctccgccacgtacaccgtcggcttcgcccacaaccaattcaggtcagaagaaaaataaaaagaagatatttcttgaccacatttaatacgcaggaaaaatccgaaaaatttgaattaatccgattttttttaaaaaaattctataccgcatttaatacgctcgcgaaatttatgggcctgtaggctgcccggactgcccggcacgaacagaccgatagtttaatcaatccgaaattttgaacaaaacgagatgaaactgaattgaactttcaaaaacaaacctgatactagacacaccttaactagaatgaatttgaacagaggaacatgttcagattcgtgatgttacgatgtggagtactatgtatgtgagtacgtttttttatgggacataggaaaaatacaaaaaaaaagaaagaaagaaaaaggaaaatacctcgacggagtagatgttggtttggccggcggtgtccttctcgacgtagccggtccatcccttcttcttgggagggaaggtgccgaccaccttggtccgctcctccgccagccactccgcgctcaggctccccacctccttctccggcgcgcactcctcctcgtagcagtcctccaccgccggcgccggcggcggaggtgaagaaggcgacggcgacaacgacgacgacaaggcgttgcaggacagcaggaacagcctcccccctcgcgcgaggctcgccgccgcagacgccgcggcctgtggcttggcggcggcgctgctcctcaggaacgcgcagcagctggtggtgctcgccgacagcatcgactgcgccgggcaagccatctcgctgcgcgccctcctctctactctctccggaccaagaagaagaagaagaagaagaagaaggaggaggagaaagggatggcgtggctagctagctagctagttggtggaatggtggagtgagcggccgcagctagcggaggagggagacgagggagccttttatgccgtcgtgtcgcgtcgcgtgcgcggcgaggaggaggaggaggaggagaaagatctgtctggctgtgcgagggagaggatgggattacgtgggtggagcggggcgggggtgtggtgggtggatcctccacgtcgcctcagcttggtctgtgtgtactgtatcaacggccaaccggcaaccggtgaagccgtcaatactcaagacagagaccccaacgtgtctgcctctgtgcgcgccaatgcctggaggctgcccgccactgttcgtgtgcttgcagttcccccgccggctcttac

SEQ ID NO: 21893 - DNA, 1430 bp, Oryza sativa
  unsure (1)..(1430): unsure at all n locations
ccgccccagtgancagactnttnnnnnnnnnnnnnnnnnnnnnnnnnnnnnnnnnnnnnnnnaaatgagtggtaaagtagcagagaggttgcaactatttaagagatccctgaatctttccagattatgtgcttctgaacagttggggatcatgcatcaccataatttcaagggaagagagggaaagatggagaagaagcaaagtgtcccaaagtgaaactatatgtaatctttcccggttcaaactaaaaatgttgtgctgctcctattccaacttgccacatgggtaaaaagaagtggccctatatgcaatttactcttttaagttgcttgattcttctcgtaagcacatgacttgggattctataacatatctcacacttcccttctaatccacctacctctttccatctcaaaactctcctcccctctcactctctccagctaagcttagctttccactttgagcgaccattatcacctctctcatttcactcggccatctatcaatcacactatcttacctcaacttcctcgccctttcttcttctcgttgaaatgcatgtaagctaatgaaaaatgtcctcatgccatcgccagttgaatgatatgctttctccattctaactccattctaaaataagtgggtttatttttatcctcttgtcatttgttcaaaaacaagttaatttctatctttggtccataaatcaatgaatttcattacttcaatactccttaactacccacccatatactttggtctttttctgttaacaagatgcactttattccctctctctccacgttattttgtacacccaaggttaaagttaagagttattttaggatatatggggtatgtaccaacattgtacggcacgcttgtttcaccagtgtctactgttgaccatggattacataacaattgctaaccagaatggcacacatatacaacattttactcgtcttgcgttgtgcagctaccaactagtaccaaattggatttgtccttgccactttttctgaaagtaaaatgtaaacctcaacgtaacatgtcacattgccaatttggcaatttccatagttcacgtaactggggctaatggtaatggtgctatgtgctgcaacaaacttacaaccacatgcatcagtgcatggcctcaaacaccattcagcagttctacatctaacaaggcacatctcaagtgaaaacaatataatgatagagaaatgtatcccctgcgactgataaatccaaaaccggcataacatcagcagcatatcagtttagcaactcatggttcctgaggctaataccatgtttacatgtaagataagttacactgggtannnnnnnnnnnnnnnnnnnnnnnnnnnnnnnnnnnnnnnnnnnnnnnnnnnnnagacataggtgctcccaacacacg

SEQ ID NO: 21894 - DNA, 1037 bp, Oryza sativa
  unsure (1)..(1037): unsure at all n locations
cggtacggtaaagccntcctnnnnnnnnnnnnnnnnnnnnnnnnnnnnnnnnnnnnnttcaataaagcatgatcatctgcagaaggttgtactaagagatcatctattgggtacttaattggaacatttatgtgttcctcatctgcaaatcataccaaaaaaaaatcgataagtatcttggaagaatgccatagccaaaaggctgctaacagaacaattgcaacaaaggtgccagattcagatgaatcaccggtcttcatcttttttttgggatcttccataggtccatcctcacgtcttttcctccctttcttttgcaaaccttcaccaaactagacaaagaaagcaagtgttagtattgtaacatacccaaggaaataaaggacagatgaaaggggcacataaccaactcaccatcatgtcattcgggggctcaatgggtatgccatatcttttggcaagattttcatgtataacccatggggcattttgagaagttgcatctctaataaaaatctttagcgtattcctactaacaggtggcctccggtgaataaagtcttcacctttgatcactgacgtactgatgatagtcttgtccctaagaagccaaccaacttcatacatcttggtgccatcagaccttaaaatcttcaaaatcctgcaagcagcctctaaaccatcctgtttagcatataattctaatccttcaaatacagcttcctgcaggctagcatatatcttctcaacaagctcatataatccaagagtgcctgaaacaaaaggtaaaagtaccagccaaatgctctttagggctgcgaaaagtgcatttagcccagagggcagcaaagggctaaatgcaattttcacagacggcggcgagcggcacggtcgatccaccgtctaccacgtcagcttgccgccctccattagggcggtatggtctatttttgnnnnnnnnnnnnnnnnnnnnnnnnnnnnnnnnnnnnnnnnnnnnnnnnnnnnnnnnnnnnnngatgtatcccacgggggcgcgc

SEQ ID NO: 21895 - DNA, 968 bp, Oryza sativa
  unsure (1)..(968): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattatccttggtttgtatgaaaaatgaaatatgactatcaaaagtagatggagggagtatttcaaaaatgaccattttgttcagcgccaaatcgtgtagcgctgaacttagatacctcagcgccaaatagcgtggcgctgaatgtgcgttggtacgctgacttagccttccatccatccacggtggcacggcattcagcgtcagttgacgtgacgctgaagtgtctaagtttagcgccagatgatttggcgctgaacaaaagggtcaattttgaaataagttttggcgtcggtttatttgtaaaattagttttttcaaaaggtcaaattgtcaaaatttgtgtgcaatgacaatatgaagtcaacaagcagcgtccatgcatgatctgaacaagccgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttccn

SEQ ID NO: 21896 - DNA, 869 bp, Oryza sativa
  unsure (1)..(869): unsure at all n locations
ggaaggcgtacatcacctctgatggtggatggttcatggatggtaaggcagcctatgctatgcaattatatcatatatatgcaaactcatgtatggttcgcggacatcaattgccggtttattcatgatgtctgttacaacctgatgcagtgtttcatgtggtggacaagcaagggcagaaggtgactgatgagaagaccattaagcacattgagaaggtttgtaattttttttccacctgaaaattggtcttaaaatttaccacctgaaagttgaaaacctattttatcctctatatcaagctttcagaattatttttggtgcaactgcatcctgatagtgtttggtttgaaagtattggtagtttaggtgaagtattttcgtatctgttcatcatgtcagtatgtgtttcagtttttgaaaaacattttaaaggttttcctttaatgaattacaaatttagaccgcagtactatttttcatgaggtgtttggaatggatagtggagatatggagccaacaattcctttgaaaactttccatgaaatcaagaatttttttgtgactatagatttacactgaagtgtaaattaaagttgaagtgaaaaactgaaaactgaagtggcagtatcaatttggttaaaattgcaggcgttaggcccagacagcaacctgctgggtggcgcgaaaggcgggtcgtccccggtgaggtcggtggggatgcacttcattggcgaccacaccggcatcgagcttaaggggcccgaccggacgggcctctcttcgaggtctttgccgtgctcgccgagctcgggtgaacgtgctttccgcgaggtgtggacacaccggcccgcgtngcctgcgtgtgt

SEQ ID NO: 21897 - DNA, 961 bp, Oryza sativa
  unsure (1)..(961): unsure at all n locations
ccgcgttttganattgattttcnnnnnnnnnnnnnnnnnnnnnnnnnnnnnnnnnnnnnnnnnnnnnnnnnnnnnnnnnnnnnnagattaatgtggtaccaggtgctgtagcaaaaccgacatactagtaacagagttcagtgtgagtgtatcgatcaatcaatgtgactttactactaggagaactatacaccataatctgcaacatgtcctgattaatcccttgttccagatgcagccaagctcagaaattcttttgcaaaatactactaacagttactacttctactgatgcagtgatgctagttgcttgtacagacagtggcaaagaaggttcagacctcagatactcttctggagatggccgcttcaaggcacttgatcaccctccctgcttcgtccttctgtagcgtgcgcccatccttccgacgaatgtacagctcctgacaatattaaaataaaaaaaaggaagttcattgcaatgtcaaaagtcaacgttgaccgagtcgcggcgcagagctcctttgaaatgcaggaatattctttctacaaatcgaattatttcatgtgaaattcttagcattgtcgtggtaggagcttcgatatggtagtagcagctgttgacatgctagagtccagagtacacacctggatgccgtagatgccgtcggaggagacggaggcgtgggagacgacgtagtgcatgtcggtgagcgtgcacacgatgtcgaacagcagcttggacctgtccctgcacttgacgttcaccaccgagtagtccttctcctcgcagtgctccaccgttaccaccggtctctcctccggcgccgccgagtttccggtctggcccgacacgatggcgcggctgatgaggccgatatactcgtcggcgtccacgtaggcgtgcatcaactggtggagccgacggacgacgtgggtgatcgaccccgagccgtcagag

SEQ ID NO: 21898 - DNA, 968 bp, Oryza sativa
  unsure (1)..(968): unsure at all n locations
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaccattttctcaagcaatgtcaaccaaataaagcaatgcaagaatgtaaataacaaatccaagatttcaagcacaactaaaatattgcatgaatgtacaggaatcactttatgcgttcctcacatttgtttcagtttttagtcgcgcatatagtacaagcttacactgtcaaaactgtaaaattcaaaaaaatacaacaatgtataaaccgcacaacagagtattacctccttcaatcctggacgccaaggtgggacgttgttatccgctcttagtatacataatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21899 - DNA, 709 bp, Oryza sativa
  unsure (1)..(709): unsure at all n locations
aaataatgacatgaatatgaataccacctgcnnnnnnnnnnnnnnnnnnnnnnnnnnnnnnnnnnnnnnnntgtatatactttactgaagtcactccctaatatttttacaaagccaactgaaatggatgcacaaatttttttttttggccaaacttgtacttcagttctccatgatgttttgaaagccatctggctagttgcttcacatagtgggtagtaactggtatttaactgattaactactgtaaagccctggtttcaagagaatatgtatgatcttgtaaaaatcttataaatactaacaattgactccccagtgttgcttattagtagattagaaaaatggttcaacagcaataacaattcagtttcaaataagttttccttagctcacctgacgcagcaattttctgtggctaagaccatacatttcaggaggttccccataaccattttgatgattggatggaggatcagtttcacttgccatatcaaaagaatttaatgtatcttggtagccgtaatgtaggagatatgaacgaacaatcctgttacaagtgcacagtacatgtacataaggcggcaaagtataaaagatttaatgtcaatataggtacaattaaagattgagacaaggtaggaatgaaaggcggagtgaatatggtatcaaatgtaaattacgtaatatggtaaatttcacataaact

SEQ ID NO: 21900 - DNA, 963 bp, Oryza sativa
  unsure (1)..(963): unsure at all n locations
ccggtagaaactggaagtgcatngtcannnnnnnnnnnnnnnnnnnnnnnnnnnnnnnnnnnnnnnnnnnnnnaagtgacataggttggttgtacttcatctttaagcatcctctcaaacactgcaagtgactgctttccctggccattgtgcgagaaccctgtcaccatggagttccaagagatgatgtccctctcaagcatcctgtcaaacaccgccatggccgctaccatgtcgccacacttggaatacatgtcaataagggcattgtggatgaaaacgttgaaagggtctgaaccgatgctcctgcgcaagatgaagccatgcacttccttccctcgggcgacaagaccaaccttggcgcacgcacccagacatgacacgagggcaaagggggttggcactaccccctcacctgtcatcctttcaaaaagctcgagagcgatctcctcctccccattctgctcatgcccagagatgagtgctgtccatgctatggcgtcctgcgctggcatcatgtcgaatacttgcacagcatcgtcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagtcacttcaannnaacatggcg

SEQ ID NO: 21901 - DNA, 4704 bp, Oryza sativa
  unsure (1)..(4704): unsure at all n locations
ntagtcgagtactcatttcaaggaatctgcaaaccgatgtggtccgtcgtagcagcagcaaataagtttgcacaagagcagcgtaggagactactggagtgcactgcattggcatgcgtcactggtgatgtagacactcagtagctggagaaactagacaacggatgaagagccccttttttaccctgcaaggcaacaggtgaaagacagtagtagtagttactatcctcgtggttgggtctctcccgttcgttcgttcgttctccacccaattcgccatcaccaccgcaccaagctcggtatcacctcgtcgatcgtcggctggtgccgcacgcgtcggcgtcggcgtcggtcgtcgtcgtcttttcttgtggcgccggtggtggaagtggaggaaggctgctgctgctgcaacagcaacactgactggcacaaggtattatccatccatccaaccatttctatcccttccgttccgccctatccgatgaggcaggaatgcgggatgcaaaatgtgtgcctcacattgcccacgagcggcatattttgcatagctcaggtgccattggcagaatgtggcctcgtatgccctcctctttctcatccttcaccaccagcagtaagcatccaaggtgtgccagccacctttttactcccacttgatcaatctgatggtaattgcaaatctgatattgaccaatgaacagtgcagtgcaatcttgctcattcagacagaagaactactgcgtcctgcaaaacaccaaccaaatgttactttaacacacactagatcaatagatcatcgtcatcatgttcacatctgcgaaactaatcagcagaacgaggttgggttgggtttttgaagtcaagaacatcacctcgaggctacaaggctagagagttgggatgatcaaatgatacatgccacaaccaaccgcaggcagtacactacgcctgcatgcgcacctgagcatgtgccaacaagaatgaggatctccatcattctcctcccccacagcatcggccaatgtgcgcgcctcgaccgaactgcatcagcacgacgtcatcaccaccagcaccaggtgctgtggtggggccgggtcacccacgctctgcatgacaggtggggcccaccacccccctcaggactcaggagatgttaggttttgcctcacgtgtgctggcaacggcaatggcgttccattgattccccccggcagcagcagcagcagagcaccggcttccagtggcggacatgccctgccacaaagaagcacagcatgcatatgatcccaaaagataaagccaaagccaaaaaaaaactaaagagatccaagagctagaaagatagaggctcaagagaaaccgtgcgagcgacagcgagggggggctgcctccgcaccattggaatgatgaggccaccatgatcttttcctgggagcagcacagaggagttgtgtgagagttcctggaagattcggccatcatgatctcattttggttaatcttatcgagataagcatcttcttgcatctgaaaccaatcgggattgaatcgaaccacagtttcctttgatggatctcttcacaagtggtcatcatgagattgttaaactttctaccaagaaagatggagggggggggggggggtcttatactcttaccacttgagatcgatgcaacttgatggcatggagtcctttcaccaactgggcatttttctagttaatcactctcaggtgaggtgatcctctcctgataattattgtgcctgccaaggcagataagaattttccccagttgattcatgaataatttggaatgattagtgtacccctctgacgcagcaatgtatacaacaggaggacaacatctgggttgcttcttcttcaagtgatgcccttgtacttttgccacacaggtccagaaaaaatgtgcaacttgcttgctggcactcgtgtatataatggctggctgtggtcaaggtgcatatggcttgagaagggtgacgcctgcatgacatgagcaagaatgcaatggtcaggggggaaacaaatagtatacgcaatgatcatgaaaagaaatactgcactagagatgttgcctgtcacattaccttgttctgaggttttggggaatgtacattaaggagtgcctgtcacaatgtagtaatcagctcatgtgaaaaccttatcacttgataaaacttcaaacacttgatataataatctatacagtaagtaattaatacaggcttaaagaaattgctgatagaaaatccaattcaatgaggtaatgactaatcaacaaaaaagtactgatacctaccagctgagatctaatataagccaacaatccttaaggccatcaattatatcacaggctgctggatgaacacttttatcatgcatgtactatggaatgattcaattattatttctgcccccctctgaaaaactaatatatatctctgcacactactgcagccaacgggtacatagcagtgcatcatgaatccatgatccaacaaatgtctcctcatagtatcattatttccctccaaagaagaaaagagaaatatatagaatataagcatcgcaaaatgtcgccctcgcttggctgccatcctcctacggatcagcactcagcactccttgacttgcacgtctctctctctctctctctctctctctctctctctctacatctcactctttcacacaatcacacacatatgctccctataagtagcactcgctcaccaagatcagcaagcttcccatttcaaattcatcaatatcccagccaagttgcatttgactgcagtttgtaagttgcacttgtagttgtagcatgggaggagctacaaacttacctccaggtttccacttcttcccctcggatgaagagctcgtcgtccatttcctccgtcgcaaggtctccctcctcccatgccaccctgacatcatcccgacgctgcttccgcatcggtacaatccatgggagctgaatggtaagtctgcaactgcattgatcaatatgatttcactaatttgttctcttacaagtcatgctgagtgctgatagaaattgcaattttaaggcaaagcactgcaagctgggaaccagtggtacttcttctgccatctaacacaaagtaggacctcatccaatgggcactggagccccattggagttgatgaaacagtaagaagcggcggccgcaatgttggcttgaagaaaacgctgctattctccattggagagccctctgaaggcatcagaaccaactggatcatgcatgagtaccatctgctagacggggattgcgtcgctggcggtagcagcaacttgactagctcgagctctaacaggaggtctcataggaagagaggccactcaagcatggtaagtgatgcatatcctctctatcttgctgctcgatcagcagtcaacagttcagtaaattgcgtataaggagtaactggagcacaaaatactaaaatttatgcatgatcattacaggagtccaacaactgggtgctgtgccgagtgttcgaatcgagctgcggttcacaagtgagcttccacggtgagggcaccgagctttcatgcttagatgaggtgtttttgtcactagatgactacgatgaagtaagtttgccgaataaatagaaatatagaacctagctaagtcagtactcgttagagctgacagtaggtcctatgcctatcaaaccatttgattagctatggccgggttatgttgatgatatctatacataatctgttgcattatgaataattaaatggtctgggaggcattgaacccaatccagtccatcctagataattaccatgtaattagttatcccccaacgagtatgttgggcttgtgtcagacaactgtggcatatgtgtgaagcacaagtcgcttctaaaaagatgagtttttttttctcgtttctcgcatatggtggtctactttggctcatgaagcattcaaaattttaatataatcaaagcatgcacttcatgcagcttgtggtatatacaaatctagaaatataactatttataagcttgtgtagttgcttgctacatcaaactatcttcgcatctgtatggacattgtgttctatcaccacaaagaaaaaaggaaggtgggtggagcttacgcgatcatatggccatctatgctgtcaatggaaatcatgcatgcttgtgtggaaatcgcgctcagatgaactcatcaaacttgccagccccggttatcatgtaggtggaccctgctagagttttcaaccctgattgatctattgcctaatggacggctttaggacattaatagtgggacagtgcctattgagtaactttatactgaaaagtttttgacaaattgagaagtttactcttggaaatgctatgatatatgactaatgcatgtacgagggggagttgttaatttgcccactcatcacttcagatgcatgttattactttttaaaataactaaacagtcatgatgaagtttaatatatatgtaagtgaatggggacacttgacaaaaaaagttcaattaaagttatgttagtggtctatatatgttactcatcttaattannnnnnnnnnnnnnnnnnnnnnnnnnnnnnnnnnnnnnnnnnnnnnnnnnnnnnnnnatgtgctaatatcatntcaagccct

SEQ ID NO: 21902 - DNA, 17121 bp, Oryza sativa
  unsure (1)..(17121): unsure at all n locations
cgtgtcttgtanatcgtanttcnnnnnnnnnnnnnnnnnnnnnnnnnnnnnnnnnnnnnnnnnnnnnnnnnnnnnnnnnnnnnnatagtgccaaatatggtgaactaaagtattagcatttgcagaaacaagataagctaacttgttattgttcctacatgcttaagtgtggttaggaaaagaaataacaacatatgaaataagcaagcatagaagcaccagtagtgattaagtagttttaactgaccatatataagaataattgccaaaggcatatacctgaattacaatgagatcaagcattttgtgaattaatatgattcattgtgcttgacctagggaaaagaaacaaaatcatacagctatccatagtgctccaataatcctgaaatgagagcagcaatatgtaaatgacattctttctttatggaaaaagaaaagaggagattgctatcatgttgaatcagtagcatggttcctgaactacatatttaaagtctgtaagcccagcaaacacaattttacatccttaccatcaaagggaattttgaactactaatgcaaggcagtgaacatggtaataaataaagtccatgccaaacttggaagtattgccttgctcactttttcttccaaattattgaacctgcaaacccaaattgagtttaatgaaatagctgacacagcctgatggattacccctggttgtttccatctactagcagatacaaatttacctcctaagtgcttctaatgatgctagaaagccgaatgccaataagcacatcgtctatactactaacatcatttacttcttctaagaggatacatacctaactccccaattgggatactcatgacacttcaaaagctaacaaccctttgaatcctacattaaggttgcatgcatgctaactttgctagtgtgctcactaatgtttacattaacattctctttgtaccagcctatgtaaagaactccacagtaagtacaacacccaaacaatatttatgacatactagagtaaactcacctcagtgtatatactttactgaagtcactccctaataagtttacaaagccaactgaaatggatgcacaaatttttttttttggccaaacttgtacttcagttctccatgatgttttgaaagccatctggctagttgcttcacatgcattagaaagacacgcttggggacttttgaaatgggttagatccatgtagttttcaacaagtacagatgtatgcctaagattgtgacacaacattatctatccatgcgtaagtgcatttgccgacggggccacattcatgcatttagtaccttttttcctaggcattcattatgttagtgatatgcacatcatggccaactagttcacttcaacacatcaacgtaggactgaaacagaaaattcttcttaatatcttgggagcattcattccatgtagatcaacacaaattgcacaaaaaaaccatcttcatatccatgttttttcaattgtttagaatagcagctaagcaatgcaatctagattctagaaaaaaaaatgaaaatctgattgtatgacggagtctcagaaaagagggtccacagcacaaaatatgatcatttgatgttgacctcacaccaatgattgttgtgaaatatgtagaaggaaattgtgattctttaatttgcatctgactagtcaaataaagcatgtaaattcccggatgatagttaactgtaaaattcaaaactaacccatgcaaggttatctgtttcgcatggtgtgaaactgtgaatcaaagaacttggaagttgacacgcaattcacaaatgtcacaatattctgcagagtgtctgagcagagacaaacagaaatacttatgactatacaacaaatgatgtgttatgggatagcattacgtgctccatagcaggcaacaaatgaactggttctatgtgtgagaataacatggagagaccgagagtgtacaaattaattgtatgtataacacatcaattaagtattcaagtatgatgaaccgcaaaacagtgtccaaagcagagttaaatcgggtccatttcatcgaaccctctttcctatctatactatatcgacagacattatactcttcagtattcaactctttaagcttgaaaacaagcataaaaaactactgccaaatcatgacaagagttgagacaaccttatagaaattaattaataaactaatttcacaggcatttatttgggacaatgcgactcctaacatttgacacgaagaaatattgggccaaatgtcatgcacaagcacgcagggctcaaatcaatcaaaagcccataacccaccaatcgattttgttttctcactcggaccggattaacacattctaatcttcgcggcagaattaaccaaaccctaacctctccctcggaaagggaaaccacaaatcccagaacaaaatctccgatctcttatcacctcaacgatccatcagcgacacggattagattccaccccttttggcaggaacaagaaccatcgatctcgtctacgagtaagaaattaatcacgcggccgcatgaggcgggggggcaagataattaaggagatcagcgacctgcattgcgtccggctgagtgtttgcgggaggagagctagagatcacctggcgcatcacgagacgacgccggagcatatcctcccgccggagacgacccggaatcagcggctcgcggccgacgggcgacggcggcggcggcggcggcggcgggtaggggctttggaggcgaagcgagaggggtgagcttgtgattagttcaaaaggttatggggcaatctgcaataacttcacatcgctgcttccttcgctcgccatcgccagtcgacgcgtttctcctgactggaacctctcaccctgccacggaaaacggagcagcgattagcagatgattaattaagtatttgatattttttaaagaaatggattaatataattttttaagcaactttcgtgtagaaattttttaaaaaaacacatcatttagcagtttgaaaaacgtacgcgcagaaaacgagtgagggaagttgggaacgagaggtaacgaatgcagcctaaggctctaacatatttccctctaacttatgtcattgacgtgtgggtgtcagtgactcaaagtcagacggaagtaagtcagaggatcctctctccatttctccttccacaacacgaaaagaaaaccttccccgcatgtttcttgttttttccgcggaaaatttttttcccgcgcatgttttttcttttttttaactgaacaaacttttaactcagatttaaaaattttgaaatcaaaatttgaaatttttcaacttacattcgaaaactttcaaattcatatctgagagtttatacttagatttgaaaacttttaacgtagattttgaaaattttcaggtcaagatttcaaaacttttaactcagatttaaaaactttttaactcatatttgaaaactttcaagtccagatttgaaacttttaaacttaatttgaaaactttcagcccagatttgaaaattttcaaatcaagatttgaaactttcaactcggattcgaaaactttcaactaaatatttgaaactttcaattcaaatttgaaaactttcatcttaaagtttaaaacattcaacttaaattttaaaaacattcaaactcaaaatttaaactttgagctaaaattttaaaaacttttttactcaacatttgcatgtgattaaaaaaattcacgaaaaaaaatcatgtgaaaaaaaataaaaaaatcatgaaaataaaatcatgttcactaaagaaatcacgtgagacccgcaggccgcacgtgtgcgccagcttttctaatggcacactcgcgccctttgtgtgagcggcagaccctcaaagtaaaacacattattttatagaacgtggctatttttacatgtttcaagagcctacggatttaacaaaatttctttttctggtctaatttttatataatacaagctttattgatctcggtcattctgaggatacttctggcctttgcaccatgacagtgcacacagccagcaaactccaacacaaacaaaataagagaaaaaaacagcgtgcaagatcaaggccctacaacccgaagactaggtcgccacccatatgtcggggtaaaaaactccttgatcacttgttccaaatgtaggcaagccgaagtgacaaagtcctgcaatttaggtttctggacaataacctataatctatatcttctataaagttacaactcactaaatttaaagctcaacattcaaccatatcacatcatcattcgctaatgataattacatatcaaacctcatgcaagcatgcaatctataatctattgaattctacaaatcagcatgcaaacatatccaatcatcatccaccatatcatttccacaatatttttacatatctatatatattatttttataatacttaacgtatacttatcaatatattctgcactaaagcattggtatcatttgactattttaagtttagtaccaataaaccctaatatttcattattatttttcttttttacttttagctcgattgttggtaaaaaacatattaaaaatttattagtaattcttgcaacaaagcgtggggaacacggacgaaggcacggagcaccactactacaacgctacctatgcatgaatgtggtctccttgacacccagactcattcaaagacagatcaacaacaaatccgtaaaaccttgttattaagtcgtgacattattcatttaaaagtaaagtaaattgcattgactgtacacgaacttatcatatggatgcaatctagtgtataaacttgtaaatgactcgttttgatggacgaacttgcttggtgtgtattccctccgtcctataatataagggattttggtgggatgggacacatcctagtactacaaatctagacagagagttatccagattcatagtactaggatatgtctcattccaccaaaatcggttatattatggaacggagggagtacaaaacaaggctataaaaggcacggtgtagctaaccttactaggtcagatattgattaaacatgatgtgtccatgtgaggaggacatgagacatgctatctttgcaaacaacgatgtactttgtttctaaatttatctttatccttctttgttctatccttcttttatatacatgcttatgttacatcctaatcaacaagattggtcatatagtacctttttatccttgggcactcgccgtacaagttggtgcaccaaaacgagcgcttattagtttatacaattttgctatatatttgtcgacaaattttctccaaaaaatttgacagatgtaattatagtataatcgtagtataattacactgtaacttgcatgtaattacactgtaactataatgtaacttgtacgtaactttcaaaaatttatctataacatgttatttcggtaaaatgaaggtcgtgggaacaaatcatttcacatatgtgtgtgctgtgatttttttcttcctcaccataacaaatcttgtaatagatctaacgattcaaaatttcatgaaacttacatacaagtgtaaagttacactgtagttacatgtaagttacagtgtaattacactacgattgtactataattatatctgtcaaatttttaggagaaaatttatcgacaaatgtataggtggttccagtttatatgtactacattatatgcacttgacacaagtcggataccgtcaattcaatttactttattaaaatttatctggacaccagaattaacttccctttagaaagcaaacgttgaaccaaactgtttagtagatagagctgggccagggtagatttaactctagccggacaggcattttaggcccggttacgtttctctcactccagttaagctgggcctaatcctactaaaaaagtaaataaataaataaataagtaaattaataaaaataagaataaaaagcttcctttttatcaataattgacaaaagagaaattttacggtccttaaaaaataataagaggtacttcctccgtttcacattataataatttctagcattgtccacattcatatatatatatatatatatatatatatatatatatgtatgtatgttaatgaatttatacatatatgtgtgtctaaattcattaacatctatatgaatatgagcaatgctagaaagtcttataacctgaaacggaggtagtaccaaatttttagttcaaatttgatatctcctcgtaccgaagataccaagagatatcaaattttacactggaaaatatagtacctcgtcaaggatcgtaaaatcgcacttgacaaaaacaaattaaacagccagcccctacattctctttgcggtaactggtaaattctccatctatcctacttgtcactcactcagtcagtcactctgcacttcagccgtagtgacaaagcccaaaggcaatggcatgcagaacaagccaaagaactgaaaaatttccgtctgaaattctgaaccttgaaattgtgtttgtttggaagcaccttaacgtggccattccttcatcacaagagagatcatgcaagaatgtctgcagactctgtccatggctccatgttgctgtctgggccttgaagcatgaagagggaacagccaccatcaatggcctcccgacagtcagcatcctacacatatctttggtggctagggccatttaattttcatgagttaatttcttgatgcaaattaagcagccaagcaaggacacacacaaaaaatgcagccaaatgcatatgccagtgaattaatatcgactatagatagatattcagcaggaaagattgaaagaatcggttaacctgctgaattttcatgtcctttctttgtctgaaaaaaggtttcatgtcctaacgcacactttggtctgcttttgtatgtggaaactaactgaatttttctttctcttacacaattatttcatctatggctctttgcttgatctgtcgctgttgatgcacatgaaaatgttggtgcatccattgaggctgcaagctgagctgattgctgtgggtggttgcacttggggttgggcctagcaggaacagtgcacctaagcaccatttttggaaaatggcaagctcaggccatagctcctcaatgagggcaggcaaatgaccaaatcatggcaaggggagggaccttttgatgaggtgatggagatggcgatgggaggagcaaagaaagagaggaggaggtttaagtggtgttctgagacaaggcaatccacattccatagccccggtacctggcgtggcaccgtgtcatcccccattgtctgcccatcgtacacgctacaaagtttatttttcatggaccatcggctacatgagtcctagaagattctaaaaatttaactagatttctataaaatcatatctgaaaattatgatggtatatatctttttgctgatgttcctttttagtattctttagctccatcttttgcttgttcagctgaaaccaaaatttgaattgtgaaacttaattttagggttgaggtttttttattgtagttcattttctagtattagctttcaaatcgataagaacacacctattaattatttttagttatgttgttcatttttttttcacggctgataagccgtgataattgtgctggtgttttttttgaattttatataattttagtatttttcttgggggggttagatcaattatgttgacttgatggaagtggacaagtggtaaaaggaaaaggagcatgagtggagtaaagtaaaagagggaactgcaatcttgtagtgatagaagagaaaacagggttttcaatatgttttttcctctatggcaataaggttttatcaattctaatttgcctccaaagttgaagttgtgatattcatgcttttgactttgatccaaattattttagaaatataaatttgtgaaacaaagaaatttcaacttcattcaggtttcaaatgaagcaaacctttcggcgaataaaaaccatataaactaaagcaacaattgagacgagtgacaaatccttaatctgaaaaaaaaggagaatgttctttcatcaattaaaaagaatatattaatcacgcacatcatcccgggagatatgaagaagagatagatccagtttgtccagatagtgtttttttttcatcttcttcgaaatatctaatcaatcactgaagcttatctgaacagttcataagtggatagtcatacaggggactgtccactgaagtgcatgtcactggagatggaattagaatccttcacatgatcacatccagacctggaccttactatacacaaaattctctgcaatgctgtttgatcagtcgatctgtttggaatctctcatcacaccaaacatgttctgctactcttgcttgcactagctggactggatctctcttgtttgttcctgcactagatcacagacatatccaatatgcttcccttttgttaaagaaaaacaaaaaataaaactgtggcacaaagttgaccagcaatcattttcagaggaattattcgatgggggtgagtgaatctttgccttatgtcagctatggaataatacttctggattgtgtccagacatttctcttttgtgaaggcaacagctaatagaatacaggagctttatagttttctgagatgctaatttgttaatagtgccatgcccactaacacaggtttgacaaaagggcatttttctcagaatgttttaatttgtgtgcccttttgtagttgtttgttccattttgacaccgtaccgtacacagccaatattaattgtgtgtccagcattgtaatgcttcatcacagttcacaaaagtatatgtattcggtgtactttgttgcttcattatttaggaaacctattgtacttaatgtgtgcataataaaaggaaattaaatgtctcccagtatttatttttccttggcacattcaaggggctatttggatggcatccccacctatctaaaaacaaatgagaaagtatggcatgtcacacattttgtggctcacactttattggtcacaattgtaacaagttatgacaaaaaaaaatgtgtgcataactagtaggctagctggctaaaaaagtatggcatgaacatatatggtattagcccagactttttttttgctatattgtgaaaattaggaacaaagatactgatatttagggaggggggagatagccaataagatatcgaggtttgactgtgctcatcctaaatcatctatttgtaaacacagagagtataatgttagagcggataaatatgtaactaaaaaattcaaataaatgtgattctaattttggatatgcttgaggtttatgatatcttatggtacgacccctccctctttagaagaaaatctacttttatatctaaacttcaatgttgatacaggtatccttcacacgcgtatattaatatactatgttttaatattcacaacttttaaaaatggtatattgaagcaaggtgccaaggtatacaggtttattgattctccagaatattgcatgctgaattaattgttctatgtatagtgagttcatgtgtaaacacttcaactgtataaatcatatgtgatatgttctttatcatgtgaaaatcatctagtggaaagccaaataaatggctacgacgtacttagctgtatccttgtaccaagccaagccactaacaatttgactacttgacatcgctcgtcaataccaatagatttatgcatctttcttactacatataatactatatggaacatcacaaattcatatgaacattcaagctatttgaatgattgaaatattggtgtttgcttcgtagatccataatcacaatataagcattaaaaaacaagtaattgcgtgccttgcaaaatttgaaatactatcacaacaaacactccaagctttgatatgctttttaacaaactatatcggatctactctgagattagtatagaccacttttcgcatagtagcgatagctttagtgcatcttcatcaaaatccaacctaccaaccttgtaagcattgcttgtcacatagtacttttagctttgccttatctttcttaattataaccatacacaaaacatcacgaacatcttgatcacacaaactaatagtgcgttgttgtttataatcccagcaaatatgtagactatataacaaatatgtagaagtccccaattctcatgagactatataatcctagcggaagattactcatcggcattgtacgtttaggtaggtttacctcatttttcttataatcgtacatgaaacatcacgaattcacatgaagattttggccacacaaactgatagtttgttgtcgtttactagacaacccataatcgtaacaagcataataaaaaccataacatgcttaactataccttctaacaaactccacacaatcaacgccatgattacattgcacttgtcgtatgctatctagaattaccatacatggcctcccctcataattgtggggtgatattctagacttttcgagtactcacaagacctatagtcctagacaagggatgagagagagacgagggtataagagaacatcgtgagaatgcgcatgaacaatttatagtacgaacccatggtatgttaaccgttaccatccaagcaaccatgatcttaattaacatgcacaataaaaaacatgtgaataatgcacactttacaaatccgaaacaccagctagcgcaacaaccaccgcatgcttagttgtaccttttaacaaacgccacaccatggactacatggctacttggcatcgcttgtcatacactatccgcattaacttctaacatgtgtctcgccactcggtctgactcccccccccccccacacacacacacagtcgccacggcgagcgctatcctggacttcccgggtccgcgcgggactatataatcctcgacggaggaggggaagaggaaagggaaggtatcggggtatcatccaaagtgggggcatatgtggagaggcagtgtgagtccctctttccctgtcatctctcccctactaggcccatttgccctctcccccctccatccatccatccattcatccatatctcccttccttttgccgtccctttttcttgatttgattcttcttcctcccatggtctctcctcttctctccccttccttacactaacagagagctcttcttcttcttcttcttcttcttcttcttcttcttcttcttcttcttcttcttcttcctctcagctagccgtgctccggctgcgtgagatgtaagacgacgcgcgaatcaaaaatctcaaaatctcaagaagccaagaacagcagcagcaagtagaaggaaaaaggaggagagaattaagagggaatccaagaacagtggtaattaacgctttaccaatctctctctctttttctctcttaaattatttctctcctggattctttggtttgccttgtttgacggtagattagaatcgtgttgtttttcattttcatttttatgtttattagcgtcgaatgattgcagtcttcgtcaatcaggtgggccgacacaaccgacttgctgttcgtgtctctgtttctttccttcttcttcttttttttctgttctaagtatttttcaaaaaaacaaaacaaaaaaaaataaaaacagagagagttttgtcttggttcttggctggtttgcatcatgttgattgggaaagcaaaaatctctctttcgaagccccccatctgccctactgttgctgctgctgttactactactgcctccatcagccgtcggctgcagtcgccgaccggtgggccccactcgtccactttgttgcaaaatctctgtgtctttattgtttcttctggtcgcgatcagagggaggagagaattaattaattaattaattaattaaaggggaaagaaaatcatggatgttatgattggagattggatggttggcttgtgacggcgcatgtacactgtagtcgtatctctctggtagcaccacgtacaattaattagttaattaattgcatagagttttttttttgttcatttttgtttgcttgttttgggaagcctttgattgatgtagcagtagcagtagtatagtactgtagttaccgtgccacacgctgctgataggaggaaggggggcgcgtggcctatctggaccgtcggatggagatcggacggaagggagtgctccacgtggcatcgagattccaatcggggaggcgccgccgcccgccgcacctgcggaaagcggattccctttttgggaaagcgtaaagcgcgcgtggctggctgcctggcctcctctcgcgcagcggattgggcccgcctgtcggtgacaggtgccccaccgggccacgtggctggctgaccaccagtggtagttgactactccgcaattaactactcctacctggataaaaggcaattatgtgccaatcagaaattcagaaatgtgaattcctcttaccagttgacttgagaccatgtggattaccaaggcaaagatgatttggtctatcaccctgctgattaatctaccctccgttcaaaaaaaaaatcaaaccctatatttaaatttggacatatttgattttttttacagagtagtaggttaggtttaggtcttaggacatctctgtgattagtgattaatccccaattgtttcaagtacttgcttgcctatttgtaagtaactttatactctctgtttgtttcagaaaaacaacaaaaaaaaaggaacatttcacattagtatcttcatacaaaatcgttcacctaactacaaactatatacaatagtgaaccgatgacctttctcgcacttaaaaatcttgaacaagattacttgttttgttaaaaaaaactattcccttcatcatgtggatatagtaatctacaactgaaatggatgttttataatagatgtatcccatccgattctagattgttatattctgagacagagcgagtaaatctgatcattttgcatttaacttttcacgattatttgctctttaaactccatattgttcaaaactgggcaatgctccatctattttaaaatacaagacataactatccttagtccaaagaccaaaaaccaattattatcatttttcttgttcatatcatcataataaatacaatacatgcacccaataaaattagagatattgagaataaatgatttaaataataacatttaacttaaagttgccattttcgtattcaaacacgtgctactaactgacaggtgggccctaaccgcggcatgcaacgctggaaaaataagacctaatcaaccgaattttttatttatattaattaataagtcttgaattaaataagtggtaaatcttaaattgaatttgtaaaaataggatggacgttgtttcaaagggcgtccagatttggacgctgttccaagaagtgtccagaggtggacgctgtaccgaagcacgtccaggctcggtttggggcgcccatgccgccatgcggagaggcgccatcgtcgactctcctctcctcaggcccaatgttggtgcagggctcgggcaaggtgctgccatgcccgccgttcacctcgactctgggagactgcaacagccgccttccggcttccgtctccacaatgtcaggaatctgccattgcagttcacctcaactcacctcgaaggctctcgaatccggagaggacgccgccgctttttgccttcacaccgggaggtcgcagccgctatccacgttctggttgagtcatgctggaacaataacccactcgtgccggcttgtgttgcgtcgtctgtccgcccctcttggttcctaacagcaagtccaggcatcgcctcactccaggtggctggccgagcaagtatgctcagttcatagattttggtattcaggtgtatatgttctgcaatagaaagtttacaaagaatgcaaaattacgaagggtaggacgcaaacatcctccttctatcagatcatctgtcgcccgatgacttccaatctctggcttgttgcaaaaggaaaaaaagcatcgatcgaaaacctcgcatgcagttcatctggcggccgcttctcaagattcagtcagcagagagctcgatgcgtagtaaacaatggaccagaacaaaaaccaaactaatcaaatatctcaaaataaaagtggtggctgttcacatatgaccccgagtagagtgtccgtcatgcggaacagcggaagcattgaaggagagccgggggatggcgaccctgtctggcagatcaggtagagagcggtgcctactcggcaagcaagcaatcaacaagagacaatagtctgcataggagtaacgaggcagagttcgaccattgtgtgattggatccaaagtccaatcttagtccggtgaattggacggctctgtggggtcttcaactgcagcattatggacgcccttgtaagaagcgtccccatctggacgttgtctacaacagcatccacacctggacgtcctatgcaatagtgtccttcctattttcgtaaaaattgactttgctttattatatatttaatttctgcattattaattattatgaataaaaaattcggcctaatcaacatcacaacaagaacctctgaaataaaaaaaacacagtaataacaggtataagtaacaaaccacaacgaaccctaataagttcagataatagaaaaggtcttctcaagattcagtcatggcgatcgccgcaagcagggccaacgccaacgccaaccgaagccgccaccatcatcaaccgaggcggtgggaaaaaaattcctcccaatgctggcacgcacgcgcactcgctcgagaatccggcgggtgggactgaaaaaacaaaacaaaaaaaagcagatcgattttgtcatctgcggcgcaaagcgggtgtgcatttcttttcttttatccccacatccagtcaccgtgacgtggttcttgattcctcaggccgggcgattattctagctctagttgggatgattggattggatccccagccagcagcagcaagcaattcttggccatcggttgtgggtggctgttgattcatgcatcacgagcactcaataaagtatgcagatctgtgcgcccctctctgatttgttcatccaggcaaaagagtatcttgcttctgtgaggtgaggtgattgattgattgatcaatgggggtggattgctttcagggagatgtgtatatgttgtgtttgcagtagcccatggtttcttggcaattgttagttttctgatcacagtggttcaagttggttgcctttttttatggttataagcgatgtgctctgaacttctgatccagatttcgatccagttctgcctgcgattcttgagtttttatgtgttccatgtcagtgtctgaatttttgacaggcagttttcagggtgagcaggtgcgttcaggtttcaggtatcgttgtacagaaattgactcgaaactgctcatgactttttcaggatactaaagcgtgaagtgttgggggttagcttttgattgaagccatcgaaaattttccagtgaactttcaggccctgctgaaagaagaatctactgaaaggttggtctaatctactctctaaagtaatttagatcttctttatgaggagcccatcattggtccggtgatgattttaagatcgaagtttctaccctcatgattggaaactatcacagatggttcacaagacgaaactgtgtacttctgtttgcttatatatatctgcatacctcgcatcatgacagtgctggttttcaactcgtaattctttcagagggaagattcgtaaccttggaagatatgctgccttactttgatccggagtatgagaacttcagtcagcgcatcaaccctcctaggtggatctctaatttaaacatctaaattccagagctcctcatatcattatcctgtttcatttcaggctattgtcggaagctccgctactttctgtagctaacaagctgataattttctgcagggtatgcattgacaacagcacctgcagcgactgcaccttagtgaaggtaagaactacttactactctctctcaaaacttgactggataatcttactgaacactgcttccaatattcaagaaccgtttcactgattgcttcgagcaccgtctgtttgcgtttggaggtaggtcgacagcatgaacaagaatggcatcctgttggaggtggtgcaagttctgagcgatctcgatctcgccatctcgaaggcgtacatcacctctgatggtggatggttcatggatggtaaggcagcctatgctatgcaattatatcatatatatgcaaactcatgtatggttcgcggacatcaattgccggtttattcatgatgtctgttacaacctgatgcagtgtttcatgtggtggacaagcaagggcagaaggtgactgatgagaagaccattaagcacattgagaaggtttgtaattttttttccacctgaaaattggtcttaaaatttaccacctgaaagttgaaaacctattttatcctctatatcaagctttcagaattatttttggtgcaactgcatcctgatagtgtttggtttgaaagtattggtagtttaggtgaagtattttcgtatctgttcatcatgtcagtatgtgtttcagtttttgaaaaacattttaaaggttttcctttaatgaattacaaatttagaccgcagtactatttttcatgaggtgtttggaatggatagtggagatatggagccaacaattccttttatcaagttttaatcctgtttaaatacggttcttagcgtgttttcgtggtcatgttcctgagcccatggaaaaggttacatnnnnnnnnnnnnnnnnnnnnnnnnnnnnnnnnnnnnnnnnnnnnnnnnnnnnnnnnnnnnnnnnaatataaanncacagcg

SEQ ID NO: 21903 - DNA, 6953 bp, Oryza sativa
  unsure (1)..(6953): unsure at all n locations
cggctattgaatagcactnnnnnnnnnnnnnnnnnnnnnnnnnnnnnnnnnnnnnnnnnnnnnnnnnnnnnnnnnnnnnnnnnnaaatcctctgacttaactacacatgcatacacatacaattgagtcactgacatgtgagttccactttgatatggcgttaagtcagaggatctctttcagctcgaactggagcttgaatatgtgctaacactggtggttgatgatgcagggattcaccctggagctgtgcggcagggacagggtcgggctgctgtccgacgtgacgcgggtgctcagggagcacggcctgacggtgacgagggccgacgtcacgacggtcggcggccaggccatcaacgtcttctacgtccgcgacgcctccggcgagccggtggacatgaagaccatcgagggcctccgcgtccaggtcggccacaccgtcatgctcaacgtcaagaaggtgccctcctccccctcctcctcctccgccgccgccgccgccgccgccaacggcaagtcgccggggcagcctgcctccggcgccctgtccaggaccagcttcttctccttcggcaacctcttcgccaagctcagagcatgatataattcacctgaatctctgaagaattatggtccctttttcgggttgcgcaaatcgccataaggagaaggagatttcagttgaaattttagagtttagggggtgagggtgagaaactgcgtgtggcatatggcagaaaaagaaattgctgttgttgtatagtccataaaccataaggagctctacctaccagtgtaggaaatgagaaaaaaatgctggatccatggtgttggttctgttctgtgcaatgcagattgcagaatgcagactgctcttgagttgcatgaatgagctttttgagctatctgttcatcttttgtacagcatctttctagcagaagctcaaagaaatttcagtagatcactctttttggagtttgacagcattcatctggcaggtcagcaatcagggatgtcaatatgagatagaagatctttagagcagaggatggtgacagtaggcagacgataggatcaaaagttgatttttcatgtcagagttttacatgtgattttaaaatcagagagaaatggacttccagttacacttgttcttgctttctttcttttgacaactcccaaaccaaacaattacataaacaccacacaattcgataaaatctatatcaaaaaccaagaaagaatctactgttcatggacagaaaaagaacgattttgagctaatggcctgatcaccagtgctgcagtagaatctacaatgcacacccagacaaattatggtgatgcatgatccccaactgttcagaagcacataatctggaaagattcagggatctcttaaatagttgcaacctctctgctactttaccactcatttgcgtggttcaaagtcatcgtcaacatcatatgctgggttgcataagcatctgaataacctgccaattccctgaaccacaaaacatgggaactaatattagcaggcacttgattatgcaatgctttgctatgcaacataaaagctgcttagtttagtaattgcctgagtaactgcaggagtccgataaggcactgtccgagccacgtcgtcatctgaactttcatcagagctgctgtcatcatcgagaatggtcggttttgatggtcctggcaatgcctccttgtccctctgtttgtagtccaattgaattaatatggtatttgcaaattatgataaaataaatctcatgtagcggtatgaattatcctaatgaaaaggccaagtaacatatacctggaatatcttcccaagaattttcagtgccattgcacgagccttgagatcctctttcttgacattgttttcatgcaacacctaacaagtacaagagaatcaattcaatttaatgtactaatcattttgacatgttaacctggaagataagacaggcatgtcgtgctacttggcgatcgcagttcagatactaccaactaactattaatcatatcactgcaaatttctatgatatcttgaggcataccatttcacaaacgtgtagaagggtcacttcaatatcaacaatattcagcttccacagtgagctcatcatcaggtctttgttcatcctcatctgcagatcgacatccctctcggtggccaagccgtccttaccgctctgccggcaggcctcctcttgcagctgcagcaactgcaaggctcctgcattgttctttttgtcctctaatcagtcagcaattttaatgaatacacaccaaaagccccggtttgcgagattttcacctttcgccgcggtgatctgtgacctccataggtgacccttgttcctcacccactctgccaggaatgggactccaaggtacatggccttcttgccaagctcctttgcagcttgccgggagtacacatatccaattgtgcgaagaatgtctagtccagatgctgagcaatggcatttcagaacagttaaaagaagcttttcttagattggcatagagatcgaaatgaattgcggggatcgatcagactgacaagtgctggacagcctcttggcctcggattcggcacggcttgcgaatccttcctggtcaccacgaacgtattgcgagaggaactccttgaggaatcttgctagcttctcttctctttccctttgcacaccctttgtcacaataaacatagaacagaatggttagtatcaactagtctagtgccaacattccatcagaaaggagagaaaaatcaaactggctttggagcatccataatcacagatggctgcaatggctattgagctcactgaccttgagcctgtcctgaagcttttcagggttgtcattgtcgctggccatctcggaggaagccattgttgccattgcaaggtggccaatgtagtcctcaaacagctcactcccgaaaagaagggtgaacaccacagtgccatccagcatgttctccctgaaaaaacaaacaaaacaaaacaaaacaaaacatttgttaacctgaaacttgaattgccacagactgcagagagtcaatcaatcatctcagatgggtttgtttggctacttggaaatgctggtcttgccatagccatcgtaggccttcctctgaagaggatcactcagcacctggtaggcctctccgagagcctgcaaaaaatccacccaagaaagctcagctggtcagacaaagcaaactgaatttaattaaaaaaaaaccatccaagcaagaaaccaacttgagctgagtagcaggaaacaacctggaatttctcggcggcttgcggatcattggggttcttgtcaggatgcacctgcctcgcctggacatcaagaaaccaaaaaccgaaaaaaaaaaacaaatcagcaccgactctccgagcagagttggcataacaagcaagaagcaagaccttgatgtagtaggccttgcggatctcgtcgtcggaggcggcggggcagacgccgagcacgtcgtagaactcggtctccttcgccatgaccgccgccgccgccgatgctgctccctaccccaagaacaccctcccgcaccaagaacaacaacaacaacaagaagaagaagaagaagaagctgggacaggatgaagcagacagagcatggatggggaactggaaagtgcaggtctggcgatcgatctgggcggggggagggagaaaaggcgcatcattcattcataccgcagtggagaggggccagagcagaggggggccatctttccagtgaggacgcgcaagcgcagcggcagcagctgggcggcgaggcgatgctggtgagggaaggtggtggcggacatggcgagctaaacaaatggcgcaaatgcgccgcgcggcgcgaggtggcagaacagcacaggtcgcccggttttctttctcttttttttgaaaaaagaaacttatttctccttttgtttttctatatttcctcctccttgggggcaaatgggcagtggaccccggggaatcaaatcaagcatttttaaatggttactactcgtctgctccctccatcccatttcaagtacggttgtgtatttaagcgttcaacattttaccgtacttcttatttgaaatgctttttatgattattattttattgttgttagatgacaaaacatgagtagtgctacctccgtcctaaaatgtagctatttgtagcacagtaccgtgtctcaaaatgaagctatttttctacctacctcctcctctcaaccaatcagaaccattatccttcacctactttttttttcaaccaatcacacaccttctccaatcattctcacctactttcttaatgtccgtaccaaccttaaaaatacctatattttgggacggaagaaagtactttatacatgacttaattttttatgtttttaaaataagacagacggtgaaacgttagacatagaaaccagaactacacttagaatagtacgaagtgagtagattattatacccttaccttttggttaaacaggttattaattaatgtttgtgaaagagatgtactatgagtctgtgactgtatgaaactggaaccacagttaagcgtaagtgcctagcccgtagcccacttatagggttatagggtaagcgacctaaggcctcgtttaattccaaactttttcttcaaatttttaacttttctatcacatcaaaactttcctacacacataaatttctaacttttccatcaaattatttcaatttcaaccaaacttttaattttagcgtgaactaaacacaccctaaagggggtttgcggactacctactttctcccctaataccagacccacaacctatatattcaacatctccacttataagtaaaatgagaggaacgtactaaacacatagaactatatagccgggacatgttagtgaatagtgaccatgatagggttatacataaaaggattagctttgagggatggggaaaaaggaatttgaaaatttcggaatataggtgtgttctttttagagaaacttttgaaacaggggttttgtgcaaatttgtagttagctactccatataagataaaatgggagtggctagaatttagctgagaattttcaaaatttccagtaacttatctcgttactttaatgtcaatccaataattatcattcctagtccttttttttcttgtataaaacgttgaaaaacatttatacataagttttacaaaattacatgcaaaattttttacaaaattacatgaaaaatatttaaacatggataaaaataaagtaaatccatatagcaacaaacttacagttaaatagaaataaaaatgcaccttgcatactattataattttagacttatgagtgtgcaatttcaggtgattgaaaatatgcaattttccatgtgcttgaaatctagtaataccccaacaaaatagtgcacacatatatatagtaacataaattggtatttatatagatgtatctttgatttgattcagtcttatgtcaatatatatatactaactcctgcatgttattaatcactttggtttgagatcccgcagaccttttttaaatgaaaggattgtgccttttgcttttccctttcttctttagagtttggtttttttttttgcgggattctttaaagtttgttaatgaatggatgtgcatgattacgacttgtggacttgtggtagccacattgtttatgtaggagcaggtaaaaagcctagtcgttagtaagccatgacattttttgtatttttttcccacaaacttgtaaatgaaccagatcatctttttttaaaaaaaaaaacaaactctgattttttttaaaaaaagaattaatatctggaagtcttggaacaggctaaggggttgggttttggtttagcatgttaggtgccttgttttaaggtgtccgggggtgtgttttttctgattggtgggcctctccagtgatacctatgctccagcgttagtctgttcccttaagtcacttgtttttctttgtgttgtgtaagacttctgtgccgttatcttcggctttgtttaaaagccgggtattatgaatgcctgttataaaaaaaagtcttgggggcaaatccaaaaaaaaacttaattattattttaaatattttagaaaaaataagtaccaatattttacaacatccttttgcttcttgtgtttttcatattaaaaataaaaccgacccaagttcagcaaagctagccaccatgaatcacattagcttcctatttcatcagttgtatcatatccttaatttaaccatggcaggaaaaaaaggtatcgtatcctaacaatgttgcatgttttagttactttagtaaaaatgaagtgcaacatgcccaatgaatgcaattgaatatacttcaccttagtttttttttttaatttctgctggagagctaagtgggaatcttccttgatgttgattaactagtgtacactgcagcaaccccctggaccagccaacccctggaaatatgcagacataaaaacccctcaagcacaacacacacaacacacaatgctgcagcactgggcaaagtttgttgggagagaggcaaggcagggaccaaaagggctaagctataaaggttgtgcacatgtgatgggagatggctttacactgcctgggatgatgcatgtcccctccatgtcctgcagggctccatcatttgcatcacatattcacatggccacagggattcgattcgattctattccacgttaattttccatccatgatccatgtagtcattaaagctagggttcttcatttggaagatgtttaaattcagctnnnnnnnnnnnnnnnnnnnnnnnnnnnnnnnnnnnnnnncgaggtgcctcacctggntctcatggnacatgc

SEQ ID NO: 21904 - DNA, 4626 bp, Oryza sativa
  unsure (1)..(4626): unsure at all n locations
agagaatttgaanattcganttttgtanaacnnnnnnnnnnnnnnnnnnnnnnnnnnnnnnnnnnnnnnnnnnnnnnnnnnnnnnnnnnnnnncaaatgtatttattgggcccatcaccgaaccttgcatatattggattgcactgtataaagagtggaggggcctactcattgtacagttgattagagcattgattagtaaagagagtctcacccgtaaactttgtgtctccactttcgatagaattacgggactcttttgtactgcttcgtgtaacaggagggctgcgtaatagttctatgtaaagtattgcggtcaagaaaattcgccatagttgccaaaagctatatgagggcatcagtagcctagaacgctataaagattgaccaatcattaatttttttaagaaagagcgggactaatagtcttgttgagtagtatattagtaacaatttgaaggtcataacatttattttgataaagttatattacacaatgtcaaaatttaatcaatcattattatacagttagccgaatcgatattattatcgttgttatatatataactaacggaattgctatcattatttatctttgttatataacttgcttagtgacaaatataggactaactttaaggggtgcaacataaaaaagaaataagacaatgctgccgtagggtggtaattggcctaacattttgacctacaaaatgtaagggttgggtaaaaaggttgagttgaaatttagtatttttttgtgctaaaaatatctaagggttgagatgtgttgtgaaaggatccacgggtcttgacccattaccacccctaggctggtgtctaaaatagaacgaaagcattgtttggatccaaaatcataaatgaatttaatatgaacataccaaataattcaaaataaatcaagaaagtaactcaataaagcatagcgtggtacctcttacaagccaataaacgcgcacaatactaatactttctgtgcacttataataccaaaactaatgttgtatttaagtacaacttaggaaaccgaatgaattaattattgctcacatcgagacaccaacttgtgacgtcgaccaattgatgtcgagccagttgacttgactcattatcttaacgagttaaaagtcgagctgagctgagctaaacgagttaacgagccataagttttttttccccttggccctaaataatgcatctgcagttctgcacgcatctggccatatgcgtgtagtgtgtacccggtgtgtacatggatggataactttgttgtatgtgtgtactagtgtagtacatggatagcctgtatgcgtgtaccggcggtgtacgtcccttgtggcccttgaacttgttgaattgccttcatgcttgcgtagttcggtagttggatactaatatatggatcgagatgtatttgatagtgcaatggcaatggacgtgtggtttcaatccaaagattctgagttcaattggcataaaccaaagctaacttatgaagttatgcgtcactataggtggaacagagacccttgtcacgcatagcggggatagctcagttgggagagcgtcagactgaagatctgaaggtcgcgtgttcgatccacgctcaccgcaatgtttttggtacatttttgttttttaaacttgtgcgccgtttaaaattggtttgaaagcctcatccctcatcttttaagaaaataaaatacatctttcaaactatggccccctttacatctttttgtttaacttatatgctgtttaaatttgaaaacctcctgtcgatctctctccattcgaaactctaacgaaacagactggcccgctgcttccgcttgctgttcagtggcattctcctacctctctatctcccttagaaattcagggtaaacctagcttttcgatcagccaacatcgcaagtatccatataatatgcttataacaatttagaaaaacttccttcgggtgtgtagcggccgggatattttattccattttctaaaaatttacaagttctgcaactggtccaagcctccactccacatttctagtcctacagatttacagaacatcagagatcatcctaatgccctcctttttcctatggtatacaatgaatgatgaatcagatcagagtaagccatatatagttacaaatgatctgtcaacaaaaaacatatgcgactccctctctatcttgtgtcagatatcaacacatatcatctacaacaactctgcagatcagatcagacggcctagaatctctttgggggagccatgctacaagaaactctgcaggtcagaaggcctagaatctctttggagagccatatgggcttggaggtctcggctggctcaactccagccagggatctggaactgcggcgcttcgcctcgactggttctgcaagggattgtttgggtaggctgctgctgataatccaggggagagcgccggatgcgttggtgaagggaggcagctccagtttgattgcttgaactgccgcagcgggcttgagcatggcgacaccggtaaagacatgtttgctctcactgcagttgggctgctgcacgtgcacggccatgttgagaagtaggttacaagatgaacttggaaacaaaggatgggcaggaggtagaatggtatacctggaggtattgtgaggagaaggataggctgtggaaaatccagcgaattcccttgcgcttagtcctgcgataccatgcagaggagcaatgtttctccttgacgaggattctctgtttggctgcaaaaggggaaaaaattgaagacatgacaaggatgtccggacatgggaattacgtcgtgtaatccagtctttaaacctggtttcacgtaattaatttatcaacaacagatatgtaaagcaagcttcctaaaaagaattatgtgcaacacatgaatcagccctactgccccccatcatctgatgcgatgatacaannnnnnnnnnnnnnnnnnnnnnnnnnnnnatcttgtaaacatctagaaatatataatctactatgtcctgttggtacttcaaaagagtaaaagagctcgacattgactctgaaaaaaacaaatgagcagaaatctcacctttctatgacttgctgcaggggaagaaattccatttctcaactgagtaccattgcatgttggtgctcttacagcctgatggtcatggacaaaagggtgacccagcaacgaagctgcagaaggcctctgtactggatcacgctttaagcacaaacttaggaaatctttcccttctttggaaaaacaatctggaatttctggtatatctttactgtttgcaattttaaatattgctgccacctgcaagaccaagaatctgacatgaggctcaccaactataaaagaagtatcaagagtcctccagttattttcactaaaagaggcagaatagcatctccaagtggaacaaagcattttggtaaatattaaacgaagtagcatacatcttcatacggataccagggatgcttcgcggttgccatctcaataattgtacatccaaggctccatatatcaaccgcaagattatatcctttgttattcattacaacctgcacgttttacatttagttggacaaaccgttcttggtgaagtaaattacataacatatgacacagtgctccaagtgttgtaaacaggaaaccgtatacctcaggagccatccagtatgggcttcctctgaaagagcgtatttcggcgaaagatgtcacctgtttcaacataagcattgaaatgagataaaagagacaaccaaagctcaaaaggaattcattttgttgttgaattgaagaagcccttccatagccatcagagacatcttttttaaatcatgtagaaatgacatcaccagcccacaacataaagggaagtttatagacatagtacagatctttatcactcccaagtctcaaacttagaggaagccagtgtttatgctcaatgttaaagacattttactgagttgcatctagcattctgtcagaggaggaacttaatactccctccgtacttgtaaaggaagtcgtttaggacagcgacacggtctccaaaatacaattttgacttcttgtttctataaaaatatttattgaaaagtgatatatgtatacttttatgaaagtatttttcaagacaaatctatacatataatttttatattttcaaactcaacaacttgagagttattcatgatttatatttccaaggtttgacttaaacattgtcctaaacgacttcctttacgagtatggagagagtattcagttagatgactactaaatgctttctgtggtctcagtgaggttttaatgatgcttctacacaaccaaacaagcaaaaccccgggaagaacgaaaatataactgcatacatgtttagccatgccaaagtccgcaagtttgacttcaccattagggcccacaagtatgtttgctcctttaatgtctctgtccacaaaaataaaatttacaaagtgatcattgtattcagtgcctaccatgaaannnnnnnnnnnnnnnnnnnnnnnnnnnnnnnnnnnncttagcgcgcaatcttaagcacagc

SEQ ID NO: 21905 - DNA, 2688 bp, Oryza sativa
  unsure (1)..(2688): unsure at all n locations
cgcgtcaggatgagcacatcctatagcnnnnnnnnnnnnnnnnnnnnnnnnnnnnnnnnnnnnnnnnnnnnnnnnnnnnnnnntggaaactggaaccagggcgtataccctctgattttagaaaagaggaaaaggccaaagcatgcacgattaagcattagaaccaaaattgatgcataaatttatgctctgtgcaccagagagtgagtctatgcatcatcagattagttcccaccaaaaaaaatgttataattttccctcacagatccatcttgtaatgagcaacgcacaatacaaatatgctaagatgagaaagaataaaattatgtggctgcatgacatgcttattgaacaattagtcaataatcatattgaacctaccagttcacttccataatattgcacgatattttggtgcgagagctgcttaagcatatctatttcctgtcattacaagatggacaagttaataaaccaaaacaggatgtagtcagagacaggttggaaaagtgtttgtgttacaataaaaataaattgttcaaaatgacacacagcctatcaattgtatagggcaatcaaatgacctgattcaattgcctaaggcgttcctttgaatgtgaatcgtgcaaaaaaacctttacctttttgattttacaaaactgtccattttcactgtacaacgcccattaagattaatcacaagatggcaacaataagagttaagagtgaaatatatttatagaaataggtctaaaattttctttgatgctcttatgtgatggcaaaaaagtgtgttgttgaacaaattttgtttaaggaaatttaattgaaccatgtatacatgtgataattatgactttaaataaccactatacttctttttatatgttctaacctaccgaattgaacatgtgggtccacataaattttaaacttttgtgcatgtacgtaatcaaattacacatagcaacattttgggtatacagccttagacagaaaaacaaaggatttagctgcgatctagccatagaactaaaattctatataaacttcaaagatgaacctgcatggatgcaaagtacatgaaaaaatgagtcacattcatagtaacttctttgggtgaacttcgaaaccatattattcttttaatgttctataagataaacctccatacctgttgaaaccaagataaacctgaccaaatgtgccgctacttaatagcttcccccttttccactgtgattggaattgactagaagtaatggaagatgaaggaatggatgagctagcaacaggaactggagggagaggcaagggttgagatggactcctaggatcatccatccttttcactggtgaccttggggtaaacccaaaatctcttgcgcagcaagcagaataagcatgccctctcggaccaggggaatgacttcttggtcttacagcaaatgtatcctcaggcaacattctgccccgagaataactagattcacttgttgaaggttcaaagatttgcatgtgatgaacttcgttcacatttgcaataggaacctcaaagaatttttgatgctcctggagaataccacatgatacaaaacgcttctcttctaccatgccattatgaccatcaggtagcacagtccttccgctagtgtggacaactggatctgtatacctacagattccaacaacaaacaggaaatatcagaggacttccaggactgtaggaacagattgtcgaaaaacaaaataggtcatctttcaatagaaaacaaaatagagccaaacagggacactatcagaaagggcaaaggcatgaaacacgcactataactacaggcagaaagaaaagaaccatcaatgtgttgaaatttagcttgacgccataaaaagatgcattcttttatgctctggcatcattcttgaaggaacagataatgctactcctagcatagaaacacctcggcgtcatttccatagaatgatcgtgaggaaaacagtagatattctatttatctataagtagccaccgtatttgttctacgccaagaaattcccacgctaatcaaagatgagaaagatttgcgtctccaagtggaacaaagcattcatttccatagaatgattgttaggaatacattagacattctatctatctataagtagccgccatgtttgttctatgcctaaaaaatttccacgttaacgaaagatgagaaagatttgcgctgttttagattacaacggtgcagatttattgataaaggtttacataagacaaacttgttcttatcaaagcaggaatagttgtatatcaaatccaattctatctgggcaaaattgcgcgggaattccacgcaaacaaattacgcgggaaattctgttaggtaacaatatcataaatatcctagcataaaatatcttaaatacaattgaatgaataaaaaagaaggatgggttgaacttttgacgcgctttggtagcctgactccccaagtccaccgaattatactagtaataaacaaaggaatacggttttgtacgctataggcggtgagagaagagacgaggtcaacggccgtatggcagttgttgcgaagcctcagtctccacacagtttggtcttttagaagtcaactcaagacccctaaatcacactatcactccgcccacttcgtgattactact

SEQ ID NO: 21906 - DNA, 6344 bp, Oryza sativa
  unsure (1)..(6344): unsure at all n locations
ntgaagtactccgatctgttcgtcaaggaaaagaaaatgttttggactgatacgagtgctacaaatgttttgcagttttcttttttttctttttaatactatatttaatttcacacaagtacatgcattcctcgtgattatgggcctgttcacttttgatgtcatttttaacattaccaagtttttggtaaagttgtaaaaaaagtggctatatttagtttgctgccaaattttgataactatatcaaatttttggcattggtaaggtttttttttttttcatcaaagtgaacaggccctatgccttccaacgcaagcttactcgtattccctctgtcaaaaaaaatcaacctaaaaagggatgggagacctctcaggacaatgaatctgaacaaaaggtagttcagattcgttgtcctagaaggggtaggttgagctttttgggatggagggaatatgcaagtatttggaccaaagcataaataatactagtatataggtggtgttcttttctcttgaagatgaagattgatttttttacgcaaaacgaggtggtattaacgtttaattgattgagttttaattattacaaacttaaaaaatagattaatatgatattttagagcaactttcatatagaaagtttccgcacgcaacgtaccatttagcagtttgaaaaacgtgccacgaaaatcttaattttcatccaaccttgttggagaaaagaacgggaccatagttagaaattgctatattttaaattagaggtattaagcatcacttgaaagttaaaatggacaccaaggttgtaactctatacacgcacggtttttaagtcactaatttgtactagctttagctggattttcgaaaactttgattagttcatatgaatggtttaaaatcatttttcttctatttaaacactaaatatttccgttgttttaatctgccgatgctttgattgtttttattactgcaccaccttctctacatttttaggggtctaggcaaactctacactacgtgcttaaatattttcttacttgtaaaaatatattttattaaccattaaccttgtaaagtgacaaataaattgtacgagtaaaagtcaatttgcaaaatggtcctaattattattccatcgcatcctcattgacacaaatttctacgtcgtcgtcctatgtggtgtgctagaacaccgcatacagatctagtccataagtacgtactcctatagtatggccctgtttagtaccaaagttttttttcaaacttccaacttttcaatttccatcacatcaaatttttcatacacacataactttgctatcacatcataccaatttcaaccaaactttcaaacttcagtgtgaacttaacacagcctatactccacaaaagattgagcaaagaagagtctaccgtacaggatgtctgatgattagccggagtcatctgaaacgacgacagccgaagattcaacggagagtactacaagaaggatccttcgcagcgaattcagaaagaatggtgcgtagagaggaggtatatagaggttgacaatggactttgagcatgttcttggatgattaatataatagtactgtaatagattatagataatagcttatatagataagttatatattataaattttatggcttcatcacatttggtttttagtttatcagtcacagcgaaaatttgaattaaagcttaattttagagttgattagatattatagatgttaattactttttaaaaaaaattggttaaacttagagaacttttgtttttggagaagattgaaacacctgacaactaatatatgttgaatggaggaagtgtgtgtttcgattggtgcagagtgaatggagaaatttagagaacgtatgggttttcacttatttaataattttcattagatatatcgtaccttttatatgtactcttgctatatgcatttactccctccgtccaagaaacagtttgttcagttttataatgtgtcatattatatattaattaggttaatttattttgaaatggagagagtatgtttagttggatatgccatgcacaatggcgagttgtcgagcgagaatcgtagatgtaaacgctgacgatgctccagtatatagtcgcatgagagggcgacagtcgaagagctaaatagctggctattaagcctagcgtttgctgtcatagtcgatggctagctaccttttcgtttttacaaacgcaacggtctgactgtgtctgtccgtgcaaggggttgagtcaaagattagggatgattagcttaggcctcaagcaattaattcggttcttaattaactaaggctgtgtttatatctaaaatttggatccaaacttcagtccttttccatcacatcaacctatcatacacacacaacttttcagtcatatcatctctaatttcaaccaaaatctaaactttgcgctgaaataaacagcgcctggtactagtaacaggaacagaaaagacgaaagtactctacacgctacgtacttttgagttttgtctgcctgaaaatttcgtggcatttgagagaagcgcagtttggcggcgtcatcgctgatgtcacgtcaattatctgtactgatgacaactgtgttggttgctctagtcaatttactggtcttaattgcacgtttctttttaacatcattatatttcaggatgaaggtatgtttttctcttccttaactctgaatcgagcttgttgcagacaacgacatacactgatacatcctccgttttattaaagaaaaatccaactttgatataaatatagtctatatctatattcgtaatgagattttctttttaacaaacgaagtatacaatagaaggatagtagtatatgctatatatcagtactaccagtaagtttgatgctaacgtatggtggtagaatggagagtggaagactgaacgagtaaaccggctggaattaattacacacatgtttggaattctcacaaatgaaaaatctcttccctgcaatgaccacaaattttaacaatttaactctttaaaaaaaactatttttaaaaataaaccgttgctaaaacttactccctccatatatttttgatagtcatattttcaaatctgaaaaaattatttttgataggcatatttcaatccaacaacttatcctcttaatgactttctcggatttaatgtgtaactctatattcttccacacaagattggctgcatgggcatcgagaaatgtaaatattaataaatcgcttgtttatgaggaatgactagtaacatgtttaaatggatgataagtagaattaattatccttggtttgtatgaaaaatgaaatatgactatcaaaagtagatggagggagtatttcaaaaatgaccattttgttcagcgccaaatcgtgtagcgctgaacttagatacctcagcgccaaatagcgtggcgctgaatgtgcgttggtacgctgacttagccttccatccatccacggtggcacggcattcagcgtcagttgacgtgacgctgaagtgtctaagtttagcgccagatgatttggcgctgaacaaaagggtcaattttgaaataagttttggcgtcggtttatttgtaaaattagttttttcaaaaggtcaaattgtcaaaatttgtgtgcaatgacaatatgaagtcaacaagcagcgtccatgcatgatctgaacaagccgtacatgggctgattgggctgtagcagagggagggaacggcccgggcgtctggccttgacgaggcggttgccaattgtcaccgcattttggccttttactctgatagtagcatgcacgactctaaacatcttattattttatggtataatatactccatcggttcaaaaaagccaaatatagtactagatgtcccatccggattcgtagtactaggaaatgtcctatctggtcctaggttttaatatattgggatggagtgagtatgtctagattcgttgtattaggatatgtcacattcagtattaaattgaatttttacgtgacagagggagtatgtaggagtggtatttcttctcttgggcttcttatggcatgtaaaagcataggtccagattagttgtagatcccgtcgagggttataagggagacactaaggccttgttcggttacacaaggattcgttccaggccgggaatgataggtataacaagaaatttataatagatacaataagagaccgggatttatttcgggtcgggaaccagtttactcatattaggtacaacaaaacatccagattagttccacacctcttgactagtggattgatttccagtctcttattgtccctatcatgagtaaattggttcccggcccagaatgaatcccggtctctcgttgtatctatcataaatttcttactatacttatcattcccggtccggattaaatccttgtataaccgaacatggcctaaaggaatattttcgcggcactacacattgcaggcaacatgtctcttccaagcatatagcaaatcgactcttcccatgggagcgaacactccaaataaaataaatatcacattttacaaaaatggcagcaacagttggccaagagccaatacgggagagagaaacataaattctacatggttgtggtcccactatagtgttgaagtactctttacacactgcacgtaaactccatctgtctaaaatataagggttaaaattatctcattcatccaaaatcccttatatttttttggacggggagagtatctctcagcctttatttctatgtagacttggttagtaccgttggaggggtttagacaatgaggatgctctaagtttcatatagagttcgttgtcatctgattttatatggaagggtgcgttttattttttttgaaatagtagtgctcatatttctaagggtggttcattaagagaatcgcccatgaaattgtattttttacatgtattttttctaagagaatcgccggtaaaaattaccccatttttacatgtggtcattttcttaacaaaccacctcataaattcatgatttgcacatatggctctttaggaaaaccgcatacgaaattagatatattttcacatgcgattttccttaaggacccacccggaaaataggttttcgtggtttgttaccccaagacggcctcaaacgttttcatagatattattccttttggtctgtcagtgaaaaataataccaagagccacgaaaattattttgtaatagtgtaagatttgcatttcgacgaaatcatgtgcacataactcctctggaaaggaaggtgtttcttttatctagaaccaaaagaaggcccatgtaagtaaggtgttcttttttttctaaaaaaacacacattacaatgtatatttgatcaataaaaaagagcccatgtaaggatgtgagtggtatatacaaaagggcaagctaagcgtgaatttttgcttggacatgtaaggaactaaggaagtgaccgagtgagcatgagaaacgaagaaactaacctaaggctccatgtgtcaatgatttatgacaatccatttttaaaatgaattttgttgttatgcactagtatcatcatatttaaaggattaacatagcaaacatgacatatttgcaatgttacggttggaaaacatagactcttcaaaaaaattctaagtattttacgaaagcaaatacctaaattattcacagctacttttctcatcattgtaataaagaaatttcggccatacgctaccacgcaacatccccggtggcacgcttgcattgcatagcaatgcaatgcacgagagaccaaaaattggtgaacacgtcacccatccctaacggcctcgatctcaccgtccgatctcaaaatccaacggctccggatgcacccacgtcagaagttgtcgatgagcttggcgtacgacgtggtcaccctattcccttccacccgcctgttctcgatctccctcttgacgcacgccgccgccgtcttgccgtcgccggcggcggtggcgcaaatgttccggcgagggtcggcgatggggaccctccagtggccgtcggaaaagttggccgccctcgcctcggcggcgtcccaccggagcagcgccttctggcgctcgtcgagcaggcagaacccctggagcgccgccggcatggcgtcgtgcgcgcgccaccaccgcgcgtgcgcctcgtcgctgnnnnnnnnnnnnnnnnnnnnnnnnnnnnnnnnnnnnnnnnnnnnnnnnnnnnnnnnnnnnnngataaacaantntcaaaggcgcgg

SEQ ID NO: 21907 - DNA, 6567 bp, Oryza sativa
  unsure (1)..(6567): unsure at all n locations
agatgaatggacctgcggctttgcgcnnnacgnnnnnnnnnnnnnnnnnnnnnnncgcgtggtacaactcctcctcgtcgatccactccgggtacaggtgctcccacgtcacgttgctcccggcgcgctcgaggcgcgccaccgcggcggccgtctgtggcagcgccgtcctccattgctgcacctcgccgtcgtcgaagttgagcagcgccaccctcgcgccgccgccgtgttccgctccggcgaccagctgcatcgccttggagatctttggccagtccaccgtcacgtccgacacgtacctggtatcatccggctcgtagctcactctcggcactccagctgatgacctgcgcgtttcaagttcagacgaagcaaaggattaatcactgaccatcgtatcaacggcctcatcttttcgtttatgcttaaatttagagttgattttgggatttttttcccatcgtagtttatttttcaacctttgtttttagattattaagaacacgcatataaaaattttattcacaaattatttttcgtttgcaaatgtgttggttcgttatttcctcttatcagccaaacaatggggctgcaagacggattttatgacccttggcttaaaaaattggtacatttcactaccttctcaacgacattaaaatcattttttcaaagagtaattttataatatttgaggagatacaaagatgtgctacattttattgtgaaatatggtatctcctggtacaagacaccaaacggtactacattttatgttacataatttggtagctttgtggtaatgatcgtaacctttatcttttcaaaagaaatatttgttacaacttattgctttttaaaaaaatcttgcgaataaaaacatgaattttgtatggtttttttttcttactctgtgtggtgatcatcgttgtgatggatagatggcgagttgaggaggctgacgaaggagccacacatgaggatgatgaggacgagcttgacatagagcatcttggggtttgaaccctcagggagcagtgcactgaatggcctgtacttggcatccttctcgtagtggtagcttcctatgtatcccctcttgctcaggctgttgctgaaattaacacgggtaaataatcacaattagttcataatccggttgcgattttcttcagaatattgcataactatttagaccatatgtagaaaacgatagcatgtgcagttgagggcttcaaaagttctaacaaaggtcacaaatcatatggttgaactgaacaagattgccccttgtgaccaaatcattacctgtaactaaaattacttgtcagtctttactaaggtgttggttttttttaaaaaaaacttaggtgttaagttttctttggcttttaccaatatgtgatcagcaatcactatttctgcatttggtcattttctacttttcttcaaacgaccaatttcataacatctcctctattactttcagaccaagaccagaaagtcatatgtgtcatagctttctttctttcttcttgttttttttaaaggaatggctctctttcttcatctcctcttgtaagaagtcatcaagaacagtcagttccatgcttcaacggtccaggcttacatctacaactagtcatcgtctccatcatcgtgccaattccctcttcattatcgctttaatccctaatagctttgttccttattatttttctttttttctacctttgactctattcttacatgaacctatttgttttcaccattctgttaatttcagaacacagttttcttttcttccatccaaattggcaatttggcatgcagattgaagagagacttcttcagaactcgtgacgccattgtgactttttcttcttcagaagttgcaaacggagttggtgaaactgcaggttgctagctatatatgtaacttcctacgacgtgatttactataaattaatcttttattggactgttagctcacctaaaggtaggaattttgattagcagagctcgccaaactttggagaattgggctctcttggttcagagcacacgaaattaggaggattaattcaaattggtttgttgggcacatcacttctggtttctattggtggaaaaaaaaaactacttcagggagtaatttttctctgctaaagtcaccaggatgacgtacttttgtactgtgattggaaaaaactgcaattttgttggtagttaataactactctatgttataaaaatactcgcaaatattgacttcaaaacgaccattttgcattgctaacatacgtggtcatgtaaccttttccatgggctcaggaacatgaccacgaaaacacgctaagaaccgtatttaaacaggattaaaacttgatagcaggtaaacttaagatcatgcatagtatttatcaccaagcgtatcattgtcgatgatgaatatgcaacgatgtaaaacaagtttacatggacaagattaaatactggatagatgcatggatggaattcaaaatgttcggtgctcaaggaatcattggcgccgttatgcatgatgctcgggtgaagataacattaagttttcactgggaacctgagattctaaatatgtaaattttagccaggtttatctagattttagctgtgtttgctaaatatttagcaaaaatatgcagaggaagcaagtttgctataactactggagggaagaaaagactcacagagttctgtcaagacggtgcctcttctctgcatgatgagcacaagcaaaacctctcatccttttatgcaaaaaaaaaacactactccaaattgaatcctagtatgtaatcacccttcttcaggtggcccagctctctgaagaactttgctgataaacctccactttccgtaaactctgaagattgataaatcttcctatcttcctcctatatcaactctggtagctcgatatcgagtcgaaaatttgaactgtttttgagagatagaacagctgaacagcaagaagcaagggagacaacacacttgcagagagggtttatgtacaaagaaagatgagatgtttatcaaggaggttctcaggaggcaatggaatgcatggcttgacagcaaaagatgatgagagctccaaacctaggcaaagagagagagcaacttatagatttggcaggagagctgtgaccagaagaacaaccccttgtttgacaagttcctgcaggaactgttggagacctggtccttgtcactagtttttggaacagatcacattaatttattgttttttaagataaggaagctttattgaacttagccaatttacatcaaggtgatacaaccgtactaagaacactcttaacctctacataactaaaaaagaaaacacaggtattagggaaggatctagtatcaaataaatagaagggggtaaggcttcgaacctaggccggctagcccaccaccttgtggagctagccggaagacccctgagcgtttctcaacctctacataactaagatgcacgcaaccaatcacattaatttaattcacaggatattaatccttggcctgcaaaaaggtgagtgcatatgtagggagcaatcagtcccaaaaatcctactacaaacctaagacacagtcctgtctgaataagggttgttcagttgtttccatttgtcttcctttggtcgcatgcgtgttttcatttcatctcactcactctcttaacattccttttgcttcaggtgtgaccttacttatgttatatgcaaagacagagttggtgtgcaactctgacagagatgtacacaactgaagaacaagcagaactgtactacatactacttctactcaatcattctggatgataattcagtaatgtatgatcaacaagggacattttcttggtacaggtgaatggaagagtagacatgaacagaaaagaaaactaaaagaaacagaggttcttttcctgtacttccaatgtagattggctaccatatacacaagcaggagaagctctgacgttcaccaaacccaactgatcaactgggaagagtttggttggacctgaagcaaaaaaaatgtgcagtgcctttgcacccaagggatgactgaatctgaaattgctttaggtaaactgctaaaatgaagcttacaaagaaggttactacataagcgagtaagtgaatgtggtgaaaaggcagacacaacacagcacagcacacaaaacccaggccagaaaaaagaaaagaaaagaaaagagaggaggaatcttgatttgactacgattcaaccagtaggcctaatagtttgaaggttacctgcaaccaaagtgagccatccaatgttttaggtgaagcatgaagaatactattccatggaaatctctgaaacaccaactatccagagttattgctctattatgtggccgtgtacatcttcgatgcagagaccggattgaattccattatccaaaaaaaaaaaaaacactactataacagtatagccaccatcaattggcatatgttaattttttttaaggccaaagaaagacaatgttgtgtatgtgtatggtgagtatgaacatgaaaagattatattttgtgggcatgcatgatgttgattaacggaacaggtcttactttgcttccagatggaggtaggcaaaaaaaaaaaaagagttcaaaactcctttgcttcgctttgcttttgcttacctgagggtgcaggaaatcaagagatagctcaggtttttctgcatgcatctgttcccaactgctccctttcctttgacctgtcctcttctccttctctgacgcgcgtgctgctgcttactctgaaatctcttgcctgcagcgacacgtagaagtaaaaggaagggggtttcttgacgtgagaagtggtcagtttgtcaatttgtcaccacggatcagtggatggtcctaactaaccaagaacaagacgtcagaatctggccaagacagtgatatccatctaaccaagggaacacatgttgttatttcccagttccaaacacgctactggagaatcaattaagggcaaacacatgtggattttatatcacagcagctgagaacgtttggtaaccaaggagaattttggtgtcgaataattaagaacacagtgtgagcgtgttaagagctgaacacggggatcttggggttaaaatcgcacacatgcacctatcactatgccaatgaatacatttcacacatggaattttattggatttttcaagtaattcgttttcttcaaaatttctccaacaaaattcctccgttccaaaggaaaagtagaaccctgtttggtgaaacttcagcttatgttggattgttggctgcaatgtctttgtaagcttttcaggaggataaaaagctactccatccgtttctaaatatttgaccgttcgttttattcaaaaacttctgtgaaatatgtaaaactatatgtatacatataaatatgtttaacaatgaatcaaatgataggaaaagaattaataataacttaatttttttaaataaaacgaatgatcaaacatatttaaaaaagttaacggcgtcaaatatttagaaacggagggagtactagctctatcttcctgcctaagggtaactgatgttggtctattgtcgcctagattggaaatttagaataagctccatgtagaaaatgatctttagtctcattttgtactaataactgtaggggtcaacccgtaactgcttgccggatttttcctaagagaaaggacgtcgagaaactgaaaagattcaatggacgcgttctcatcgtcagcgttagctctgtgtgaaaacaataattgatgtcatcagctttaaattagtctatttgatcaaatggatttgctaaaaaggtgtcgctacattttgggactagtcagatcttaacggttcaaatgcccttgattgaacatcgtgtgcacgggccgggcgccttggcctctctctcctgtttttgcttttgtttttttactttatttgttaatctgcatagatagtataactactccctccgtattaaaaaaaaacccaatcttaggatactgatactactacacaattataattattttttagttccatatctcatataacaaagtaattaaagaattacacctattaaaatttgtagtaagtatggtgtaattacaatataactacttacaatttacaacgtaaaaagaaattaaaaaaatgtgatgctaaaaatatactccctccttcctgaaacgagttcatttttagcttatccagtttctcccaaaataagtttatttttaagtagttattaaattgaagtttgtgagagtagaaaataaatgcattgagagtagataaaataagaaataattgcattggaatttgaataattagggnatatctaatttatctaacatttatttctcattgcaaatggaagccttaatcaaacctattttgaaaccttcattttggggtggacctatatattaacctttttatttcatagtatatattcttaaattattattta

SEQ ID NO: 21908 - DNA, 2174 bp, Oryza sativa
  unsure (1)..(2174): unsure at all n locations
agtgccaggataagcagcatctatagcacnnnnnnnnnnnnnnnnnnnnnnnnnnnnnnnnnnnnnnnnnnnnnnnnnnnntgaaaacctccattttgtgtggtacctatatataaaccttttattttcatagttatttatacataaatatataatttatattaacaacaatgaaaatccatagtgtatgagtactcaaacttttataccatatcgaagatcatatatagatgaacaccatgttaccatgactactacatctaattttatttatctcatctacttatagactaagagacaacaacacataaatagttatctctaacatataaatccaaataactctaatactctcataattatattagagtttatatagatcttgtcccttcataatgggtgcattcttctctctctcctcacttctctctttcacttcatcaattggcatcttatggcaagtgattggaggtatatagtaatatgaccgatgatggcctttaaatggcacaaaaaaaacccatagctttggatgcaaaaggctccgttcggctaccttgcggctgggcgggctgcagcagaaaaccagcatgaacttttttttttgtcttttactgctacaacccagtcacagcgttgccgcagactggacccccgaacaaacccaaagttgttcttagtaagaaggtaggagaaaaaaatatttataaccaacactacaagtacgacgtatacgttagcgtcatcatctaatgtgtgttggcctaatatattactttgaaattaaacacaataaataattaattggataagaactagaacaccttgacctaggaggaaaagaaaagatcaaacaaaaagcctattatataaatagctttcaaaaaaacaaagaaactcacgcaatgctgaaggaagaagggaggagaagggcatatgcgtccaaaccggcttaaggctgtgttcgggcatgctggttcccaaccggtaatcatggaaaacggaacagtctattaatgcgtaattaattaagtattagctatttttttgaaatggattaatttaatttttttaaagtaactttcgtatagaagttttttttttttttgcaaaaaacacactattttgccgtttgaaaaacgtacacgcctggaggttgggaaaaatggtgccgaagaccgcctaaattctcttaacgagtagctaggctcacgtgtcagtcccacatggttggcgtgggctccctcttttttcaaaaaaaaataataataaaagggaatcatgggctagatgggcttggcacatgggccatttgtatagctcggcccatctcctgcaaccgggccgggcaaagctagctgagaaaggctcgggttgttgggccaggcctgtcagcctctcgtcggtccgaattaggagaaggaaaccctagctagaggaggatttgcccataaatagtcgaacccctcctgcgatgcctccgccgccgcgacgaatctctccccctctccctcctccgcttcgtggatccgaggatccctctcgttcttacgcttcctgcggtttgattcgatctcgcgtctcgtctggttttgggttcttggggggttttcgattcatcctgcttggctgtttttcttttcctttcaatttgtggatgttgtttttcttggatcgagattcgagatggcgatgatgaggaactagtcatgcaccactctgaactcgggagagatctctctcctgttcttgctgacaagcagacttactacccattatcaatctgagcctgttcatctcattcacctgaagaaacaaaattgctgccttttctgtttcttgttctcttgttcttggatgagcagggacgattgttttcctgttctcctgcattttctgttttgtgcattgtggataaaaataatgggaagaaccaaatgatgtgggtttgccatttggcgatccaaccatgatgcggactgaatatttccttgaggtcaaatctaattgccgctgatggttctttggcccacaaatcctccattctaaaacaggttctttttggtttcggttcagtccggtagctgcgtgaatgtctgaatttattcctttctggtgcattgtataaaacttgctaattccaccctgtgaattaatgcgaaccttaattgata

SEQ ID NO: 21909 - DNA, 8005 bp, Oryza sativa
  unsure (1)..(8005): unsure at all n locations
ggccttgcattgaagatcgtatagcnnnnnnnnnnnnnnnnnnnnnnnnnnnnnnnnnnnnnnnnnnnnnnnnnnnnnncctaaagcagattcgggggatacctcatacctggctactttgccaaatgattcctatcaacgtgaagaacctgcgtgtgaactaggacctctcctggatttaacatgtggactaggacctctcctggatttaattttactagtatttagaacttaggccatgtttagtatcccactattcttaacttttcatcacatcatatcacataaaaaaactttcctacacatgaattttcaactttttttttccaaactcccaatttttttcaaactttcaacttcttttaggaactaaacacatcctttaactgaattttagtatgaatttagcataatacctgaatgttaggacctgaatttgtagtatgagttcagtattttgcaggaattttagtaagaggctgggtgacaattctgacgaattggctgaatgaattgatcgaagcagccagggaaggcttgataagcctggatgacaaatgtctgaactgatttcctgcgcacacacccatttccgacgctttcaaacagaggcacattcctcaattcttgcaaactattcgacaaaacactccggttagacacgaaataaaatggtagaaagagtaatcttggagacgttcatgccaaataataggaattggaaaggataatttacatagaaatattcgaagtcgtaccgagtgtagcacaaaatccattcattgctggcctttctattagggctgatcacctgataaaatttttcaccctcacgtcgaatgtttggacacatgtatggaatattaaatataagttttaaaaaataattaattgtatagattgtgactaatttgcaagacgaattttttaagtctaattgctctatgatttgacaatgtgatgctatattaaatatttgctaatgacggattaattatgtttaataacttcatctaatagtttacaggcggaatatgtaatttgttttgtgattagtttacgtttaatatttcaaatatgtgtcagtatatacgatgtaacacgccaaaattttacacctatgaatctaaacacccccttagtgtgcgtgaagattctgacgccaaagttgttcggcgaccccatcaattgtggtacttaatattgtggttaatattgtggtttatacgaagttctcggtttcaaagcagtaagaaaattttgttcccacataatggttctggtattaacatacaaccattttctcctatgtatttagttctagaaatgtttactactaaagtatttttttgtcttctattggaagtaatccttttcatcttttttatataaatagaccacgtttaaaaaatacaaaaatatataaggataataccccacttaattatagagcgaagccatttacttccgccttgcaaataagtggcaaaaaacctatttcgcttgttagtggaagcttggagctatcaaaaaccctaatgagtgaacgttcagtcacatgtgctcggagtgccaattggttgtcctctctttttgacgcacctaaacacctttcctggtatttatttatgcatggaatagatggatgttcgagttcaatccagaggttttcaatctataaactttacataaacttccaatgtataaatgtaatacattgaggaacttttgatttataaactttttttgtacatatgaactttcagtctataagctttatacataaaaagaacttgtcaatatagaaagttgtgcacatgaaatttcaaatgaactaaaaaacgccaaaactttctattcaaaatcattaactttcaacaatctttggaattgtttgctcaaaaatagatttttttttccaaccggatatgtgaacctttctatttcaaatcataaacttctaaccaccactcactagtggcccgacacataattaggggaggaagaaaaatgagattttggccacgcgttgccttgtcagggaggatgaagaaggcccctcatgcacattggagttgtcgccaccagcctaatcatcgcctcactcgtgacctcaaccaagcccaccttgcctcaccattgtacgtaccatctactcctgggaaaataggaacagagtaggagtggagagctcgttggaggaggaaaatagataagggcgtggtttttacttgtggcattaagcaaaggcactataagggtagtggtgctgtgatgccatgggagcgaggggaacatgtgggagaggggataaggtattcgttttgtttgtatgcatgtgaaccatatatgccttcccatatagtcatgtttcaattgagataagtaagagcataaataatggcataagaatgagaataggtgccacatatgattttcatagataaatagaggtgagaggagaattgagattttttctttctaaaaactgttcaataaacctaatagaggaagatgcattgagaaacacacaatatgttctcatcatgtctctccgcttaaccgctcctacgactccatccaatccacattgttattgtcgctgtagctttggcgattcctcaactgtctgctacaacgatgcaccacctaccatcctcttctccaatcgtgccattggcgctagtcgctattcccatgccaccacccacgtcgggagcgctagtcgccgttcacattctcggagacaagagtcacctcgtgtgaggccccgatccggtgacgagtcctgcgggggctagggccggtgcgagattgttctttgtgctggactagggccgagcgagcccgtagaaaagcggggccagggccagggccgcacccggcccgccccattgccaaccctatcacgtggcagcctgccagccttaacacgtagcggtgccatctgccaccgcttttcacctttttctcgcctacaaacaaactcgcaagaggaaaaaaagaccattcgcgtcgcgtgcgtattctttgcttccgctctcgatagatcgcgaggaaaggagtagtacggcggcggcggcggcatcgtcggcggcgatgaggtcggccatgacccgcctgatccgttcctcgtcccccgtagtctcgccctcccgtctcaggtgagcccctccccgcgcgcgcccgccgtcgaaacatcccccaagtttttgggaagagataaacaataaacccttaaattcagatgagatgagatgagatggcgtgcaaaggtgcgcgtgcttcgttaggatggggaattaggagccgcatttacctcctcgttggcttatccaccacaatagggggattttgttatgattattgtggattttattatgatgctaaattagtggtgttctgttctaccttgtgtgaccgatgatgccaacagcgccgcaaacttgttaaagaacaataatgggaaggctttcttgagcgaggatgcttccaagcgtgtggaggagcctttcaaggtggaggaagcagaaaccgtgaaggtgccaccgccttccccggacaaggtaattataattaatgtgattattactagtttgcgtaaaatgcactagtttaagactttttcttgtgtttagcttgtttggcagtcattcttggtagcagtcgttttatccttttcttacccatatattataaggtgcattgttccctttcttttttttttttctgaatgagcaatctatcatagtgggctagtgacctagtgtattcattttaaactatcagcgggatgaattttggtttatgcggttgtatctgatgtagattattgtcatagaatggacatgttggctgttggggagatatccagtgcagccatcagttacgtaactgaaaagttgcaaaatgaattcgataatctcgatgtagtccttcgaactgaaaatgcattagaggaaacataaacgtgctagtttgattcgaatgctaacatattcccttttctttcatctcgcctttcttttgtgctgttttatcggaactatttcattgtcattgctctcaatgttgaaacagttagacttgaaatgttatctacataagccctgtaagttcactacaccgacaatgttattttaccagatcttcagattgatttgatatggaaacctcttttttccctttgtgcagcatattgtgtttttgcattaagcatttcccaaaatatttccctgaatatgtcacggatacatcctgctttatgatatttaaatctctatagtgtgcttatcttcaagggaaagcaattcttcatttccaacagaaaggtcatatataactaaaatattcatgtagacaagtgcttagcctatttccaatgttttcttatcttcattatcctgagcaatatattacagaccgataaaaatattataacaagtattctgttttgaatggtgttcctgcaggtttaacagcaattaatatatttttggaaatgtattgtttaatattaacagctaactacgtgttattcgagcttttagataaattatgtacatttttctatggagttattctttatgctttccatttggtgaagattactgaattgctactgacatatatgtcgacatagcttcttgtgctaggtggaaatggttttgttggttcacatgtttgcaaggaggctttggacaaaggatttactgttgctagtcttaataggtatttctgtaagctgtatctgttgacatgttcattctcattttgttgtcagactgtttgattttgagatatatttttttatttttttttgtaactagccaaaatcataaataaactattgctacagaggctgtatgtctattgaaacttaaacacgtttttgccctgatatctgatatggaagagcaatggatactctgaatcctctaatctaactgtagataactttatatggttctcttaagtttgtgttgatgcctttagctttagaaaaaattcatgggagactctcattctccttttgttcctctattgtggtcactgaacagaactgtgtgaagctgtttctactcatattagatttcgattctagaagtttgttaacaatgtaaaaatataatcagagttagtttgatcttttctttttcatcttattcttctgtgagtgttttcaagggggtgtcaatggtgtattctgagagcaatactcatgtaatttatgaatgtacttattgctgttcagtagctgtagtcttgcattgaatttcctaaatttttattatttttagataattgaagctttattgaattcataatttccttattgacacatctgatgtattatcagacaaacaaatatcagactttatatacttcaaaatcatcaatctttattttcaatcaatgacttaccattctcttgatttttgactttaacagatctggaaagccatcaataagtgaatcttgggctgacaaagttatatggaacaaaggttatttgctagtgagataaatttattgtgcttataaatgattatgttgcttaatgtctcttttattgggcaggcaatctacttgaacctgattccctgaaggatattatggaaggtgtttctgctgtggtatgtttacacttttattttcgaatttgttaacttggtgcacatttttgtactgaaaactgcattcttgcatttatgctttcctcttttttttttttttttacccttgtactttcctggatctttggcaagtctcttgaaagttgaaacagactcacttgtctggtctttacatgatgccgaaacaactgcaggatattgtactaagttaatatatgattctgaaatgatatattgggcacctcaagcatcaaatactaacttattgctaccttctttgttcaaatccttattagtgattgggttggggttagggtttttgttattttgtatgcgcattattatgactgttttctgctgttattgtcatggaaatctaattaaaggtaccattcattagactactagacttgaaactaccaagaggtatctgatgcctttactccatacatgtcggcaccaatgagtatctggtggatctgtacagtcttgtaggttaatatcttttagtttctaaaatccatccttctcaattaatatcatttagtttccaagctccatccgttgcactcccttggctcaaattgctcataactcttggttgatctaggtggaaatggttttttacaggccatctttttaaattgttatcacttaggttttcaaatccatccctgccacttcccttgcctgcagataattttggattattgggtcatactatctaggttctatgagcactggattaattagtatgatggaaatatttccacttcgtgttaaaccttttatcatcatccctggaacaccgttgataccttttaaatttattatgcaccgatactctaataaggtataacatataagtagtaactgctttatgctaacatgaatttatgaatcttgaaacattactcatatgagagaaattgctataggtatcatgtgttggaggctttggctcaaattcttacatgtacaaaattaatggaactgcaaacatcaatgccatcagtgttgcagctgagaaaggtatttatgtttgagaacatattgttgcagcaccatattcattttctatgttatgtttgcagtttctgtcaattcatcaatatgctctttttcacatgtattgatatgattctccccactagtttgtaatctcctttagtcagtatagtgtgtagttcttatgatcagatcaattaaagcaaaagggtaaatgtcagaatactaactcttgtgtcataatttccaaaaaaataaataaatacaatttcttactagtacttcacaaagttatctctggaagaataattatctagaaacatgcactttacttccttgcatattgggcttgtctgtcgtacacaaaaagtggagaggtaccattcagccatgtactgtagcttggactgcttggacagtgacgatgcatgacatctagtcactagagttgcatatactgcccggtgcttgcttaggccgaaggcaggaatcactccaaatctttcatttttgatcaattatttcatatgatatggcaaagtaaaattaagtctatgctgatgcacattatttttggttgggacttaactgcttccacatcatgctctacctgcaggtattaagagatttgtgtatgtgtcagcagcggactttggttttgtgaactacttgttgcaaggttattatgagggcaaggtaagtttttccatgttatgagggcaaggtcatagttccatagtgttgcttgtttttctgaccctataagtaatcgttattgatataaatttgattggtttcatttatcctttgaagagggcaactgaagctgaactgctatcaaaatttacctatggcggtgagttctctttcacatgtaacctttttattttcatgccaatgtgttcttgcccttcttttattgtaagaaattatttctataccttttgaaatcatttttctaaaataaagttacgggggtatccttttctaaatgaaccttcttcctacaccacacaaggtggcatggcaatcgtgtgctgccatgctccacatcattgcgagtggcgtggccaaatctttgcaacaccatgatctcttcccaacatgacagtattgccctgtagcaccagctataacggaatngcaaatagccaaatacattcagatttggaaatgggagggtgtagaggtttatcttgaactttaggttttcaaaattcgtgatcaggaacccaggatcggattngatataacacccacatataccattgaagtaagcagcaatttggctgtcccttacaaagaaataaccaggtcagaggtttcggcgaatggcccctggtcaagccggggcctgtgtt

SEQ ID NO: 21910 - DNA, 1768 bp, Oryza sativa
  unsure (1)..(1768): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtttgcgcttatttcttacattcgtagacggggaagacatactattgcacgcaacattctctccattgcatacaacattctcattctcatgtttaggcaacatataaagctggccttgttatatggcaagacccacacacttattcttgaatataattgaacataattgttgatcgaaaaagcaattatatccatcatccgctaaacatgaaacataaaccaaatttctactcaaaaagggtacatagagaacattgtgcaaatgaagtgtgaagctattattcaattctaatggatgttctccaattgcttcaacttcagcctcgactccatttgccactctaatgcatctttctcctcttgttagcatcctcctcatatggaatcgctgtaatgaatttgcaacatgaatgatcgcacctgaatcaacccaccaagtggattttaaataacttatgtacagtgattcatcttcaaatgtaataatgtcctcacctttctttatgagatgctttaggaaatcagggcaatctttctaatagtgccccttcttcttgcaccacttgcaagtgtccttgtccacttctacattgcttggtcgtggatgtggatcactttgtggtgcctttccttgtgccttaggagaggcaacattctggttgtagttgttcctcttcttgttgtgcttcacatagttggcggaatcaccacgagccttgggtctatcctcttcttgcacacatatggcaatgagcttctcaatgtcccagttttctggctgtgagttgtagttgacaacaaaagcctcaaaatctgaaggcaaggaggcaaaaataaggtgaactagaaacttatcagggagtaccaagtccatcttcttgagctttgaagtgatatcactcatcttcaaaatgtgctctctaacccctctgccagtgtacttcatggttactaagctcttaatgagggtgctggcataggcctttgaagaaccagtaaattgattctccactctctgaaggtactcagtgggtggtacaagctgagattgctccccttattgcctccacaatggagctcttaatcaccatcaagcacttgcggtttgatgactcccacttcgcacgacttcaatcttattgccgcatggtctagcatcctctgtttgaagtcaccttcactctcaccttctgccctcactggagtaacaagctcagtggggcgaggctcggtgagagctatgtcagcgcaagtgctatctctatcttctctcggcatgagccatagttgttcccgttaaggggctcagcggccgagatgtaagctagtgggttagtagttcctgaaagcaaattaaannnnnnnnnnnnnnnnnnnnnnnnnnnnnnnnnnnnnnnnnnnnnnnnnnnnnngctatagtgtatatcgaannttcaagttcgtc

SEQ ID NO: 21911 - DNA, 723 bp, Oryza sativa
  unsure (1)..(723): unsure at all n locations
gacgcgcnttgaagacaatttgcaagnccccnnnnnnnnnnnnnnnnnnnnnnnnnnnnnnnnnnnnnnnnnnnnntgtcagacccggatgcattgcagacttccatcttgttgcatcgaactaaaacagttcaattcctgtgaaaaattgaaacactgcatcaggttgtaacagacatcatgaataaaccggcaattgatgtccgcgaaccatacatgagtttgcatatatatgatataattgcatagcataggctgccttaccatccatgaaccatccaccatcagaggtgatgtacgccttcgagatggcgagatcgagatcgctcagaacttgcaccacctccaacaggatgccattcttgttcatgctgtcgacctacctccaaacgcaaacagacggtgctcgaagcaatcagtgaaacggttcttgaatattggaagcagtgttcagtaagattatccagtcaagttttgagagagagtagtaagtagttcttaccttcactaaggtgcagtcgctgcaggtgctgttgtcaatgcataccctgcagaaaattatcagcttgttagctacagaaagtagcggagctttcgacaatagcctggaatgaaacaggataatgatatgaggagctctggaatttagatgtttaaattagagatccacctaaggagggttgatgcgctgactgaagttctaatactcgggtcaaaagaagg

SEQ ID NO: 21912 - DNA, 748 bp, Oryza sativa
  unsure (1)..(748): unsure at all n locations
gtgttattgatattcttactcggtacccatttatgatgaatcattgatcttaaaatgctctattctaaggtgagtcatagcgtacatctgaaaaagagtgtggccatggtatgcaaatcaacgtgtgtttgattattattctatgataaacaattggcatatgagattattggtttagatatttggagattattggcgatgtggttttagagatgattggattttacaagtgatgaacagggactgctggttatttggaccggtcagaccgggcaggtgctgccggtcaatccggagctatgtgagcggtcagactggctagcccacggtctgaccggccgactctgtgtcggtttaggtttcgggttgatttgttcgatacccgtggataattcgtgtttatgacttcgagatgaatactatgcgtatgtaatactgttgtttgctaacaatgagacaagttagtgagaacttatgctcggatatggtttcttggttgatgcttgtgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21913 - DNA, 2810 bp, Oryza sativa
  unsure (1)..(2810): unsure at all n locations
cgcgtggattgatatacactcgtaccccttcgtagacacctgcgaaaagtttcgaccaagcgccggtcttttcatcacctcggtacgtgttcaatatgttgcgcatatttgatatgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattgttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggataaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcattgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacacctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgacttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaaagtggtgttcaagaaagagctn

SEQ ID NO: 21914 - DNA, 7073 bp, Oryza sativa
  unsure (1)..(7073): unsure at all n locations
cgcgatgtataatcgnnnnnnnnnnnnnnnnnnnnnnnnnnnnnnnnnnnnnnnnnnnnccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaagaagttctgtaaaactcttgtccgaccagccattacaagccttaagcttcatgagttccaacacgcatgacaacttgctgtgcttcgacttgcatccatcatacaacggcatctggcaatcttccaccaacttactaaacttctcaaaatctctgtcgttgtcctctgcgtcttcaatgtcatgcaacattgtagatagacattgagtgtccaaatctatggtctctccacctaaaggagaaggtacgaacatgccttctcgagctgcggcggttttctctacatcctgatccaacacttcttcagctgcaatatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacaatgcgcatagtacatccatctacgatccatctgaaatcaacaacatacgaagaaaaataaatgataatcgatatgttgagaatgaatggagaataatgtgttttttaccttgaattttagcaaaaaatcgccccccttgccctcccaaccgatttgtgaacagtaaaatggtcgggatggaaagcagttggcagtttgaggggtatttatagacccaacacacctcaaacgggttagataaaaaaagcccgtcaaaggtattggtcatacctttgacgggcttctattcagtggcccgtcactggtatcccctcacctgtgacgggccagaaatgaaagccgtcacaggtggcggcccatcacctttgacggcttctaatgtatcggcccgtcacaggtgaggggataccagtgatgggttggaagcaaaactcgtcactggtatacctttgacgggttttcctttcggcccgtcacaggtgaggggatacctgtgacggtccgcggccggatggctcaccggtgacgttatcccgtctgacccgtcagaggtaatggtcactagtgaccaaatcgtttgcccgtcacaggtatcccgtcagaggtgtgacgatctggcgtagtgccaatagtatctgcttctttaggggaggaggagtaatgggtggcctttttaatgtcgccttttagtagccacagaaaaacccccggtgaaaatcaaattttcattggcagatgtttaagtgcgccgccagcgaaaaggtgtacatcttcgctagcggccctcttaaccttgctgccagcgaatatccattttcactggcagtccatagccccccaccccttagagtattttcgctggcggtgatcatgtatagccaccagagaaaaaaaataggttgacggcatgaaaaatcgtaagcccgttctaggattctgaaaaggctatcaattagaaagagaatcatatagaccatcaaatttatgtataacttgtgtaacctatggcttagattggatttataatgagacaatgcatgaaccacttatgaaaatcttattgaaatccgttataaacacggctgtatggatgatctaaggtggctgagcctacattaggaaatctcatacaatgtatatataagttttattgtgaatgttgagtgccatttcctttaatattatgtgctttaacttaggattctagaaaaatacacaggctatgtttgggaggtgaatttggaacttaccggaaagaacacagctatagtagagtgtaaaatttcaatttttgctcagatgaatgatccgagaccatggatgactagagctcatcaaataatgtgaaatatactatatgcacatttgttgtaatcagagtatctagagtttgggtgaaattacggcacaattgaattaattagttcggatcatccgatttccattattaagagccataattcttttgcaacaaaaagaagagagagaaatacagagatgctggagggctcttgcatgttttattaggatgaacaatggtcacccggttggctgctcatgtttctgcacatgcccatgtgcctgagccgtcgataccaccggtcgcagacatgcgctgcatgtcacatcaggaaattaccatggatgtatctatcaggacgcatggcagttggtctcgccatggctgggtctcactaactagttttgccagctcccaaccatgttggtgctcatggtcgtgaacgggcaatatggatgcccgatgcctccgaagcctagccacatcaattacttgttcgtgagatccatggctgaaaacaatgcaggcgagctgcttatccgcttccccaggagtacaacgcatggctgaaaataatcgacctcgacagatctacgcacgggttcatcgaccacgtctccttcgcttcgactacatcgactatggcacaaagggctatcatccgtattgagcattctcgatggttcattggtggagaaaccatttatactctcggttggtaaccccttttagtcccggttttccaatagggactagcaatccgggactaaatatacacttctttagtcccggttagtgttaccaaccgcgactaaagagaaggtatctttagtcccggtcttttttttcattgtttcttttgccatagtttaatccctgtattttctcccaaatcgagtgggatgcatatccccaaatcccaaatcaaagtaacatcccataacattcacatcacagatcttaagttacttatacacacaaatcaaatacatcacaaatcttaaaaaaattacacacaaatcaaacacatcacatattatacattttagatccatgcaacgaatcacaaaattatacatctaagtgaatcacaaattgaaaaaaaaagagaaaggatgctggcagtggctgccccctgccgccgctcgccactcgccacaggcgcggccccgctggctgcctgctgcgtgtggtcccgccggccttcggatgggaagggtggaggggggagagggccggggatgggaggaggaaggggaggagaggggagaaggaaagggggaggggaggagaggaggaagggatcgatctgaggagatgagaggctagttgtggaggagaggataactgcgaagaggccggttgtggaggagaggataagggagagggattatatactacgcgttgaattttagtccaaccgggactaatctttagtcccggtttgtgacaccaaccgggactaaagatcctcagccccctgacagactactgacaggggataaacttggactaaagatgatctttagtccccattgttgttaccaaccgggactaaagatcgtagaatggctgtggggttttaaaccgggactaaagatcatctttagtcatggttcatcccctgtcagtagcctgtgagggggctgaggatctttagttgtcacgccctaaaaatcgactaaattaaaaatgcatattttaaatcatttttagaaattgttttaaaagcctacaagctaaaccctaattttctaggaaaatttccaacataaaaatgagctagataaaattttattaaatactatgcttgctcctctattttctagagttttctgggaattatttgagcaagggaagtatttttaataattgaaacaacatttcacaaattgttttattcaaaaaagttcaaaaatccccctcctaggccgttgggccgatttcggcctaactctctctttctctctctccccgcgcgcggcccatgccggcccaagccgccgccgcccgcgcccctctctctcgggacactgacatgtggggcccacatgtcaggcccttcttcaacctccggccgccgccgagaccgagcccgagccgccgtcttccacctccgattccgcccaaatccgagcccgattcctccgggtttttgaggggttttgttcctctcgttctcctctttcttttcccccaagaatcaaagcgaatcgttgagtattctctccgaatcgagttcgttttgattttatccctaaaaccgagtttgaattcttcccgaatcgattcctctcgtttggagctcgatctcttcaatccaatgccatatatagcttcctctcgttgtcctcttccgtttgccccctctcccgagctctcccgtgcctcctagcgccgccgcgacgtgttccaagtccgccgccgccgccgcccgtcttcggcgtcgtcgccgcgccgtctccgccgtcgccgtcgcttgccgtcatcgccaagaggtgcgccgtggtgagaggaagctcgtgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacaggcgcttgacagcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattatactataaagggttagggttgcagtaaacagcatttaaagacatttagttgctccaaagctattttgtaaacacgattctagaactatacaatgttattaatcacggccgtgaacccacacggacctgccttaacccaaggcctacgatgattcagaccgaactggcaacccgaccctgggtcccagctcgtcccaagccaacccaggccaaccattccacattttagttgataagcaggttttaagacttagaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgaaccgcagcccgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggcagaggtgctactgtcaaaaccatgcacccctagcccagcccaaaaccattttagggattttgaatagaaggagcggtgtgaagccggttccacgataaccagaccattccaaagtatccaggtgacttgaatatttcccaaagtctaaagttgtaaaaccacctaatgttacctaattaacttgcgaagcatctacctaaaattaaactagtggtgccatgagtagagtgtccactagttggggttttgtttattctagggtgaacaaggtaatattaacaataacaataataaggtcataacaaaggaaaataggcatggctaaataaaacagtgataacgcgggaatttaaataaagtgataatgcaataatttaaatcaacataattttacaaactgggattcaatatgttcaaagatgatgtgacttgccttgctcgctttcccaaacatcggcttcaacttccacgaagagcggatcttccgaagctgtagcgtctacacgaccaacggaaaagaaaaggctattaccctaataaactccatataacagcagaaataaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaattggatttattgcgtcagccgggagagagggcgcgcggaccgggtccacgggagtggggcccacgcggcagcctcacggcccacggtggaccgggcgcacgcggctggcgtcggccggcgccgtgggtcccacgcgttagccgcacccacgggcgcgggcggctgacggccgggcccacctggcagccgcgggcgcgcccgaaggcggcctcgccggcacggccgatgggaggcggcgcacccgcgccccgatggtcgccgccggagaccaacggcgcggcggagcggcacccgagagagaggagggaagagggaaagcgaacggcggtccatggctcaccccgggacgacgagggcggcggaaatggcgaccggagcggaggacgacggcggcgcgggctcgggtcgacgaggacggcggcgttccggcggtcggcgagcgaagcggaggggcggacggggtcggcgaggacgcggcgaagccgaagggggtgacgccgaaacgggaggaggtccggagcgacgacggcgactgaccggagctcggcggcgatggcggagagagaggacgacggcgcgggctcgattccgacggggagagtgagcggcgagcggcggaaacggaggagcggagctcgggaagcgattaaatagcgccgggag

SEQ ID NO: 21915 - DNA, 19831 bp, Oryza sativa
  unsure (1)..(19831): unsure at all n locations
gaggaaaaagaatggaaaaaacgggaaaaaaaggagggaatcacggggagtcattccccctttttatgccgcccagcacggcagaattcgcggatttgacgccggcgccggtgtaaggcacggggccgacgatagcccagctcgagaaagggaatacggttgggccccaccggtcagcgagggtgcaggcggggcccgcctgtcaccggcgcgcgcgcggggaagaagtcctatgggcctcggggaacagaacaaagaggcagaggggaaagtgggcgagccggcccaagaaggaaaggggggaaaagaagacttttagggtttttctttttataaaaccttttaaactttgttaatttcttcccaattataatttgtgctctgaaaattccactaaaattttattaacacattttaggcttttaggaaataaacaaaaatcttccaagccttatttgacttttaaatttgcacattttaattgttggaggctttcacatgggttttaattattctcggcacaattttaagaatatattttagagtcgttttggaacgcgacagctcggccgccccttcttttccgccgccgaccaccggagctcgttcgccgccgtcgacccgagccgccgcgccgcttcttctcgtcgccggccgccgtcgtgcgttgttggtcgtcgtggtgagtaccaacgggttcgcctcgttgtcctctacgcgtaggtgtcctccaatcgtccggccgaccgctctagcgccggcgagctcgcggacccgagccggccgccgttgctgacgtcatgccgacgttatctccagggctgacgtcatctcctctagggctgacgtcatcgtttccttttctttttcttttttccgattttctaatagattaaaacttcggaaaatcataactaaataaccgtagatccgttttaggtggttcaagtttctaaatttttctaaaatcaagatctacatgttaaaaatatcctcatgtactgtttatgcttgtttttgtactgttttgttgattttgtttatttgcttttgtttccgacgttccggaggagagcgtttccgttgaggaaggttccgaagcgtttgtggaagcccaaggcaagtcacacagatcccaaacaaccctttgagcatgttgatcccgtttaaagctattgttttatttcaactatgcattgttttcgaatgtcatcgggtggtgaacctttcccagttatttattggccgaagatgactttattttcctatgggctataatttgattagcatgaaccttatatattggattggttcagctaaatgctatatataggtttgcttagccatgcatagaaacattagctaactaaaaggggttaaatataaattatattacataattattattgttaataatggttatatttaatggtagctcacgatggtcaatcgtgtgatgttaactaattgataattaaaatctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtaattcattatagtgcgccagactgagaagtggcgagaagtccatgggggtcgctggggagtccatgccttgttttaaagggggtgattatgatccaggaaaggtgcgctgtaatgggttatgttgtacaaggggtattgtcacaactcctttccgagataccgtggtggtattgaggcacatggtgacatgatgtggggttgtgtcttgtgggtacagtggtacacctctgatcagagtttaaactattcgaatagccgtacccgcggttatgggtgagttgagcaatgttcttcgtgattagtctcacactactcattaatggtaataatgtgtaattaatttaattcctggtttggaatggttaattcctggtttggagggttaatttgttcaactggggttggttgttcaaatatggttgggcctatgcaacacgggtgtgttgtatggtgtttatttaatattgactaattattcaactgttttactattctcttaaatatttattaaatgctgttttctgcaaatgagctatattatgccatcctttgttatcttgtgcacttgcatatttgctgtgtggcttgttgagtatatcatatgctcattcttgcaatattcattcatcagaagaggagtatctcagtgaaggtgatgatctggaggattaggcttgttctggttaagttgcttgtggagtggagtcgccatagctgttccgtagtttgttatagttttattttccgctgcgtagaatgttatttttctttgagaggaactatctacctctgtaataattttaatttgcaaatattcaatagttatttatttgtactctattattaatttgtcattgtgtgcctcggttgattcctggacgagggtttatcacacatgtaagcgtttggaattttggatagaaattccgggcgtgacaatagtcccggttggtgtcataaaccgggactctaaaattcaacgcgtattatataatccctctcccttattctctcctccacaaccggcctcttcgcagttatgctctcctccacaaccggcctcttatcctctcctccacaaccagcctctcatctcctcatatcgatcccttcctcctttcctcccctccccctctccttctttttggaaatgggactattgtggttttgggtcgacccaacaaagatcagctttctagtagtggttccttctctagtccaagagtccgcgctgctcatgcttgtactgcgggggatgttagagtatatggataagatcgtattgtatccggtttgccatggtaggataggattagtttctatctctatctcttaaagttatttaagacctaatctatgtaataacctatatataccggtcctttgaggctcaatacaataattcacgttacccagtatatctcttttcttatacaatccaacagaaaaacaggcaggtagtgatcttgaacctgcctgtaggagaatgagagtagcatagagagtcacaccaagtgtagtagtgggctccttatatgtgctataaattctcttatactttaggccagagatagtacgagttccagaacatcctggtggttgtatccaagaaaatatgtgtcccatacatactcgcacatcacctttgtcgctgtatatgatgccgtgatgggctttaagctagcagtctatgtgtaccgtggaggatgagtaaccaaacacagctgtccttaggctatcaagtcatgtaagtataggggactatgctattagacattggtactcttaaataggggtgaaaacggtacggaaatttccgagaattccggctaccgtttccggtttgcaccgaccgtttcaatcggtatcggtaattgtcggtatcggaaatggaaacggtaatctctttcggaaatggtagcggaaatgatatggggttttttccgaccgttttgtcggtaaccgttttttatcggtaatttccatcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaagtcgccgacgccggccgcaacctccttcgccccgacggcctccgtcgcagccggccaccttccctcccccatgctccaccgccggcttccgtgccaccgagccaagcgccgagcgccgncgcacccgcccagccttcttcttcccaccgatgccgcccctttctcctctctccttcccccaccgccgcctgcgccaggccgncatctccggcgcctctctcctctcgggcgcgcgtgaaggagccaaaggcagagaagagaacgagagagaaaacaaagaagaaatcgagagagcaggaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttctcatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcagacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgttgttttcgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctactcttaaattggttctgactggaaaccggtagttttaaccagctcccgactggcaccaataaaaggtttctgcagtagtgaatgtggcatgcgagaattgaaacagttcgataaaaacagcaataacacattatgcggtctaatttaaattgtgtatggtgtcatctaatttaaaacatctattgggtaattaaggaaattgctcagtgacatgaaaaatgactgaattggaatccctatggctggtgcactgaatggaatgttggccggaaacattattgttcttaggttaggtgtataaattcgagcaatgtgggaagctggaagctagagcgcttagatggagctaaaaacacaaggtacactgcaagaaagatccattgattgtagggtttttttttggggggggggtgctgggaatctagttaattgcaactgctagtgtgctacaactttagctagcttaggcaagagatttgcattgcaagtaggatgcaactagggatgaaaatggtacgaaaacggacgaaaatccaactatcaagtttgaattgagtatattgggttgggctgaattgagtgacttaggaattaggatactgaattaggttgggctggggaggaattatagactatggtatgggcctttataattccagaaattccgagaaatttttcggaaagtttccgaccgaatccgagttccgacggaaactgcccttatcatattcgatttcgtttctgagaaaatatttccgaattcgtttcaatttccgaaaaaatccaaaataattctgaccgacaaattccgttttcgaaaataagcccgctgtaccattttcatccctagatgcaacatagccgtgaacttatttgcacaagtatcaaaaaatccacttgttctcccgaatcagtagatcgctgctcacccagatcccgtgtgttgatgggtgatcaatgcacatccgaagtcttgcttctgacggtctcaaattgattggagcaatggagttaagcagtgaccctccatgacctcggaactgattgtgatgttttcttttgtttagtacacttgtgaagctaatagtcatttgccgaccatgcgcaccacgcttaaccagaaaacaaacaaattagccatacaaatttcactttacattcctctccagatcagtttctcttaatctgtaaattggtcatggtgagttctagctagttattgtcttattgagggtcttctctgaccttatgtggaagttacatgttgttccacagttgctagctagtgttaattagctgttcctctaccttaatatgcgtggtgcctcattaacacaaccaattgggtaatgagaaatagctagagaagtagagattggatagcaacagccaacagattggtctccagcagaatgaacacaaccgattcactactaaattataatatgtttcagtaataagagcttgccaagttcacaactacaagagaaacttttcaagctagctgttatatacttgtattaaactgcacccacttggcaacttcttgtatccaaggtgcaatttactcaaatgagaactacacatataatgacattaaatggaatcccatgagttaggttcactaaatgaaaggtttggatagagagacattattgcttttagatgtataaattcgagaaatacaggaagctagaatgcacacaaatggagctgactacaaaaaaggtgcttacatagcaacatgaacatttggtttcttcaacagttgcaagaaagacctactaattgtagtattctccttcttaattgtaggcagaactcctgccatctgggtttataaagagaaccatggacagaaaatggtatagcgtgtgcagacgtgcagtgatataaaggcactacatttctagtgtcatctgtgtgaaatgtcatggtgtaataaacgactagttcgattgaagacgtatataactatatatatggcataatgaacaaaatcgagtcccatgagagcatagtgtactatatgatagggtgggctgaaaacaccattgttctgctaattttaggcttgaaggtgactgggaatctagttaattgcaactgctgcaacataagctacatcagtcaacagattagcattgcaagtaggatgcaactacattgtgaccctttctttgcagaaatagatgataaggcacgtcgatatcaggctttgccgtttgggtagatcgctgctcaccaagattccatttggctgctcattaattatctgaaattttggttggcgtaggctcagagagatctaagtgggagctggttgtgatgttcagtattgtctacacttacgaaggtattgctcaccatgtccacaaggcttcagctacgggactagagaaagaaacaaactagccctacaagtgaactttacactcctctctagtcaagtttcactgtcgtgtgattcgaacatatgctgataggtatacttctctaatacttcgagaaataacatattgcaaacaaactaactaaatgaggttgttaattaacaaatgtttacaacatgttctagtcgacaagccttttcatgttcatagcccaaaagttacttgaagagctgaaggtacgtagcacaaggtccatcctaacgtacttgcagttcctttatgctaagaaggtatcttgcgaaggactgaaaaatactcaaatgataacactttcttcgttttgcctattcgcggaataagcgaaacatcatatttgcaaacgaaaagtaatttgtgaaaaaaacttttatatactttgttaaatcaaagtgtgtttgattgttattctatgatgaataattggcatatgagattattggttttggtatttagagattattggcgaagtgggtttagagatgattggatttgcagatgataaacagggactactggataattggaccgtttagaccggtcaaggtttgccggtcacaccagaggtatacgtgtggtcagaccaaccagcccgcggtctgaccattcgactatgtgtcggttttagtttcgggttatttcattggatatttgtggataatttgtgtttatgacttctagatggatactatgtgtacgtaatactgttgtttgctaacaatgagtcaagttggagatagcttgtgctcgagatatggtttcttgtttgattcatgtgtaggtgatcttgacgcctcgagatagtatagcggattgggagtcaacttggagataaggagacgtccggacggtcagatattatgtgggatacttaggctaaagatcaatgcacatggttagtccagattccatatggcatacgatggaggtattgtgtgcgtatgggatgcggagtcgaatttggaggaagtccaaatttggaacgattggagtttgtaaagttagtttcttgtacgggaatgtttcctagaggattagaacttcttgtacaagtttggctcatggctttacgctaactacctcgggtatatatagaaagggagagtgtggcctcctggtatcgctttagagagcattgagttgagagaatagttagggtttcgagtttaatcgagattttcgtgaggagtgctgttgttgcactttgtaaacacagagagaagtaataaagttgtcatctactttgagagttcttcgatttgtgtttgctcgtgttcggcagtctaaccgtcgagacaccaccggtcagatcgatggcatcggaccagttagaccggtggagtaacggcggttagaccggtggcggctacaggtgacgacaagtgatttcggcagtcagaccggagcgactactgcggttagaccaacggtttccaggcggttagaccggtgcatctactccggtcagaccgcgtatcatcgaattgagagtaacttttaattccgctaaaagttttagtttttgggtactccaaccattcacccctctcttgttggcttagttcttgttgttcgatcctacattttcttctttggattttaatcgatctagagttttgccatggctaacaagtttacaagtagccacgtgttttcgatggcttggatttttcttattggtgtgacaagatgcaatcttacatgatggttgaagattatgatgtttggcaaaaggttgctcagacttatgtgattcctaatcaaattaataatgttgctttgaaaactgaatttaacaaaaattgcaaagctcgcaatattttattgagtgggatttctcgttcggattttgatcctgtttcacatcttcaaaccgccaatgagatttggaatgctttgaaaaactttcatcaaggaactacaaacattaaataacttcatcgagatcttttaaaaaaggagtacatttaaaaagatccattgattctgcttatgacactaattattcacaatctaagattcctcgccactttttgaatggtcttgatatgtctgtttgggagatgaaggttacatctattcaagagtctgttgatatgtccactttgactttggattcactttatacaaaactcaaaacacatgagatgaatattctttctcacaaagttgattctaagtctagtgcatgctttggtttctccctcgacttgtttggatattggtgcttcatcgtcaaattctaccgctcttgctttaattaatgacatgtccgatgagcaactcgaacaattcgaggaggaggactgggctttggctgctaacaagatttctcaagctatgaacaatgtcaggtacaggaaaagaggaggtcaaactcgttgctttaaatgtggagcacttgatcacattcgttgaatattttggattttcagtgcaatattttgaattttttataatggatttttgtacaatatcatgaaatttcctatagcgtatatttaagctttgtgtgtacttactaaattttaatatttagttaggagttatcccaccaattcctttgatacaaacaaacatcccatggtgcaatcaattgttttttgccacaccgcgctaagtgcaagggaatcttgattttctttttaagtcattgacatgtagggatttaatttattggaatataatattgccacaacggttgctgtaaccaaatatctgtcaagttgatcaaactagcctaattttagatcaatgtagcaaactatggttaagtgtggctggcaatcaaacatccctggagtatttatggtacaaattagatgagtgaaaaataaagttatcatgggatggagagaatttgtctagaagaagtaaaaaaaaaatagacacaacttggccgcttgagtgttgagatcatggttcttgtctttctgtgtgccatattgccttgttggcagtgattgcttcttgaaatcatttcatttgtaaagtatgacacgctaagattttatgcgtttacaggaaagagataaattaacagaagtcaatggaaatatttggttgaatcaagaaaataaatagactcaaccacggttagtgacctggccatgctattgagtacggacttgaacaatgacataagtagtcgtgcaaggtattgacataaacaatgatataaggaatccagcgggcatgtgatgaccgcagactttcagttactgtttataggtcatgtagtccctccgaaaaaaaaaaaagaaagaaaacacaacctaagtaccaagatactccctctgttttatttatatctatctagattcattaacatcaatatgaatataggaaatgctagaatgacttacattgtgaaacgaaggaagtatcatacattctagtacaacgaatatggaatagtatatatactccctccgtaaaaaaaaagaaaacacaatctaagtactgagatgtgatacattctagtacaacgaatacggacatagtgtatatgtctagatttaggttgtttttttttaacggagggaatactcatcatattatatgattttttagctaaggacgcagtattaaattcattgacattgagagtgtgctccggatgcccctatatataaatatataaatagacagagggagggacagggagagagaatgggtatctcaaatgctctgcaatggtgggaggagtggcagctccgggttcttctcttgggcagcctcgctttccagtacttccttttcattacagcctcccggcataagtttcctatccgatcctacctcagatcctttatctggtttgtatacctcggtagcgatgccctagcaatatatgcccttgcaaccctatttaaccgtcacaagaaacaggatgttggtcacacacacaacaacgatgtcttagagattctttgggctcctatcctactgattcaccttggtggacaggatagcataactgcctacaatattgaagacaatgagctgtggatgcgacatgttctcacggcactgtcccagatcaccgtagccatctatgtcttttgcaaatcatggccaggaggggacaggagattgttgcagtcggcaatcttgctcttcgtgcctgggattctcaaatgcttggagaagccctgggctctcaatagagctagcatcaatagcctggtgagttttgacgagaaagtccgtaggacgattaacaggcaaggcaagcagattgattcgatcgaagattttgtgcgaagtgcaaggggatttttttgtggaaatgatcatctggagaaaccaagtagatcagcggactttacacctgatgagttatttgtagaccttgcatctccttgtactgataatcgcgtaagaaaactaatgtcattctcagcactttgtggagacgaagcatattatttgttacagaacaacctgtccgacacctttgatctactctatacaaaagaaaagatgtcccttaaaactccccctaccgaagaacttgagactggccttcatcattttgttgaattatacaaacagttgaattataccctatttagctctctcagtgaattttttggtactgtaatacgtgaattagcaatgtttctaccatttacggccatcggcctatttcaccagagtaacagaaaatcttataatgataaagatgtcaaggttacttatgcattgctctgctgtactgctgtcatagagttttacaacccttttgtaaaggtattcacaagtgtgacactaaaccaacgatcaagctcagtttccaagctcagtcaaaggccaaggcaacgctacctttaccaacatcaagatgacatggtttcccaatacaacctattaggatactttgttcgcaacaaaaaacattctacgataatgaactttgtgggattctttgggtgcagaaactatcttgaccgacgttggcgaatgaagtcctgcttttcatcgcgcagcattacaaacgtagttcttgggcatgtgaagcgttggtggaaggatcacataactgatgttttcacctacaggatgttcaatgatattaggggtcaatggagtctcaaagttgagggttgctttcagggattaggctggagcttaaagggagctttcgatgagagtgtccttctctggcatctcgccacggatttgtgcttctaccatatcagtccatctcatggccgtgaacatgccacaacaatgtgcatagagcgatctctggcctcaataatcggtgccctacttggtgcgaaaaatctattcaccataaaaatgctgttcagtgccgagaaatgtcgaattacatgacgtacctactgtttgtcaatcctgagatgttgatgccaggcacaaggcgaaacctattcacagacgcctacaacgaactgaagggtgtcgtcaaggaaaagaatccaccactggatgaaagagaacttgcagagagaataatcgccgaggtgcagcaacaactcgaggagataactggggaagataagtcaccatccagtaaaagagggctcattgaagatgcttggtccattgctgaagagctcctgaagttagaagatgacgagaagatgtggagagtgattgaaggcgtatgggtggagatgctttgcttttctgctgccagatgccgagggtacttgcatgctaagggcctcggtacaggcgtggagttcctgagctatgtttggctactcttgcattacatggggatggagaccttggcagagaagctggcaagaggagacctccaaaacagaggacactcaggtaatttgcggacattccatgttagagagtcctctggtgaagagcaggttgctggaccatcgacttcttatgctaacggagacaacggtgatcaacatgttgttgctccattctctgaggatggctttaccttggctggggatgaaaatgtgtgacgtgatacttacaagatcacttagttcctgtttgttgctctttttttttttgttttgctcctgcatgtgtgtttcagcttttcttgcgatttaatattaccagtgtcatgcaactgatttttcatgtgaatgcttactaattacactaccacaatgttaagtcttaatgccagtatgtttttcttcttaaagttgtatgagcgttttttaagggagagaagcttgtgcgcgcgcgcgcatatcttctaatagtactagcctactaggtgaatctccgcgctttgctgcggaaattactaagtaaattttaatattttttaatatttgagctaaaactaaaaatgatattagttattaacaaataaaactggtttgtcaaactatatgttaggagagaaataaatttagtagtatgtatgtgattgtagataaaatatgatatcccacgctttgattatatggatgaatatatgttaattattataaaaatgatggatgtatatatgttaaaaatattgtgaaaaaaaatatgaagcaagatgattggatgttgatttatagaattcaatgaattatagatgatgtttcatgcttacataagttttgtatgtaattattactaatggatgatgaggtggtatgtttgcatgtagagctatagtattagtgggttataactttatagtaataaatgatatgatttatgatgaatcattgatcttaaaatgctctattctaaggtgagtcatagcgtacatctgaaaaagagtgtggccatggtatgcaaatcaacgtgtgtttgattattattctatgataaacaattggcatatgagattattggtttagatatttggagattattggcgatgtggttttagagatgattggattttacaagtgatgaacagggactgctggttatttggaccggtcagaccgggcaggtgctgccggtcaatccggagctatgtgagcggtcagactggctagcccacggtctgaccggccgactctgtgtcggtttaggtttcgggttgatttgttcgatatccgtggataattcgtgtttatgacttcgagatgaatactatgcgtatgtaatactgttgtttgctaacaatgagacaagttagtgagaacttatgctcggatatggtttcttggttgatgcttgtgtaggtggtcttgatgtctcgggagagcgttgccggtgatggatcgggagtcaacttgggagaagatgacatccgaacaatctggatatcatgcgggatgcttaggctaaagatcaatgcaagtggttggtgaagattccatatggtataagatggagatattgtgtgcatatgggatgaggagtcgaatttggagagagtccaagtttagtacaattggagtttgtaaaatttgtttcttgtatgggaaggtttcctaggggattaggacttcttgtacaagtttacttcgtagctttaggctgtctactagggtataaatagagagggagggtgtggcctcctggtatcgctttagagagagttgagccaagagaaaagttagcgtttcgagtttagtcaaaattttcgtgacgagtgatgttgttgccctttgtaaacacatagagaagtaataaagtttcaatctactttgagagatcttctatttgtgttttctcgggttcagcactccaagcggtgggacactagtggttagaccgacggcattgcaacggttagaccggcggggacacggcggttagaccggtggcggtgacaggtttcggcggttagaccggagaaactacctcggtcagaccggagatttctagacgatcagatgggtgcatatactctggttagaccgcatgtcatcaaaattgagggtaacttttaattccgttaaaaattttggttttttagtactacagccgatcaccctcctggttgggctagttcttgttgttcgatcttacaagtgggtattagagccttgttttcttctttggattttaaccgatctaaagttttagccatggttaacaagtttacaactaagccacatgttttcgatggattgaaactttcttattggtgtgacaagatgtaatcttacatgatggctgaagattatgatgtttggcaaaaggttgctcagccttatgtgattcctgatcaaattaatactgctgctttgaaaactgaatttaacaacaattgcaaagctcgcaatattttattgagtgggatttctcgtttgagacataccaagtaatgtcatcgatcatcatgagttcattaactgagaggaacttttcaagttgctgtattaaaccgcacccacattccaagttcttttatcagtgtttcaatttactcataagagaattacattatgtgacatgtaatgacagaaatggaattccatgagttaggaacactaaaagaaaggtccaactggagacattcttactattatggagctgaagatatatggagcaaagtgggaggctagagcacatatatatggagcagaagacacagggtacatttttacatgtcaacgtttggcttcgccaataactgcaagaaagacccgccaattgtaggcctgagaggaacggggaatctagtttattctgcgcgcttccaccatatcgaacattatctaccttaacctcaacttttttttttattacaaagtagtatcggatgcaactaaagagtgacgatgaacttatatttgccgaagtatccaaaattgcaatggtaagcgaaacggccccatcatttcgcttattctaatgaaaagtaattaatttatggataaaatttttatatacgtgttcttagcgatttaaaagaaaaaaactgaaaaataaacttcgataaaaaaaccttaaaatcaacttcaaatttaatgttgaaaaatcaaattttagttgaaaagtataagcataagcgaaaatatgagattcttagtcgagcatgagcagatcgctgctcaccaagattacatttggtgggtgagtgcaggtacgtccacacactcttatgttgcaaactcaaaacaagatgaagcaaggtcctcttatataggatcaaacataagtaaccaagtctactagaaaagggtgagtggtagattacgccagcgaaagtcaaataatcgaatcttgatagatcaaaacacaccccaacattaaaaaccaatggaatatacattcggtggtctatccgacctactatggtaggtctaaccaaagcctggccggtttgaccgcaggtcctctcgcgatctgaccgtcagcctaaaaacagcacgatagaggttcggtaaaaacacgctttctcttaaaccaaccgttggattgagttgcaaactttacagaataaactagacaaaccaaggaacaactccaccacagggatttgcaaattacaaaacggtttaagagaaaacaccatcgattagggctggacgaaaagctcgtgtctcattgactcactcagctcttatctagcttggctcatttggatttattaacaacccaagccagggttttagctcgtttgttataacgagccagatcaagctggcccgtgagctgttcgcgagccaaacgagccaagcacaacagctcaagtacctagttggccagcagcaatatgaagcgaccaagctggcccatcaagaaaaagcccatgaaggaaagaaaaatactaaccctagatggagagacacgtacatgacctgtctctcgcactttgaattcccgatcccctttctactctagcatcgctcgctctccacttctcacgcaccgacgaggtcgcgccgtcgattgctcgtaggcggtagtggcaccctcgccttggtaggccctcgcctcagtcggccccgaccgccggccctcgcggcatcacctttgtcggccccgctgccggcccttgcctctgtggcttcgtcggcaccagtgcatctacaccatcgatgaagaaggagctaggaaggtgaacgagtcaatgagaccagccaaaccaacatttgtacatctcttccaagatgattatctcttgcatgttttattgatggcaaaatttgctaggacatccaaagactgtgctctttgctagaggacactgaaagaatacgtttttgttagatgacactggtaattagctgctggacacctacggtattattttattatatctagagaaatatttattaaagacaagtttacccataggcccacttgtcaatcacacatatctagctttctctgttcatgttcttcttcctgctgctaccttctctctcatgcgtgtgcacagcagcggcaatggagagcatgtgcagttgctggctggggcagagcatgcggcagctggttggaggaggtaggcctggagcttggccacccgtcagcggcgccacgagagagccgcacagctagggtgtcggtgcgggagactgggttgcaaaggggaaatatagcgcagcttcaatttgaccaagcagtaagtacgacggggtgtctaggaactttgggaagtcgatttccaacgattgcaggacaaagcaatgtcggggttgtgtgcccatgatgagcttgacggcagcccaattgagtttggactggcaaggcatcttcgtctaatttttaaaattgattgggtgcagtgcctctatgggtagggaaaaaatttaggatgtaatggattgccggaaattggcgtgatggcgaatgatggcaacgacatcgtgctcgccatcaacgagctcctcggcagcttcaggtgcgtcgtcgctgtcggcggtgaacccggcgatgcgccgccgccccgccgtggccgagccgtcccggctcggcccggccgcgttggccacgcgcgtcacacctctcgggtcgggccggccgcgttggccgcgtgcgttgcacctctgctcggcagtagcaagcgcgaggaagaagggaaaagaaaagaagagagatctggagtattttggtacttacacaactctttctttctccatttaactgaaaataataaaataatgtgagaagtgtccaacagctagttatcacttttttacggtgtccacgaaaagattcacgatctttggatgtctcacagcaaagaccgtaatcttttgatgtcttatagcaatttttgtctttattgattcctcatttgcatttttagatctggaatgcccctgatttatgttgcagtactggtttaatcccgccactcaattacatttgctttgtagtgatcgatcagtgcaagctcgtgatgtatcatcatattcattttcttttccaatctgtttgtttgtgagcgtttgccctcttcctcctccccatcccatggcatatgccgctactcttttccttcttctgtctcacgagctaaacgagctagctcgagctgacacacgagccgagccgagccaacactttagctcgttaggataacgagccgagccgacccagctcgatatccacccctatccttgatacacatccatctcagatggtcaggtggagtgtcagtattattttcacacgccatgtcgattggtgtgacgaaaagtttcaaattttagaaataagttttgaaagggttcatttttttaaattaaaaataaggttaaaaataaaagaaaatccttttctagcactaaaacaatgtcaaccacatcaggtggtcaatgactaatctgaagcacatagttattgtgaagcacatcagtgtggagaagccctcccgtcgccgacagcaaggtgttggacgccaccgcctccaacgtcctcctcggtgcacccttcgcccaccgcagagcgccctcccgtgatgccgccagccgcctgagctcaccccgcctcgaccgctggccacccgagttctctctgcctctgcctccaccgcccgccgcctaagctttgcctccgctgtcggccactcgagtgagcgagagggagagagagagaacagggattagggagaggagagggatgacagctgggtccacgagttcttttaattttatttgctgactggattgccacgttagcgccacgtgtgcaagtttaagtcgaaaacaactcaaaacagtacttaggagggttatttgtccggtttgtatagttggggtgagatgtctggttttatgttttaagggggtaatttaatcgaccgtgatagttcgggagggggtaattaatttgtactttttcctattataatactccctccgtctcataaaaattacatttctagctaatttaggacaaaacagtaggattgaaaaatgaccacaatgaccttatttaatgaacccattgcatgcacatatttcatatatacaaatgattaaaagtaagtttagagaattaacccatataattagcatacctaaattacaagctgagagaacttaaggaaacttatctagatgaatcaatttgttgggacaaagccttagagctagaaatgcaattttttttcggacggaggtagtacaatgnaggagtgagggtnngagctagagtgtcntacctggggcgcg

SEQ ID NO: 21916 - DNA, 6938 bp, Oryza sativa
  unsure (1)..(6938): unsure at all n locations
cgcggganaaggagagaacggccgaaggggaaggaatcgnccgcggaaatctcggccgccattgataacgccggcgaagatcgcgggcgcgatttcggacgaatccgagggagagagagaggggaaagagggggaaaaaaggaagggaatcacggggagtgatttccccctctttaatgcgcgcggggacgccgggatccgccgaattcgncggcgtcgncggcgctagggcacgggcgcgtcgacgggctcggcgcgagaaagggaatgacgggtgggccccacccgtcagcgagggtggcggtcgggcccgcccgtcaacggcgcgcgcgcggggaagaagacctatggtccgcggggtagaggagagagaggcataggggaaagtgggccgagccggcccaagaagggaaggggggaaaagaagacttttagggtttttctttttataaaacctttttaactttgtttatttcttctcaattattatttgtgcgctgaaaattccactaaaatttatttacacattttaggcttttaggaaatatacaaaaatcctccaagccttatttgacttttaaatttgcacattttaattgttggaggctttcacatgggttttaattattctcggcacaattttgaggatatattttagagtcgttttgggacgcgacaaacctaccccccttaaacggaatctcgaccccgagattcggagggactggcgaagagatcgggatgggctgccttcagctcatcttcacgctcccaggtagcttcttcttcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcggagacatttcttgagttgcgacgcatgaaacacatcgtgcacgttgcccaaggaggcgggcagctccagctggtaagcgacttctccgcgccgggcaatgatacggaaaggacccacataccgaggtgcgagctttccctttgtctgaaacctgtgtacacctcgcaatggcgtgactcgaagatacacaaagtcacccactgcgaattccaggtcacagcgacggttatctgcataacttttctgccgggactgtgccacctttagattatcccgaatgattctgactttagcttcagcttctctcaggatatcagtcccgaacacttggctttctccaacttggtcccacaatagtggtgtccggcacttgcgcccatacaacgcttcataaggtgccatttgtatgctggcttggtagctgttgttgtaggagaactcggcataggggagactcttatcccaggtcttcccgaaatctagaacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacgaactctgcaatttcccgcttcatgctaacccaccagtatttctccttcaagtctaagtacatcttcgtactgcccgggtgaatggaatagggactttcgtgagcttcctgaagtatcagctatttaagttctctgttatctggaacgcatacccgatttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcagccaaaaatccgcgactaactatgcttaggttcagggcttccatctgttgattaagttcgggtggaatgccacggacgttaagagcgtggcaatggctttttcgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccaccgctgctaactccaaatcatgggtagggtagttgccctcatgagcccgtagctggcgggaggcataggccactacatgaccatcctgcatgagcacgcaccccaatccttggcgcgaagcatcacagtacaccatgaaatccttgcgggtatccggcaagattaacaccggcgaggaaaccagcttttccttgagagtttggaatgccttctcgcattgcgggctccacacaaatttctcttctttcttcaacaattgtgtcatgggtcgagcgattttggagaagttctcgatgaacctctggtagtatcctgccaaacctaagaaactgcgaatttgggtgactgtcttgggttgcttccaatcggtgacggcggtcactgcttcggggtccacagcaactcctttagcagatatcacatgccctaagaatttgacttcggtcaaccagaactcacacttgctaagcttggcatacaattgatgttcccgcaactttcccaacaccaggcggagatggtgctgatggtcttcctctgattgtgagtatatcagaatgtcatcaatgaaaaccacaacaaacttatccaagtattccatgaacactttgttcattaagttgatgaagaaggcaggtgcattggttaaaccgaacgacatcaccgtgaattcatacagtccgtatcgcgtggtgaatgcggtcttcggaatatcttcttcacgaatacgtaattggtgatatccagaacgaagatcgatcttggagaatacagtggcacctttgagttgatcgaatagatcatcgatccggggaagaggatacttgttcttgatggtgacttcattgagagctctgtagtcaacgcacatcctcttcgtcttgtctttcttctctacaaaaatcacaggagcaccccagggagaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagtcctatctcatgaagttctgaacttttgacagaggttgggggtgcaaagaagacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaagcccctgaatttctatactttgctgtcataacccctccaggggtggtgatgagcagagggttcctaagcctttctacccccaactgatttctccccacgaatggcacagatataaaagagtgggaagctccagagtcgaacaaaatggtagcagggatggagtgaatgaggaacgtaccaacgatgacgtctggagttgtcagcacgtcctcggccgtcacgtggttcacacgaccccgaatgacatccttcccaccattgttggagcggggaggcgcttggccttgctgacgcctcggctttgggcatttatccgcaaagtgcccgggctcgaagcagttgaagcacagacgctgcggacctgaagcgtccctgcggccttgtccaggctgcacagttggcgtaggaggacggggcgcacgagtcccttgttgattctactgcggctgcggctgtgggacgcgcaccacgaattgaggtcgaggcgcggagcgaggttgttgatgctgttgctgcggctgcgaggaggatccccctgggtagggattggtgtagcggaccctttggttagcaccctgttgattgcggaagttcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctctggggcataacgggccagattgttgaactcatgcaaatactccatcacggagcggttgccttgcttcaactctcggaactccctcttcttaagagccacgactccagcgggcacatgggtcctccggaaagcggcggtgaagcgagcccaagtgataggttgcccctctggctgcgtagcttggaagtggtcccaccatagagatgcgggcccttgcagctggtgggcggcgaagatgactttctcctcatcgctgcactgcaccgtgtctagctttttcccaaggcatgcaaccaatccaacgcatccacggggttgttggagctagagaaggtgggtgggcggatgcggaggaactcggcgagtttagagtgttgtggaggtggtggtggagcattatgtggtggcggattttggaggtggtggaggaaagcagtcatcatattggcctgctgggcgaggatttgggtgagaatggcgttggtatctggtggtggtggcgaaggcggaggaggaggtgaaggtgggttgccttggtggttgtggttgctgccttcgggttggttgccttcaccggtaacagcatttctcctggtcgtcaccatctgaaaaccccacacggaaccagcaaacagagagagctaacaattaaaactaaccacccacgactactataattcttgaatttattactgctattaaattggttcattaaagttcaagttgcttaagcaaataaaataaagacaggctccgacacagttatgccacacaccggcataaccatgccccacacgacccaacaagaagacaaacgagaaagaacacgcgcgcaagcctactaactgctcgtctaccgctgcgacggcccaggacggaaggtgagcaacaacgcatcctccgtgctaccaacgccggaggcttccccctcctggggaaccacgggcgcgggctcggcacgaggggtctcgacgaagcaggtccacgccagggactgacgaacaagctcgggcctggaggtgctcttgcgggcggtgatcttctggctgcggcagacacggcggcgcttgggacggcagtcctctccctgggcgatcttgagctgatgcagctgcgcctccactgcgtctaggtccttcttgagctgcaggttctcctgacgcagctccaggatcttcatgttgttctcgaccatcccacggcgcaccatctgatggaaatcgatacgagccgcgtcgtacgcctccaccatgcgcgccaggtgcacgatgggagcgtcatcctccgagccagcatctcggaaggtggcgtagtcgcgggctcctccgcgacgagggtggtagcggtagggcgagtgctgcaactcgtccgggtagcgctggtgaagagtgccgatggcgaggagagcggcgttttggcaagcggcggggaaggaatctccgcccgcggtgactgccagcgaagtccgctcgggagagccagagaggatcactgcagtaacctcccaaccagcgtggggctctgcatcctcaccctcctgctctggaagcggcctggcctggtagtccactccatgtggataccccaagaccacgcacataccccgcagctccaagacgaagccagtcatgtccaaaccacgacgggtgacgctgccggccatctacaaacaaaaacaaacagaaaaacaacattttagagatcagattttggcgataaatgaagcagcaagacagagagagactagaggattttcacaaataacaagggatttttatttcgaaaatactgctaaggcttggggtctacggctcgtcctagggtcaagggggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcggaagactagggcgacgaccacagacgcttgacggcaggcacgaactagacaccaaagccttcatcttcaaggaactcctcttctggggttgggaaaaattgagcaagactgagtacaaccaccgtactcaacaagacacacccgcaagtgcagaataaatgcaagggagtacaagggaattatactataaagggttagggttgcagtaaacagcatttaaagacatttagttgctccaaagctattttgtaaacacgattctagaactatacaatgttattaatcacggccgggtaccagctcgatntcaagtcatcaggggggcc

SEQ ID NO: 21917 - DNA, 790 bp, Oryza sativa
  unsure (1)..(790): unsure at all n locations
ccgtggnaatagaaacaccttctggcacccatgtgatatctgctaaaggagttgctgtggaccccgaagcagtgaccgccgtcaccgattggaagcaacccaagacagtcacccaaattcgcagtttcttaggtttggcaggatactaccagaggttcatcgagaacttctccaaaatcgctcgacccatgacacaattgttgaagaaagaagagaaatttgtgtggagcccgcaatgcgagaaggcattccaaactctctgggccgcgggggagaggagagagagggagagggggaagtgggccgagccggcccaagaagggaaggggggaaaagaagacttttagggtttttctttttataaaacctttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattatcctacctctagagggggtaataccgggtattccaccagattg

SEQ ID NO: 21918 - DNA, 822 bp, Oryza sativa
  unsure (1)..(822): unsure at all n locations
tgcggaanaaagaaagagttgattaagaatcgatttcttctcgaaacataatgacctattatagattttttgtgttnnctgncanatacnccccccccccccagaggntttgatgtanatcgcctgctgccagcaggcgactctagaggatccccaaatatgatatatatatatatatatatatatatatatccatttttcaagtttgtaataatttaaactcaattaattacacgttattaccaccttttttgcgtgaaacacttacaaacaccacctaaaggtgtgttggagaatactacctccgtttcaggttataagactttctagcattgcccatatttatatagatgttatatatcgcggaggccgggggcgaggaaacggtggcggcgcgcgcttttccaacaaaccgcgccccacctgtcagctatgtggcaagattggacatgtggtggcagactgctggtacaggtatgatgaaaatttcattccagattcaaaaacagcagctgcggcttcctatggggtagatacaaattggtacatggacaccagagccactgaccacatcacaggagaactgggcaagctgacaacccatgagaagtacaacggcaaaaaacaaattcacacggcaagcggtgcaagtatggacattaagcatattggtcatttctattatttatacccccatacgcaaaaatcaggtgaaaaaaatcccttatggggcctaaaactaaaaaaaaaccttatctctggtcaatcgattaaccggtggtaatcaagcccttggtggaagacattcctttttcttttgca

SEQ ID NO: 21919 - DNA, 723 bp, Oryza sativa
  unsure (1)..(723): unsure at all n locations
cgcgtccnattgttgatcaactnnnnnnnnnnnnnnnnnnnnnnnnnnnnnnnnnnnnnnnnaacgtggcaatccagccagcatatcaaattaaaagaactcgtggacccagctgtcatccctctcctctccctaagaccagatctgtctctctccctatagctcactcgagcggccgacagccgaggcaaagcttatgcagcccgcgctggacgcagagagcagagagaactcgggtggccagcggtccaggcggggtgagctcaagcggctgacggcatcacgggagggctctctgcgctgggccaagggagcacccacgaggacattggaggcggaggcctccaacaccttgctgacgatgaccggagggcttctgcacactgatgcgcttcacaataactatgtgcgccacattagacattgaccacctgatgtgggagacatcgttttagcgctagaaaaggactgtctgtgaatcctaacctcattcacaatttaaaaaaacgaaccctttcaaaacttctttgtaaaatgggaaacttttagtcacaccaatcgacaaggcgtgggaaaactattctgtccctccacctgaccatctgagatggatgtgtatcaaggatcggggccggtatcgcactgggtccgataaggtcggtaatctaaccagctaacagggttggtaaggcttgctcgcgaaggacctccaggtctcttgtt

SEQ ID NO: 21920 - DNA, 1332 bp, Oryza sativa
  unsure (1)..(1332): unsure at all n locations
gatgcccctttgatgaccatctnnnnnnnnnnnnnnnnnnnnnnnnnnnnnnnnnnnnnnnnctctgattgatacagtctgaatatgatgctaagagttatatactgatattcttacaaggttgctactcaactagctgcctttttataaagcactgtatctgtggaattgaaaagcccatttccttctcatgatagaatagattgattatagttgccacgtggaatacaagattagaatagcacaagtgcaaacaatgttgaactcatagtgctggtaaggttcaattagtgctggtaaggttcaattcagaaggttggggttgtactctagtgcagccattaaaagttgaacagaaaacaaatgtacctttccggtgatctttgtatagatggaaagaacatccatcacagtagactcaaagtgtgttgtggcatcataactctgaaaagcaaatcgaattaaatgtttatttcaaatgcagttttttggtcatatgtctaacctacatacacttgatatttctgcgatgacttactgttgagatgaaacaattgtctgaagatgggtcattagtaggttcaaatctgtcgtatgtatcaataaatagttcatccactggcccaagaaggtctatccctggtttcaattccgccgctggattttcactctctgcttgtgctgacacgaacgcgatgaacttcccttttgatgcaacattgtgagagtaggaacaacagaaaacatacctggcatgcaccagtgaacattcttttgttacaataatagaaatgacaagtagaccaagagtaatctataggtgtaatgcccagtaatggataaaaaccagaggtgatatacagaatacttgcatgtctgatttgcgtccaagttgcttttgtggtattatgatctgtacagagtgagaatctgcagtatttgggattggatggctcatgatagcgattgcccgaaaaacttttccaacttttctaacctgatataacagcagataattctaatcagtaccaacattttgtaaacttctacgtcctctaatcctaagcataagttgttttggacttgtgaataggaactaaggccccgttcaatgtggggttttgtagacagattttggttgcacgcaaaacgagaaacatcatccacacatgatttattaagtattaattattataaattttaaaaatagatttatttgtttttttaaataacttatatgtaaaaactttttgtcaaaaacacaccatttaacagtttgaaaagcgtgctaacggaaaacgaggggtaccgagctagaatatcaatccagcg

SEQ ID NO: 21921 - DNA, 718 bp, Oryza sativa
  unsure (1)..(718): unsure at all n locations
ttttaatatctgtgccattcgtgggaagaaatcagttgggggtagaaaggcttaggaaccctctgctcatcaccacccctggaggggttatgacagcaaagtatagaaattcaggggcttccttttccctcggatctgattctgctagacaccaagaacttggatgtgatccttgggatgaattggttggctcaattccaaggagtagtggattgcgcgagacgcactgtcactctgtaccgagggccggaacaaccggttgtcttctttgcacccccaacctctgtcaaaagttcagaacttcatgagataggactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttctccctggggtgctcctgtgatttttgtagagaagaaagacaagacgaagaggatgtgcgttgactacagagctctcaatgaagtcaccatcaagaacaagtatcctcttccccggatcgatnnnnnnnnnnnnnnnnnnnnnnnnnnnnnnnnnnnnnnnnnnnnnnngctattcaatgggccgt

SEQ ID NO: 21922 - DNA, 753 bp, Oryza sativa
  unsure (1)..(753): unsure at all n locations
cggtcctttgttagtcactcggtcccgaattcttcaaagtgtttgaatgtctgtggaccacaaacaccatacttactcaagggactgaagacaacatccgctggaagtgggcagaatcaggggaatactctgccaaatcggcataccagatgcaattcctcgacggagttccctcgatcacgacaaatgtggtgtagaaatgttgggggccaactgcaaaatgcaagtctttcacatggctgctctttcaaaacaggatccggacgacagataggctccaacaaagagaatagcccaatgaatatttttgtcaactttgcttgagaaaccttgaaacggtgcaacaccttttcaacgaatgcccgatgaccaggaaaatctgggatgtggtggcaacgcggatgacctcccacagctgaaaaccgcaaaactggttcgacacgtcatccctcgaggaatggtggtgccagagtgtcaaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataatggaatgcgccn

SEQ ID NO: 21923 - DNA, 745 bp, Oryza sativa
  unsure (1)..(745): unsure at all n locations
gtgtccctttgttgtctacctggtacccttcatgttcctaaagctaaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattcgccacatccaagcaagtccttggagccatcaagcccacaatgtcaaggtggcatagccgtctaggtcatccttctctagctattgttcaaaaagttgttagtaggaataatctcccatgtttaggagatgtcaatgagtcaggagtctgtaatgcctgtcaacaggccaagagtcaccagctaccctatccaaaatcctttagtgtgtcaaataatcctctagaacttgtgttttcagatgtgtggggacctgctcctacttctattgggggcagaaagtactatgtcagttttatagatgatttcagtaaatttacttggatctatttgcttaagagtaaagctgaagtttttcttaagtttcaagaatttcaacaacgagttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21924 - DNA, 767 bp, Oryza sativa
  unsure (1)..(767): unsure at all n locations
ccgcgggtangatcgatcnaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaccgtcgctgtgacctggaattcgcagtgggtgactttgtgtatcttcgagtcacgccattgcgaggtgtacacaggtttcagacaaagggaaagctcgcacctcggtatgtgggtcctttccgtatcattgcccggcgcggagaagtcgcttaccagctggagctgcccgccttcttgggcaacgtgcacgatgtgtttcatgcgtcgcaactcaagaaatgtctccgagtgccatccgagcaggccgactcagagcaaattgaagttcgcgaagacttgacctacgtggagagggcagtgaaaatcctggacaccatggagcgcaggaccaggaaccgggtaatccggttttgcaagggccagtggagcaaccccgccgaagaagaagcttcctgggagcgtgaagattgactgaaagcaacccataccgatctcttcgccaagtcctccgaattttgggggccagatttcgtttaaagggggtagggtttgtcccgttccaaaaccaattttaaatatatcctctaaaatgtggccagaattattaaaaaccctgtggaaaggcttccacacatttaaag

SEQ ID NO: 21925 - DNA, 754 bp, Oryza sativa
  unsure (1)..(754): unsure at all n locations
aggcgtaccattgattattcgtactcggtacccactcctggggaagcggataagcagctcgcctgcattgttttcagccatggatctcacgaacaagtaattgatgtggctaggcttcggaggcatcgggcatccatattgcccgttcacgaccatgagcaccaacatggttgggagctggcaaaactagttagtgagacccagccatggcgagaccaactgccatgcgtcctgatagatacatccatggtaatttcctgatgtgacatgcagcgcatgtctgcgaccggtggtatcgacggctcaggcacatgggcatgtgcagaaacatgagcagccaaccgggtgaccattgttcatcctaataaaacatgcaagagccctccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagt

SEQ ID NO: 21926 - DNA, 806 bp, Oryza sativa
  unsure (1)..(806): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttattcatcactcagtctgaaaagaatttcctataaatatttgcatatgcgcatgcgaagaatatttaactgtgcgacacttaaaacccaagttccaataagtttttgtgtatgtctccactctccataataaagtagagcagtgccatctaagcccaacaaactacacacaaactccagaatataatcaaatataaattggagccgggcctgacctttggaatcatgtctacattgtagtctctgctagccccaatttgcgccgggggagtaccttcacctttgaaccttttccatagctggcatacataaacaatgagcttgatcagataatttcatctgataggtaaccaacctcacacaaatttgtctgaaactaatattgatgaggaaatttctaacatcccttagcacgtcaggaaaacagaagttggcagacaggtaggtaagataatgttggcaaatttttgctacggagggtgaagccttgtcacctgattcaggttgagcgatgtggagtctccaccgtagtaatcattcctgtccatatgcagcacctggtgacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21927 - DNA, 5406 bp, Oryza sativa
  unsure (1)..(5406): unsure at all n locations
acggnccattgaattgcacattcganttcnnnnnnnnnnnnnnnnnnnnnnnnnnnnnnnnnnnnnnnnnccgtcgctgtgacctggaattcgcagtgggtgactttgtgtatcttcgagtcacttttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaacaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacatatcaaatatgcgcaacatattgaacacgtaccgaggtgatgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgtaccgtatttttcggaacgtttccaaaacaaaaacgaatccgaatttgcagcaaaacaaaactgcaaaaggaggctgcatctgcgcaagggtgctgcatctgcgcaagggtgaggagccaatttttcggaccattcgacgcgtacgtcgtgcacgcgcgccgcctgccctgccctgccaggccaggcgagcgagcgcgcgcgtgtgtttcccctcttctctccaccacacatgcttcaagtggctaggagagcatcctcccttttaaggaggtccccctctcctagaataagcaaggtggtactaaactccacatgcatgccatctcatgaggtgggcttttgtgattttccaaagaattaatcttcgagtgggctaaggcccattcattaattccaacacacttcccagagtctttccaccgtgcatcttcggagacgtcctagcgacagctgcaaaaacaaaggtttgatcctcttttccctcaacggttcaaacgaaataacaactcccagtgggcatagtcgacggtgaacatggaagatagacgcgatatcaatgcattccgagtgatgagaaggaactaaaggtaccctttctaaaccaacacctttgatgttccacatatccaaaaagtcgagaagccccccatcacccttgagatcggtcaacaacaaaaaacacagaatcaacattcaagaacaaaatcaacatccacatatcaaaaataaaatccaagaacacagaggggaggacaccgaaggagagaaggccactgccactactgctcattgtgggtgaagtccactcttgagcgccgcatgatgggagggcagcaccattcgttgagggagtcgccgtgccagggacaattgagggagccgctgccggcatcaagtggtccgtccctgagctcacagcgatggatccaaccgcccccgtgctcgtggcggcagatttggccacccccttgctcacaacaacaaacccagcggagaggaggagggacggcgtttgtggcagagatgaggggcggtggtggcaacgtagataggagtggtggcagtaaccaagagagagacggagaggctcagagagagtggcgagagagagagagagagggagagagaggctggactctagagacagagtcatccatatataaaaatccaggtcggctcgattgtcggcttgactacctgaggagtgttggttttctaaaagattacccggttgaagcattagcttgctttagatggtatacgggcggcaatggaatgggttcacatgcccattatagcggataccagattaccggtaatataatccagatgtggcagttagccttgtgaaggactgctccggccagatatattcacaggcaacggtgattactgaagtaattaataagcacaatgcagtgttaaattttactaaataaagagcgaaccaaatagagttggcggatccagcatgggggcggcggggtctcgagccctccattactggcgtgaagactatgagagaccccacaaagaccccactaaaattttttaccatgggagggggactgtaactctatctagtttgcttagaccccactactatttatttctagatccgccactcttcatatttttgctcagcaatgtgcacggcaacatatatggaatggcgtttctgtgctcccgaaggaaccccattctcttccaaactgttcagattcttacccagaagataaattttgctacggaacacctcaaattttagataatttgctgatagatatggtaaaaacgtgttatggctgaaagacaccataaaaaactgataatttgctagagaatactttcgattcaattgaagagagaattcttttcaaagacgagaatgcccctagggccaaaagcttctgagttgaggctggagtgaaaatggaatatgatgtacgcttgcgatgtacttaaggtgatcacaaatttaaagttgcataatttctaaactttcactctaacatcatgtgttaaagcatgtggtcctaagggtattcttgtttttcttaagaatttatctccagcaaagtgttctacaagaatttatgtgcagcaaattgttctccaacaaattactattttttgggtttttttttcagctatcacatatttttgtgatgtctacaagcatattatagaaatttcgggcatcatgtaacaaaatttgcctacccaaaatataagaaaaggaaatatcctggggaaatgagctatgtgttgaaaactcatgaaaaccatactttaatattttgtaaattcatgaaaaaatattagagataggtgtaaataagaaataaattctcactaaatgttaagtccaaactcaacttcatttgagagaaagaaatgacaaacttcatatgaatataactcacaaaataaattagaagctagaaattaagaaacctaacttccccaaactttatatgagtagaactcacaaaataaactagaagctagaaattaagaaacctaacttccccagatttttatgagctgtttatcataatcgcaacttctcaaacaagatcttaagctcaactaagatagattttttaagagtgaattcagaaaactattgatacatcgaccaaactatatatcatgaaactatagttttaagaggtatatcacaaaactatagatttaataatcaatttgttacaaatttacaatttattttaaggtgatgttctaaggtagatttatgtgctataatatcggtgcagaaaaactgaaaacgaggagagagcgagagaagagctgggggcagctataaaaaaaatgtatatttaacttgtactcatatataactattcaaaaaaatgtgcacgacatagttggctagcgccacgagcgagactgcaatcaataggttgcgaggctgattctttctttagctagtgcatgtgttagacaatttcttttaccaaccccggacgaatgtcaatgcaatccgactgttagaagggaaattcactgtttaatttctagcgattccagaagagtttggtgctgcaaaattcgcagcttttctgatcttctttctcctttatttattgatctcctcaagtgggagtttgttacatactacaaacttttcttctttttcttttttgtttcatattacacacaaacatgaccgattaaaacgcacgatgcaacaaacgcgctatcccacgtcgtggcacatccgacttcggtcagaaaacgagctgaagaaacgcttaattcttggcttcactgaatataattccggtaaccccggattatatccaattaaccactacatgaaacaaaattaattaacttaattcacatgagaggtggcgtgcaacagcatcgcatcaacggtcatccccgggccgaacgccatcatcactcccaactccggccattcacccgccgccgccgcctccttgcgctgccggcgcagctcgtccagcgcgaagatcaccgtagcgccagacatgttcccgtagtcgctgagcacacggcggctcgccgccagcttgccgggctcgaggccgagcgccgcgtcgacctggtccatgatcgtcgacgagcccgggtgcaccgcccagaacaggtcgttccacccgccgccgccgtcgccgccgagaagtgggccgaacatgtccaggaggcaccgctcgacgttgtccccgatgagccccgggacctgccgcccgaggacgccgtccaagcggcgctccgtgaaccgcatgttcagggcgtggtccgactccgggatgatcgtctgcgccgccgacactatctcgaacagcgggcgctcgacgtcgtcggcgtcggcgccgacaatgacggcggccgcgccgtcgccgaacaggccctggacgaggagcgtcctgaagcagccctcgtcgggcccggtgaagtacatgaaggtgagctcggcggcgacgacgaggacgcgcgcgccgcggctgttctcggcgaggtccttggcgaggcggagcgcggcgcaaccggcgaagcagccgttgaggtggagcatggtgcggcgcacggaggggcggaggccgaggagcgggacgaggcggaagtcgacacccgggacgtgggcgccggagttggtggtgacgacaaggtgggtgatgtcggcggccgggcggccccactcggcgatcgccttcttggcggcctccgccgccagctccggcacggcgtccgcggcgatgtccagccgcgcgtcgagcgacggcgcgtcgcggtccacgaactccgggtgtgcggacagcatcttctcn

SEQ ID NO: 21928 - DNA, 29567 bp, Oryza sativa
  unsure (1)..(29567): unsure at all n locations
ttgggaattganttgcttatacnnnnnnnnnnnnnnnnnnnnnnnnnnnnnnnnnnnnnnnnnnnnatttttttttataatttgtagtttgtaagagttctaatttgtatatattttttataatttgtaatttgtaaaagttgaattttaacatgtatatttatcgactgatacatcacatgctaatacatctttttttttgcaaatttattttgtaaccatttgggtgatatatgtaaacaacgagtggacgtgtgaacgttttctcgagggtttaaaatccattctcggtggaggttgtatatgcaaaattaatatatcgactgagaagagttggatagtagaaggagagaggctgtcgtgtgtttacacgtacagatacgcttgaacttgtccttgagggcagtgaggtggtcgctgttggtgacgcggaagtagaagtcggggaactcctcctgggtaacgcagttgggagggttggcggtgccgatggcgagcacggcggcgagcccgtcggcgcgctgcgaccgccgcatttcgccgagcgggtataaggcgcttcccatggtcgtcgtcggtgccatgcaaacaattaaatcactgcaactaattcttcgatctcgatcgatctccgcccgccttgcttggcacgtctcgcacttttgttttgcagaccacctcacacacttatggtgtttatatagcagtgcgctggatatatgacccactgcttgtttgtcagttgccagatttttcaaaacatctacgtgtgctgttttgtgtatctatctattatctatatatctatctatctataagatatatcttaaggctgcgttcggcagctgccgattaagagaagacttatctcttcactttccgagtaattaaacggtgtgtttaattttcttcaaaaattttcaataagagttgctttaacaaatcatatcaatctatttttaaattttaaaatagttaatactcaattgatcatatgttaatggctcacctcattttgtatatctcaatcttctcttttcatctcctttcaaacacattaaagtccattaaacatcctataaacgctccacgtgacacttctacaaacgctttcagaccatcatgtgacgctctaataaattagagaaaatcatatatattctgagaaaaaaatctatccatttagttccactcaaattagtggatccgttattttgaaccactagattacgtctattaaaaattaattccgtcctaattgatttcccgtgtaagtaagagataaaatacctacgcatagcttcacatgaaaataaacctaaaacacattaccccttgaacttcttagtattaaaaatcaaccaaatctaaatagatagccacatataatgtcaaattacccgtagcaaagcatgtgcattcaactagtttacatttacatttatatgctcctaattgtcttataattaagtgccttatatatgtcgccttccactttggcgtgcagtgtaaagtttagttctgacttgattaattaggcaatttcaatattaccaatcaataattgtatgttatacttgcattggtttaaaaccgcataaattttagtgaaattcaaagttcatcttggagtcctcgtttagtttttttatttaataactcaaattcaaaattaacgattctagctagatgtacactagatgtagattgaattgttatgattcgattagggcacattatttttctagttacgttgtttaaattatcaaatgtttctcttttagaacattagtatcaaataactacgacatgttctttcttagcagataatggataatccggctttgacttaagaacaagctacccccacttcctatgaagttttcaactgaatcaacagtaaatatgcatactaatgaaaaagatgacaagaaggagaaacattattaggaggcttcctattggtgaatcttcatccaatgttagtgaagatttgcatgaccattttctccaaactctggcgtacaatacatatatgagttccttgtttttatcacacttttatagttgggcccaaaactgcagccaataaatataaaagtacttgcatataagatttaaaagtagctctgtcaaacaccatatcactcatggtaaaccaaagaacctaacataaaatatatggatctactaaaataagctttatggttcttacgtcaacggcactaagctaactcccccaaaatgtgaaacattatttggtggattcaagccaaaataaatacggaccaatctccaaagaaatttagcaaagtgacaatcaaagaatatatgttggacagtttcaatatgcatacaaaagcaacatttttttagtactagcccaatttagtcttgctaaattatccctgtttaagatatcccctttaattaagcaaatatcacataaatatttttattttaagaggaatcccattttgttcttctcaatatatataaccattgttgattgcagctaagtacataggatggatagagaacataccattttgatgaagattccatcaaaatatatctttatcctcatttagattaatatcccaaatcattggttcattgatgtacttggctagtgcaacgaggcctgatatctcatttgctgtaagtaagctgagccggtttgtctcaaattcgggagatgatcattggcaggctctggaaagagtaatgcgctatttaaagggcactatgagctatggaattcactataccgggtactcaaaaatactggaagggtatagtgactcaaactggatatctgatgctgatgagataaaggccacaagtggatatatgttcacacttggaggtggcgctgtttgctagaaatcttgcaagcagaccatcttaacgaggtcaacaatggaagtagaacttacaacactagatactacgacaattcaggccgagtagcttcgtaaactcctgatggatttgccggtggttgaaaaaccagtgccagctatcctaatgaactgtgataatcaaacaatagttattaaagtgaacagtttaaatgacaacatgaagtcatctaggcatatcaaaagaagactgaaatctgtcagaaagcagaaaaactccggagtgatagcattggactatgtccaaacggctaaaaatctggcagatcagtttaccaaggggctaccatgtaatgtgatagacagtgcattgagggaaatgggcttgatacccacctaaggtcacacaatagtggaaacctgtccattgtgatcggaaatcccgtgaatttggatggcgaaacaaactattgtgtggctgagagaagagacccttaaaaatggctcattttcatgatgtacttctcttctattctgcatggtaggatggcttatgccttaatgtggtccaagtggcttttctaagcagagatgttgacctgcagaacatctcaaaaggaacacacctatatgagttcgactgctagccacagtctatgagatttgggcgatctctagatactcatgaaagggccttgagtttgacttatatgctccaaaaagaggggatgcaaacggcaacccagtaccaatcaagggtttgagtgaaacctgatcacacaagactaacaattcaaggcatagtccattgtttagttgtggtctgatgtagctcattttctaggtggaagttcaacttaacagtctctaccaaaacattggtatatcaaacaggttcaactttgagaacatttcttatgagccatgaaatttggtggggattattagaataaatgggctaggccctaattttctattaaatctcaaggccccataataaatgttaaggataataataccaccctgagaattaaaagaggagtatctcaacttaaatagggagttattggaggctcgctgttgaccggttgaggtggggattagaaagccacacgcgcacgcgcgcgcgccgagccaagccgagccaaccggggcgaggctgtgggcgaggcgtggcgtggcatgcgttgcgtctctctctctctcctttttgcaacggaccggaatccaatcccgcgagattgcctctgtaatggatagttgattcaatgcgattgattgcatcgttactgcggcaacgggcggattcctctcctgcgctattaggaaatagagcaccccgatcagatctcaaggcttagtttccaaacgctggttcttcctcctcgcgcctgtgctgcttctgtttttcccggttctgatcgcttgcgcacacgagagatcgggacgaggagggcctctaaaaccacacattcgcctaagatctgcaccgggtaggcgggtgatcaggtttgcacgactgctcttcttctgttcgtcgtctgttcatctgcatcaccatgtctggagttgtcgcacctagagatggcacacctggagcgggagccggagctggcgccccgatcgacaataccaacggaggcagttctgccacataatccagcggagggactttcacagtgtataactctctaccgctatttctgtttttgttacttctgttagtcgcaatgctattgcgttctctacatgatgatgatgcttattctatcttaagcacgctcctggttatgtttaattttatcactagatcacctcacattgttcatgccatgattattgtcttaatattttggattaaaatatgccgatatatgactatatttccaacagttacatgattacatccttacaaaatataagaatttacatgttattaagcagatattaaggttttaaaaacactttaacactccttatatggatggttaggggtgggaaaatggtaaagatatatatatatatatatataggtcatggttaatgggaccctttactctaaacaatgccacatgcaatcagttatattttaatatgttttaaatgctataagtgcttacctttagcatcaagcatgtggtttccccgccgtcgtgcagctaaagatatatacacatgcatgacgccatcgtgcgtgaaatttcttggtacagactcgcggtggcggatttatgaatttttttttagcctgcacaaacctaatgatagaaaataaattaacaagcaaatacaaatacatatagcattttatcatgaatagaagtaaattggctatcatcatttatatactaaaagtccattaaacttcctacaaacgctctcaagccgccacatggcctcctacaaacactcctatgtcgccacgtggcattttataatctcaccgtcgattttcttttaaattggtggacccgttaattttaagcgttagatctcccttagagaaaaatcatccccactatttttgagaaaaattaccgtatttgctttaactaatagatagaaaaaaaaagagaatcccataataggacaagaggccagtgaggatcgggcagggtacatacgttctttttttttctttttctggtggcatacgttctattttttttcctggtggcatacatacgttactacgttagtatttttttcgcctttttttttggcaaacaatactttttttgctttacacattcggcaaacagtactattactacgatacgatacgtacatgtacgggagtttaggggggaagtgttaatagatataaaatcacatgttaccaatttaagggaaaatcgatggtttgattttttttctcataatttttaatatttattttaatttagagatatgacatgtagtgacctacaagcatttatacgagcgccacgtgccggtttaaaagcgttcgtgggaagttcaatggacttatatatactaaaagacaattaaacttcatatagacgctcatataaacgctcatacatcgtcacgtgacattctataatcacaccgtcaattttcttttaaattggtggacccgttaattttaaccattagatctccatctcaaagaaaataaatctggtatccccactactaacaccttacatacatgaggtaaaaaaaagctgtacatactctttccaccctccgaatctcccctcctctcctattttctagctaacttatcctattttataattaacactcaatatatcaaaaaaataattcagacatctaaataatcataaccctcaagttacaattttattctcattttttgttaattgttgtgttatttataattaaatataaaattcaaaatccatattgatcatattttgttatctaaatattagatcatgcaaccattctaactacaaatgtctaggcctaatggtacacctataaacgcttctaagtcatttgccacatgacactattaaattaaaaaaaatctataagtgtgacaaatgaaaacaaaacatctaaccatcagtttacacttgaatcaatggatgcactatcttatatggttagatctatctttaaaaggaaatcccaaaactccgtcccaaccgtttgtcccgttcctctctccctaccattcattatctgttatttttatctccatagcaactaaatcgaaaattatctttacgagaaaaaaaacacacccacaaatggactccgtctaacaagtctagcgagcttttcctttgccatgtgcttctcttctctttctccttaagctagcacttatagaaacaacctaattagaatttaaaataatcgtaaatttttaaatcttatattcaatttatgacatttttaaactattgtaagtttcaattaaatcaataatttaatacattgtggacccatctattcaccttgaaacctccaataaataaaataaaataccaaaatttctaattaaaaattaaaatatcccaccttatgtttttaatagcagtcaacccattatttataccatgctaaatagctaatggccttcttccaactccttctgttttagattacaagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatggaagtagttaatttctcttaacattcaaataggggctatttacagatacttagatgcgcttttatgaataaatgatcttttttagagataaatagacgttcctaagatcatcatcacatctaaattatacatattatatctgatgtcactaatagattagagtaaaagcttttaattatatcttttttcttgtcataacgtgtaccctgtctaggatctatttgtcatagacaatagattgaaaacaatcaagggatacttttatcccatgccaagttgtatggccttaacccacttatatttccataccaaattgcagagatcaaaacatttaagggatgcttgatggaatggaaatctagaaaaaaaatagaaaaataacatgataaaaataattgaacactgaactttttttttcttctaaatttaactttttttgaatttgaaacccattctaaatagcaatgttcaaatattttaggagtactgatacaatgaaaataactaaaattttaaataacatataatagaaaatagaatttttggcattatgttggaaacaaaatctaacataatttcagttcgaagtatacaactctaaactacaacttgagagcgataaaagtctcattttttaatatattttctgatttagaaaaacttttactgctaaaccatagtttcatactgcaatactatataattacaattaaatcattatttcaacatattcagctcatttaattagatcatgtaatcgtattagccatatttttaatagaaaatatcttcaattgatatatcctaaaattcaaaaaaacatatatagtgcaaaaaaagatgctaaatattaaaaaaataaatgcattatgtacaaatgcattatgtagaagtgatatatagtttcatatatatatttcttataaaaccaaatttgcacagttttaagtaattttagtttagaatttatacgccagcgatgtttactagcattcaaaaaaacaccacacaaattattgaaaaattaaacatgtttacaatagagtaatcataaaaattcctaatcaaatttctaacccagttaaataagatgcccgcgcatatgcgcgggctaccttcctagttatatactaaaagtccattaaactttctacaaacgctcttaagccaccacgtggcactcctacaaacgctcttaagccaccacgtggcactatctaatctcaccgtcgattttcacttaaattagtagactcgttattttacaccattagattagatctattatttaaaaataataacttcctcatatattatataacatagaaacgttaatataacatagaaacgttactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgcatttacgctgctacgtgtctctctaataaattagagaaatcctagaaatttatttatatactaaaagtgcattaaacatcctgcaaaaactattacgccgtcacgccgtgctataataaattagagaaatcctagaaattcagagaaaaaagaaaggcatatgatcctttaatttttacttaaattggaggacccgttatttaaaatattagtttagatctattaaaaatcccatgctgctaatctctatctggaaaaaaaacataatgtgcgtacgtcgtacgatcgtctccatcctaaaaaaataaaacttaaatacctacaccatatacgataaataaaacagataaagccaaataaataaaagaaaacatgcacacgtacatagaatcggaaagaaatactaatcgtgaaaaatcacactgatgtgttgtcaacatcctttaaactattattttattaaaaataacactacacagatatgcacattaaacttaatctctgatagataaaatgtcaaagcaaccgtctgacaaaacctaacattgtgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaattttttttattgctatttgaggagagagaagcatacatcatagatagatgtaaataaacaaataaacaaataagaattaggcagttattttgctacaatacaatccttaattcatcatgagaattatgattatccatgtatgttttttctttgccaagtagtattggcaaacatgaacaatccagtaaaacacgtataaaactataaattctatatactgagtataattgatggacgaatgttatacacctctgaacccaattttgtcaattctttacctcaaatcaactcaaaacttaaaaataatactgtttttgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtgagtgtgccaatagtgaattgagtgttaaaattgtactttaagatggtctttaggggcacagttacatcgatgcgaaacccgtgtttcaaggcattatgtaagaaagccttagttggctgctacggtcgacttcatctgttagaaaatcattcatgaatatttttaacggtgttatcgtattatctggtagatatgatatttttagacaatttatacatagatgtgaaaataagttatgcacactgggttatgcagtgtagatgatatttttagcgtataaataatgtatcatttattttagtggtacaaatacagtttcttttattaaaagtgcacctaactttcaaaaacaatgatagtaagtagtggtgacaaaagacgagtttatatatgaccaggacaaagggatttttacttaaatctaataaacattctatcacatttagtaatctataccatctattttacggcaaatatatttgttttttttatttagggtaatctatattcccttacaggatatatgtattaatgtatatactaagatatgatttattttagcattctttttcttgaacaacaaataagatgcccgtgtatatgtgggggtttcttttccgatttatattctgaaaatatcctccattttatattttgtccttacattggttgaaacatagcctatgatacatgcatgcgcgcgcgaatgcgcgggctaccttcctagttagtataataattagtgctaatctaaatggtgcatgtatggagctcatggttagtttctaatgtatggatacatacggtggagcccggatgcctatccgtgctggctgggccttggctccgtcgctggtacagagaatgaggttcaaattagttactactttcgtcccctaaaatatagtaatcagaatatttcctaatacgacaatatatagacaggagatctaccccgattcataatattaagatgtgtcatattctacaaatggagaaaacaactcatgggacatgtatgtgatgacaataaataaactatggccatgtttactttatgtgccaaaatatttttgaagtatatggacacacatttaagtattaaacgtagactaataacaaaataaattacagatttcacctataaactgtaagacaaatttattaagcctaattaatccgtcattatagcaaatgtttactatagtatcacattgtcaaatcatggtgtaattaggctcaaaagattcgtctcacaatttacatgcaaactgcgcaattagtttttttttcatatttaatgctccatacatatgtctaaacatttgatgtgatggaatttttgaaagtcggaaggaaacactgcctatgatgtaggcccccacctagctaggttaagagctgatgtgaaagggatcgatccctaggttaagagctaatgtgaaagggatcggagtgaggttgaacctgccgacatctctgccaatatggtcactctcagtgagagagtttcattctcactaaatagtgtcatgtcaatatttatatgacgtctcttaaaaaaatatttatatgacgtggcaagtaattaataaaaaagagatgaaatgaatttcatctcgatgaaactatttatacaccgttttcaatgtgacttgtttctacatgtgttgcctatgaaacaacaaaaataaaacagtatattgtgttagctatttcaaccatcaattaaatgtcttactacctccgtcccaaaataagtgcagccgtagatatccgtgtccaacgtttgaccgtccgtcttatttgaaaaatttatgaaaaatttaaaaatatttagtcacacataaagtactattcatgttttatcatgtaatagcaacaaaaatactaatcataaaaaaattttaaataagacaaacggtcaaatgttaaacgtgaatagtgcaaaactgcacttattttgggacggatggagtattctttatatgacactcttttttttttactgaactttatatgacactcttagaaacataaaaataaaacgtcccactaggaatgacgttaggccatttttcacatagagttccaagagtgacacgtgcatcaaacaaagaggttcggattaataaataaaacaaacgcttctaacgcatttcgtgatttcatatgctactcataacatttagttgttgaattgtgttgttaaaagagttgataccagtacgatttcatttttaatttcaaggcacgaaatgaaatgattctgttgctgtgggttttattttgtttctaagcattcctaatggataaatgcatatatatgtagtttcatttcttgatttttaggttgagattcctaacagattcaagttgatgaacaaaactaatatatccaatgcacaattttatttcgtggtttgatatgtcgtccatagtattttattattgaattgtatcatgaaactatttggttataataggggtttatttctgttttcaagacacatgagataaaatgaatagggttccattctgtttcgaaggcataggtaagtatgtaaaacaagttttttaaaataaaactcatttcttctcacttgtaaatttcttggcatgtcattagtttagcctatgtgatatcttatttaataacatcgaaactcttgttaaacatgcattggaaatgacctaggtattaaaatttcacctaaatgaaactcattcattttctttatattttttcagtttagccttatcgtttaataagattgaaactcttacgcaacctgtcctgaaactggccttaggttaggtgctaaggagactattagagagagaaagttgagagttcttttaagactatagagaggagagttgacgttgtccttcaataaacatccatgtggacaggagtctgactttctccatagctgtgccaattttatatgttcggtgtacgtgaatatagaagagagggaagcgagagaggacacttgacttcgcccaatgagaaacatcggcatgccgattttgtgacgaggttcggtgttgacgagaataggagggagggagaaaaaagaaacacacatgtagatggatcggactttttatatcttacccttttttaaaaaaatcttattttacaaatatactcttaaaaaaattgttctagaaatgaacatttttctcgatgctagaattattggtctgagattcaatgtctcggtgccaataacattgacatcgatatcctcgcttcttgctaaagctaagtcaccgatacgaaggatcggtgcaaatgacattagtgctaaagatctatttgtaagaaaaaatatttgaattttaaccttttctgaaattcttttataaataaatccttagtgtcagttagtagcagagccaagcctgatcagcatgggctagtggcctagtgcccagtctccgccaaacgaacgcgtgactttccagttagaacattaggcaaaacagtgattacccttgctagattatttggcaaaccagtaaagaatgcatgacagcatgagtgctcgaactagattatctaggcaaactatcgaagcaattaagggcaaagcatcacaattcatgtattaacatatagcccactaattaagtaatacataattattgtccaatcaatctaatctattgatcaaaatggtttttctcttctaaaccacaatttgatagcgttaacttggctttcattaatgatggatagcccatagagttgtatgaatatgtgtgttcattagaattgcccagattttagaaaatatatagatccgccactgctgccagtgttattgtaactaaaaaggattaaaatataaaaaatgcagggtaagtgaagataattaaacaattaactgttagtgtgtagtgttgtttccaaagggcgatttttgttgaaataagacatttatctcaaagttgatacaactatcattagattgcacagccaaagcaaagtttttgggtgaatacacactaataactatcagtttgcatactagattgtgttagattaaataagctggaccaatttaatcctaataaattctatgtgcccataattaatgttaaggaattaatatcacgttgaaaatcaacgtggagggatctcaacttaaatagactgctattggagagcaattgttgagcggttaaggtggtggtggggctgccacacgcatgcgcgcgagccgggccagggcaagggctggctgctctatttcccaaacattatgttttaactaaagatgtaactgatggatgcactcgttactccaacaacgaaacgttatggtttgattgaagacataaccaatggaggtgctcgttactctagcaacagatggggaattcaatcggattgattcgggcgctctcattactccagcaacggacatttcaatctcgacttgattcctcctggaacattactctcttgtacactatataactcccaccttctcgttactccagcaacggaacgttatgttttgattgaagatataaccgacggaggcgcttgttactgcaacaatagacggagaattcaatcagattgattcgagcactcccgttactccaccaacagacagagaattcaatctcgatttgattcctcccggaatattactctctcatgcactacataactcccacctctagaatagacatagtacacacaaatgcccagtacatcttctctctcgaactctgattctcttgttgggaaaatcttgttttctctgttcctacgcttcttgtgtgtctctggttccgatcacctacgcacacaggacaatcaattttttggggagcgcattctagagcgactgctctcatcctcttcctcttcatctactctgcactgctagttcttcttcctatcaaaaggcagcaatggtggaggtggcggcatcgggaccgggcaccggcacatgcgagaacagcaacaccaacgtagacaacaacaccaacaatgcctcatctagtaccggagcattctccaagtaaccatgttaaccatgttattagatgatacttattttgttattgccatgttctgtttagcactatcactagatcattctacacatatgtcatgtcatgttcagtatgatgtttttctgaaaattaaaatatactgactaaatttccaccacatgcgcttgagtgaaacaacctctagctaccttctccgatattgctaacttgccgctgcaaccaaaaacctgtaaacccgatttttttggaggatagcccaaagtatggacccggtagcaaaatattacggctgccactagcaggactagcaggttttcgaattcctccctgacacatgacgaggttgaaccatatgatatggagaacattgcgtgagcagaccggcatagccctatgtatgtacctgatcacgtgacctagaacttgaattaattattctttttcaaccatatattcaacttaatgacacgaaatactattaggccaactatatggaaggtggttgattccaccggacagtgaaattctaccatgacaaactgattacgtttagctttgacggccattaatttttcagcccccaacctgattacagaaataacgattcatctagtgtcagctaaccgacgtgagagacttacgcttagttcacaatcgctatgttttttcaaacaaatttgtcaatactctgaccataaaagttctttataacttaataaattataagtggaaaattgctaatagtacaacagagtcaataatctgaaaagagaaaggtattacgtcgtttgctctgttcaactaaaaccaaatcatactaaggtacgtcgttcggagcgtcacattttcacgtccagttgtctgccaatatcgagcagcaggcacggagcaaattttcgacaagttgaataaaactgcgggtgcaaaacagcggccggccttatgctgaattatttgacgttattgcaacgacagatttttttttaatttagtcattattgccggccggtctaactcaatataggttattttatatattcaagttggtttcattattactgtccctgatgctacaagtgtagaagaaaactgtgcacagtgaaattacactcttagaaccaaagccaagtatcttttattttactttcgataacatagttcctatagattttaacaaagttcatttatattatcgtgtagaatattttctatttcgtattttagttggataccataaaaaaagtggtggagacttgtgccatacatcaattcttttatttatcattttagactgtccataggtggaagatgttataaataaaagaaaagcagtggcgagcagattgcctgaagccttaaaactgagtataagcacattgcgcttcaaacaagagtttacaaaaataaatttcagaagactcgggtacatctaaggtgcaaaagactataggtattttagcatgtgccatataatcccgaggattataatactagtgttttataaaaaccacataatttacgtgtactgtgtgacataacttattggttattttatatatcttagatcataatattgatggttttctgcaatttacttttttttgaaatgattatattgctcctcgcacattcgtaactgctggcttattattgaaaacaaaattattaagctaaaaaaattccatctataaaaatttgaatcagacaaaattgtttgacacaaaattggaaaaccaaatttaaaattgaaattggaggggaaattacacaaatcagtacttctccgcttcttagaatacaaaaagtagtattcttttaataattaacttcaaccaaattgagatgaacataccttttagaatttcatcgaatttgtttaagattcatttcaggatttattaattttttgtttcaaattttggggccaaataattgtacacccttctatttatacccaaaacatgattgtccataatcacgaatccaacaagcattacagaatcctaattacttaggaaatctctcaaactagggaatttctatacaactccaaactccaatattttcaaacatgaactccaattttcatgccgtgacaaattcatcccaaattaaaaaccattatctaaatggaaaaaagaatttattaaaaactaaaaagaaattagaaacaacaaaatacgtacaagaaaattttaaaatttaaatgtagcttgcagtattttcattaaattatccatagtccaatacgtcctcgtgttttacttgaatttttattccaatacgtcctcgtgttttacttgaatttttagagcaccaaaaataattattacacaataaaaacaacgtacagagttttctaagcatagaaactgaaaataaatcatccctcctccttgtgccatgtctagcccagtcttccatcttccctcctttcatgcggcctgcttcggcctccctttctctgggcctcctccacatcatggcccatcccgcctctcgtccccagcccacctgcactgcctccctccctccgcgcctgggccgcctcgcctcccggcccagccgccggtcgtcttcctcctctggccgaccgttcctctctcgctccttccttccttcctcctccattgaagccgccgccaatccgccccttcctgtggccggctctcctccccgacctataaaacggagcctcctccctcccctcgctccattttgccacctcccaaattcctagctgcctccctgtctccaccgcgccacccgagctccggcaacccctgccgccatgctcgttcgccgtcagacgttgtcggttccttccccggcaccgggacgtcaacctcctcgccggcctctctgcctccctgcccgaagctcgttggatccgcgccctcgccggctcccgtgcctccaaccctctgccaggccattgctcctcgccggagtaccgcccggcctcgccgccactcccgtttgcggttgcatgttcctccttggctgccacctcccgagcccttttgggcgccggaacactgtcgacgccaagttcgtccatccttcaccgtgtcagctgtcctagtagcctaccaaagatccctgatgcgtccataatggactctagcatgatacttggcccaacgggcctaaagatggtgacataacacccggacagattctggatgcccattgtttcgatgattttcattgacttcaaaggggttttaatatgagactagattcattagaaaggcggtctagttagctttccatacttgtacagaacgtcgaaaatagagttcagatgagataagggtgatgattttagtgcgggctgctccagtatttttgagatggacttgaatttgatatgagatagacctccatcttgacttgaacgcccatcttgaccttctccatctcctagtctctagttctctccatagttcctaatcatatttaaatcattatgtaataattagtcctcaaaatcatataaaagaaatacctaggaacgagctcacatgtaatttcaattgttgggcatgagctctagtgattagatcttgcatagcaacttgaggaatattgtgtgtatccaaattgttgatgtctccatcatcatccccctcatgaagtagagtcgtcctcgacccaagcttatcttcttctctcaaatatagctccaaatcgaaaatgttaaatgtgggactaacctcaaactttagaggcaattcaagtttatatgtattatcatttatcttttccgatattctaaaaggcccactggctctagacgccaagtacaggaccgctggttagataactctacattgaaatgtcatttttgggagttaaattgctaatagtgttgaatgatgaatatattaatttgaaagcacgtaaagtttttatgagagcttcggaagttagagaagcatgttgattgaaacaatacaagcaatatgattttacatgccaatttgacctccctttatagtatgtctgattgtggcaacatttatttaactgtaaaattattgtagtgaaccagcgccgctacggctgggaaggaaaccagaggtgcatcgctgtcagcactggcgtcctgtccctgcatcatttgtccgcatcgcgtgcctgcagcctgttagagatagaggtttgttacatagagttgttacgtgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatatggtatcagagccaatcatgcacgcgtgagatcgcatctaccaaaaatggcgagttcctccaattccaccaccaatccactctccggccaagttgtcccagagaagctcacaaggaataatttccttctatggaagacacagatccttcccatcattcgcggtgcccgcatggaggggtacctcaccggcgcgactcgcgctccgtcggcagcgatcgacgtcaaggaaggcgacaaggtcatcaccaagatcaatccagcctatgaggaatgggttgtcgtcgatcaacaggtgcttggatttctccttgcatctgtatcaaaggacatactcacccaagtcgtcaatctggaaacggcggctgcgacatggagagtgatcacaacgatgctctcctcacaatcccgtgcgcgtgctctgaacacgcagcttgcactgttgacgacccgcaagggcgatctcagtgtcacggagtacatcggcaagatgaagacgctagctgacgagatgtcatccgccggcaagcccctcgatgacgaggagatgatgtcgtacatcctcgccggactcgacgacgattatgagcccgtcgtctccactcttgtcggcaaggcggaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccagcacgtttcgcggccgtggcggtggtcgcggcgatcgcggaggccgggggcgaggaaacggtggcggcgcgcgcttctccaacaaaccgcgccccacctgtcagctatgtggcaagattggacatgtggtggcagactgctggtacaggtatgatgaaaatttcattccagattcaaaaacagcagctgcggcttcctatggtgtagatacaaattggtacatggacaccagagccactgaccacatcacaggagaactggacaagctgacaacccatgagaagtacaacggcaaagaacagattcacacggcaagcggtgcaggtatggacattaagcatattggtcattctattattcatacccccatacgcaatattcagttgaaaaatatccttcatgttcctaaagctaaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattcgccacatccaagcaagtccttggagccatcaagcccacaatgtcaaggtggcatagccgtctaggtcatccttctctagctattgttcaaaaagttgttagtaggaataatctcccatgtttaggagatgtcaatgagtcaggagtctgtaatgcctgtcaacaggccaagagtcaccagctaccctatccaaaatcctttagtgtgtcaaataatcctctagaacttgtgttttcagatgtgtggggacctgctcctacttctattgggggcagaaagtactatgtcagttttatagatgatttcagtaaatttacttggatctatttgcttaagagtaaagctgaagtttttcttaagtttcaagaatttcaacaacgagttgagcgccttttcaatcgcaaaatcatctctatgcaaactgactgggggggagagtatgaaaaattgcactctttcttcactaagattggtatctcacatcatgtttcatgtccctatgcacatcaacagaatggttctgcagaacgcaaacatagacacatagtagaggttgggttggctctcctttctcatgcttcaatgcctctgaaattttgggatgaggcgttcctagctgctgcctatctcataaaccgcacacctagtaaggtcattcagtatactactcctttagagcgcctccttgatcaaaagcctaactattctgctcttagaacctttggttgtgcttgttggcccaatctccgtccttacaacaaacacaaacttcagtttcgctccaaacaatgcgcttttcttgggtatagcaacatccacaaaggttttcagtgtcttgatatatcaactggcagagtttacatctctagagatgttgtatttgatgaaaatatttttccctttgaaaggttacatgcaaacgctggagcaaggctgagatccgaaattcttttgcttccttcctccttatatcaaaatattgcaactaatggggttgaacataatgaccgcatgcctaatgtccctgagcaatctaatgtgcctgttgagcatgtgacagatcaggagatacaattcggagaaggttcagaaaatacagcacaaaatgatcacagttctgcagcaaatattgaaggagatgcaccggatctggatgccacagaagatcctgaggacatttttcctggcagcagcgatcccgagggaggatttcagccctcacctgtgcacacgcctgcactgtcttttcccgacgatgaagaaatcggcgaaaccggtggcttgacgtctctgcagcagggggagcagtcgcatgcagccacgtcgtcaagcagccatcatgatggggggagcggcagccctctgaccggcggatcgtctgcacccgacacagccgtggctgagcccgcacggccggtcactcgtcttcagcgaggtataagaaaacagaaggtttataccgatggtactgtaaggtatggcatgctgacaactacaggagaacctcaaaacctagatgaagctttgactgataaaaactggaaagatgctatggatgctgagtttactgctttattagaaaataaaacttggcacctaattccacctagtcatggtaaaaatgttatagactgcaagtgggtctacaaaattaagagaaagtctgatggtagtctggatagatataaagctcgtctagtagccaaggggtttaaacaacgctatggtattgattatgaggacactttcagtcctgtggttaaagcagctactatcagaactgtcttgtctattgctgtttccaggggatggtgccttcgccaactagatgtgcaaaatgcttttctgcatggataccttgaagaagaggtatatatgaggcaacctcctggttatgaaaataagagtaagcccaactacatttgcaagttagacaaagcactttatgggttgaagcaagctcctcgagcttggtattcaaggttaagtactaagttgattagccttggcttccaagcttccaaagctgatacatcattgttcttttataacaaaggaggtgttacaatttttgtacttatctatgttgatgatataattgtggctagttctagacagaaggcagtatctgctttgctggcagatttgagtcaagaatttgcactcaaagatttgggggatctgcattacttccttggaatagaggtcagtacggcaggtgatgatattttactgaaacaagaaaaatatgcctatgatttgttgaaaagagcaagtatgctagattgtaaacctgttagtactcctctgtctgtatcagaaaaactgtcagctcatagtggaactgctctaggagaaacagatgcaactagatatagaagtatagttggagctcttcagtatctgactttgactaggcctgatatttcatttgcagtaaataaggtctgtcagtttttacatagtccaactatagatcattggatggcagtgaagaggattttaagatatgtgaaattctcagttgatcttggtcttaagataagtcgttcatcatccactcttgttagtgctttttcagatgctgattgggcaggatcaattgatgacagaagatcaactggaggttttgctgtgtttctggggtcgaatttggtttcctggagtgcaagaaaacaggctacagtatcaagatcaagtacagaagctgaatacaaagctgttgcaaatgcaacggcagaggtaatgtgggttcaggctctacttaaagagctaggaatagattcacctgaaactgcatgtatgtggtgtgataatctgggagctacttacttggctgttaatcctgtgtttcatgcacgaactaaacatattgagatagactatcattttgtcagagaaagggttgccagaaagcaattagaaatcaagtttatatcttcaggtgatcaagttacagatgggtttactaaacctctcggtgctccacaacttaggaatttcagatacaatcttaacttagataagttatgattgagggggagtgttagagatagaggtttgttacatagagttgttacatgagataacaacgcatgagatgataagataggaagagattttgttttctgttttgtaaccaatcttcaccattgtatgcgccactttgggggcttttcccaaacatatattaacacgtacagcggcctctaacgaggttagaacgcttctgccaacttatacagccatcccagtaagatcccgttaatcatgattcacttggggggaggcaaagcaggaggaagatgatgccaaatttgcattcattttaatagatgttgataatttgtttcacctctctgctggaaaagtttaagaagcattcaatgtttaagaattaattttcttttgaaaagaatcagataattaactacgagcaaagaattcagcaaacttcatgtcttcatcttaacaagccagcccaaagtttttagatttaattgatcaagatttcattctgtttttgtttttaaattcactgaaatatttgtttttggttgtatgcatatatattaggttcagtttagtagaacaatcctatatgcctggagtttcgaactttcgatggcgacatggcgtgtttgcagtccacaagctttcctgcttctgcttgtatggtttgcttttgattgtaacgattttggagcaaatagagcactgaccatcgtgtacagtactgagatccgcggaacgaaccaatgaggcgcgcatcggcaatggacctctcgccctcttcaacaccatcgccgccgtcaaggtactgcaatatccacgatccaacaggatggcagtgagttgggcttgctggatgggatcatgtgaagcttcccccacacatgtttttcctacatctctattcattgcaaaaaaaaaaaaagtgggctaccttggcattgaattagcaattactagatgttattatgagaatcagagagcgagaaatgaaattatccttagcaatattgccagttgactgacaattctaattgtgaatgaaggaagtaataactgaggcgtacgtgctgccatgtatatgaatattcatgtagtacatttccatttagtttatattttttgaaattttgatatactgcatttggaaccaagcttcttgttttatttaacaaagagattcaagaacagtttctgttttatttttgacataacactcagtaatattttgaagaacagttatatcactgtcgttatgaattggaccttatcaaagtaacaacaatactcggttatttgcctcggtataagtgagccgtaacactgttgaatctttcctagttcagtagatttctctcagttcctgtaaaacttttgattgaatactctggtgatgttcactgggcaaagagctaacttccccataacctaccttggaatgcccctcacgatccacagactcagaaaggtccacgtgcagtacctcctagacaggattaaggcaaggctcgcttgatggaagaaaaaattactctcagcagggggagaagagaattagtcatagcagtcttaagttcaatgccgatctatatcatcacagcgctcaagatccacaagcagctcatccaagaaattgacaaagctaggagaaaatttctttgggacagaggcgatgagatccatggaggcaaaggcaaggtgaactagaaaagggtctgcaggccaatcaagtatggtggacttggaatacctgatttgcaaaaaaaacaggacacgcaccctggctgcgatgtctatggtacgagcggaccagcccgaacaaaccatggataggcacgcccacaccctagatgaacaagataaggagctctttgctgcctccaccgaggtcctcgtgggggacggccgaaaggcactcttttgggaatcaacctagacctcgagcaccccccccctaagaacaattgcctcaaatctatacaagcactcaagaaggaagaagcgaatagtggcagaggccctaggaggagataaatggatggatgatatcagacacaacctgaccacaacactcgtcactgaattcttcaaagtgtttgaatgtctgtggaccacaaacaccatactaactcaagggactgaagacaacatccgctggaagtggacagaatcaggggaatactctgccaaatcggcataccagatgcaattcctcgacggagttccctcgatcacgacaaatgtggtgtagaaatgttgggcaccaactgcaaaatgcaagtccttcacatggctgctccttcaaaacaggatccggacgacagataggctccaacaaagagaatagcccaatgaatatttttgtcaactttgcttgagaaaccttgaaacggtgcaacaccttttcaacgaatgcccgatgaccaggaaaatctgggatgtggtggcaacgcggatgacctcccacagctgaaaaccgcaaaactggttcgacacgtcatccctcgaggaatggtggtgccagagtgtcaaggctgcaacaaaggagaaaagaggggggggcatcaattagatcctcatctcctaggaaatatggagagagcggaatagtcgcgtcttcagaaaagaagaactgtcgctgcaacaaataattgaacggatcacggatgagatctggttatggccggcagctggtgcaaagggcatcaagtgtctgatcccaaacacccaagacgctatcagtagcctgtaacaaaacatatgtaattttaggcatgctaggcatcccgtggtcgcccttccctcctccctcctctttttctttccttccttcttttaatgtaaccttctagcccttggctattgtacagtttttccccctaccttaatacaaaatacaagtacaccccgacggggtttaaaaaaaataccctggtgatggtagtaagattatgccctttctattttggattgagatgaacatatgcttgatcatgttcacttcaatcaaaacaggtgaaatgtgtgggatattgtgtgagaaacaactttgaatgtgtacataacttagctttccttgaatttaactttattgagttttactatggtgctcaaatctcttttttcatgccatcagtggttgtggacatatattatgattaaatatgtattgaagtgattacacataattgtgatattaaataaactttttcaaacaaaaatatgatatgttttacttttccttaaatatatttcatattatcatatatgacccaaatcaagtaaagctcatttggactgattagagaaaaattaatttgactaacatgcaaattaatagtataatttattagccaaaatattattgtgtgtagtgttagcacagtatattaatagtcacaatgtaaaatgtgacgacgctagcatagttttaattttgtacgaatttgaatatcatgtacatgaatagatgaataataatgacgctatataaatgacatatttgtaattgcatggattaaatgacatatggaccatccctattttttaatcacccaggtagacatccacacatttattcagtggcggagctagaaccaaattgagggtggtgcactgcttcactatatagatggtggcaattactctaaataatggtttttgaccatttatagatatctattgacaccaaatcattgagtagcaagtaaaagtgtttacagaaatttaagatgaaagaaaccacgaatggaaacataaagaaagatatacatcctcgacattaaagttgtcaatgtcaatatcatcgatagttcatagcctacaataataccagaacataagttagaaacatcttaattttgaactaaaaatttatatccaatgaacatgtaaaaaacataaaaataaatatgtttagggtttagggtttatgttccaatgaacacaaaaagatattgggactatcgggcgctttcctcttgagatacttgtccataacatgtcaattaaataattttattatgttagactatacgtgcactgtacaatagaacaatgtacgcttcaaaagcaatgatagtttgataatagcatagtgtcacagtgtgcttacaattttactagtgatggtcccttcaagagagatgatcaattaaaactgaaacatccagttcttcaaactttaaacggtttaaacactagcttatataaatctggacaattgaaaaggcagtatatgtcaacaggttacaaatctaactaatcaacaagttacaagagaggaggataaattcaaagtttagaactaatcaagagaattagagaatgaataatgataaataccttcatcaatttcaatttggctgtgctgctgtgcattgctcggctgccctagtgccctgctttgcagtccagctgctactgcctgctgcgagcctccgctgctccctgtctccctgttgtctgtcgatgcacgcagccacgcagccactgcgatggcgcgatgcacattcacccgccactacctgcggcgctgctgcctgtcgatggtgcagctggctagagagactaggtgggcgacggcgatgctgcctgctagtgcggcggaatacggatgacgaacagacggggtatcgtggagacgcggaatcgcggtgggaaaaagaaaggaaaaatataaaagaaaaacgggagacgaggagttcagaggtgcggtgatcgagcgagcctcgcgggtcgcggcgcgtcgctcctgggtgcgtgaggtgcgccgtgcgcctcccagctttcctcatgggcctaaggccttcacttgttcgctcatgggccatgggtggtgcacgatcttgagctaagaggttagtccacttagactcccttaaatgtcggccgaatctaaatcgtaacccttaaccaaccggataaaatgactctccgacctattgaaaccggtgcaatttgactccctgggtggttttgcaagcggttttggctgacgtggcgcatacgtgacggtgttgacccggtcttcgtcccacatgtcgtcgacgtgtcgcttacgtggaattagagtaaaaataaaaaaacaaaattctgtaggccccacatgtcattcacacaaaaaaagtgggacgctcgtcggcaccaccatctcctcctcgtcgtcgtcgagcaacacctccgaactccggccaaggagagctcttccagagcaagagtcgacgacgacaccatgcgcgtgctccatcgccgcctccattggtgacgatgtcctgctgcttcatcgccgcctccagcgcccacgccgtcgggccgctgcggggagtcttggcggcatagccagcggacgaaggaggcggcctcgcgagcgcggcagcgcaagaggaggtggccaccgccgctctagcgcccacccccctgcccgtcgcagttgccgccacgcccgacccctctcttcctcttgcagactcgcacgcaacaccggccccggaaggtaaagagaggggggccactgccgccgtcatcaccaccactccgcccggccttcgccaccaccgncgctagcactggatcttgaagttgcggggctacggccgcgccaccgggaccaggaaaactgcggcggccaggggccgcnccgagaagaccttgccacccgccggtctagcggccaccccccctgcccgttgccggccggtggcacccccaaccccttttttcctttttgaaaactggaccgcacaccaacccccgggaggaaaagagaga

SEQ ID NO: 21929 - DNA, 6784 bp, Oryza sativa
  unsure (1)..(6784): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaggaggtggccaccgccgctctagcgcccacccccctgcccgtcgcagttgccgccacgcccgacccctctctttctcttgcagactcgcacgcaacaccggccccggaaggtaaagagaggggggccactgccgccgtcatcaccaccactccgcccggccttcgccaccaccgccgctagcactggatctggaagttgcggggctacggcggcgcaacgggacgaggaagctgcggcggcgaggggcggcgcgagaggacgtggccaccgccgctctagcgcccacccccctgcccgtcgccgccgctgccacgcccaaccccttttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaaaaaagggaggggaagaaggattacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcgaaggcgagttttcctccgcaaagctacatggagtgcgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccgccatggacgtggagtacgacgtgatcgtgctcgggacggggctcaaggagtgcatcctcagcggcctcctctccgtcgatcgcctcaaggtggtctccttctccatctctctctctctctctctctctctctctctctctctctctctctctctcccgcccggatcgatctagctagggcatcgcgtcatggatggaggattaatttccatttctaattgcttgatcaatcgatcccctcccgtttctggctaaccaatcaaataccctttcgtcctttgtgatgccatttttggatttttttttaccgggtaaaattattcgaagaaacgacagatctgatcgtgaatcgctttgtgatctgattaacaatcacaaattcacaaataatgatgtgaaacaaaccagcaattttttttatgttttttgcgagtgatcttgaatttgtcattattttgtcagcgaaaaaaaaaattctcatcagaaaatgatgaaaaacgtgtcccatttctgttttgtcaccaggtgctgcatatggacaggaatgattactacggtggagactccacatcgctcaacctgaatcaggtgacaaggcttcaccctccgtagcaaaaatttgccaacattatcttacctacctgtctgccaacttctgttttcctgacgtgctaagggatgttagaaatttcctcatcaatattagtttcagacaaatttgtgtgaggttggttacctatcagatgaaattatctgatcaagctcattgtttatgtatgccagctatggaaaaggttcaaaggtgaaggtactcccccggcgcaaattggggctagcagagactacaatgtagacatgattccaaaggtcaggcccggctccaatttatatttgattatattctggagtttgtgtgtagtttgttgggcttagatggcactgctctactttattatggagagtggagacatacacaaaaacttattggaacttgggttttaagtgtcgcacagttaaatattcttcgcatgcgcatatgcaaatatttataggaaattctttttagattgtgtgatgattaatttcaccctacttcctttctagttactgacatattgtgaaatgctattttgtctagtttatgatggcaaatggtacattggtccgtgtacttatccacactggtgttaccaagtacttatcattcaaagctgttgatggaagctatgtcttcaataagggaaaggttggattctaattctaatgcgtgtagatcactccataactcaattggcaaatctataatacaattttgtacatgatatttggatcacagatccacaaggttccctctactgatatggaagctctcaagtctccattgatgggattgttcgagaagcgcagagcagggaagttcttcctttttgtccaagattacaaggaaaatgatccaagtacccacaagggatatgaccttaacaaaatgaccaccaaggagcttatctcgtgagtacccatgtttactgctgcttttctacctttttttttatttcacgaagaataagtgcttaattttattttcagatgtaagtagttgatttggtttgtttgtgaaatttatatttgggtcccatatggttcctgtatgtactcagtcgtatcttcagtgtacatttataccacctaaatgatccatgcacaaaggaattgtatggttttatttgtttatatacatatataataccttagaatcaacaaaagtcctgtcaaaaaaaaaagaatcaatgaggggcctcaattgcttttttatatgctctgttcaataaatctgcaacatggtacagtactacagtggtactcacatacggatacattcaggccaacacatacagatacatcaatttaattcctaaattttcataatgtacatccacatggatcaaaaatagctccccttcattgaaatatataaaaacaattatgccagttccgcagctgcacttattttatcatcacagagccatccttatacggtacacttcttcagttcatttatagataagcataagaattaggtgaattttattcattagcgatgaattgacacatcaaacttattcatacaatctgatttatgtttcatatatattttctgatattttggtctatcatactatttgaagaacctgaagttgtagtgcctcttaatgattcaatttattgagacttctctgctcccctttatttttttccagaaaatatggtttggatgataatacaatagactttattggccatgcagtggctcttcataaagaggataactacctgacagaacctgcaattgacactgtaaagcggatgaaggcaagtattgagtctttcaacttcaaaatattagaaaagaagctcggatcaaactagtcctgacagtctgatgaaattccacatcacactttggcgtacatacatcgaatagaacatcagctgggttatctgtggacaaaactaaagccattttagtcacaatatattgctggaaatcacaactatgaacatgacgtgtctctgtcaaccaactaaaccacttcttccaacccgttcgaaactagacattttactgctgttcccatgctatagttagcatatatggtcacttcactttcactcccagatattgccttttacctaacacttctttgaattattgcagctttatgcagaatcagtgggtcgttttcaaggaggatcaccatatatttatcccttgtatggcttaggagagctgccacaggtcattactattaaactgtgtcatcaattccagcaatcacagagatcataaatggttgattttctaacttgtttttatttgatccagggttttgcaaggcttagtgctgtctatggtgggacatacatgttaaataagccagagtgcaaggtataatttgtgttgttattgtgagttgaaccttccaaataatttctttggtgatttgggcatggtgatcacaatgtgaaatgaaaattttaggattttaaggtgcaaaagcaagaaaaaaaatttgaggggggagggcaggagatctgccaatttcattaaggaggatagaaatgatacaagttcgcctctcaaaggttccatagaagaaaaaattaggaatatgatgattattgctttgaaaaggaagaatagatcaagctgtcagagtttgacaaaatatattatgttaacataatccaggcttggatttcaccagttgtatgcatggtagatgctagtgctaatgaattgtggcatgacaatctaaaaattgttctagaagctgtaatgttaaatccatttcagtggtaaatatgtgattttctgatcaaacatacatgggcatattcagatagaatttaatgatgaaggaaaagtttgtggtgttacgtcagaaggggagactgcaaaatgtaagaaggttgtctgtgatccatcatacatacctgataaggtaaaacacttttttttcatacaaacaaatagttgccctcaaagggagtatatcttagtgattaccttcctaattagttaattatactgtacttttcttaagattatttgaaggagacctactatgtctgataaataaattgtcctttgttgcattaaatttatttattacttattcagaatcaaatagaagtatgatgcaatttagtgtctctcatgttagcctcctcagctcttctgtaaatataagtcatcctagaacattgaagtacttctatacagtatctttttcacttttgtcctatatatataaatgatactgttctcatggataaatgacttatcttttgcattctgaataacaatcaagggtgagttatttagttaatttctaagtcccagttctgtttttcaactccaaacttcaatttcctcgttttccgttagcacgcttttcaaactgttaaatggtgtgtttttgacaaaaagtttttacatataagttatttaaaaaaacaaataaatctatttttaaaatttataataattaatacttaataaatcatgtgtggatgatgtttctcgttttgcgtgcaaccaaaatctgtctacaaaaccccacattgaacggggccttagttcctattcacaagtccaaaacaacttatgcttaggattagaggacgtagaagtttacaaaatgttggtactgattagaattatctgctgttatatcaggttagaaaagttggaaaagtttttcgggcaatcgctatcatgagccatccaatcccaaatactgcagattctcactctgtacagatcataataccacaaaagcaacttggacgcaaatcagacatgcaagtattctgtatatcacctctggtttttatccattactgggcattacacctatagattactcttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21930 - DNA, 7227 bp, Oryza sativa
  unsure (1)..(7227): unsure at all n locations
gggtttttttataccccaccacttgattttgccgcacaccaacaaaaatataattttcttttttttggggggtntggtagaaaaaacaccgggagtggttggggagaaaaaactcttttttagggaggtgtttaaaagaacaaaaaattttttttaaggggggtggggccccctctaagttgtggaggcgcataaccccgttaaatatttaaaaaggggggagagaagaaaaatgtttctcccggggtggaccaacacatattcccaaataggccccgcgttggtttaaggggtttggtcaacaacccatttggaacgaccccctcccccaatttaaaaccctccggggtagttaaaaagaccccncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcaaaagggaagttcatcgcgttcgtgtcagcacaagcagagagtgaaaatccagcggcggaattgaaaccagggatagaccttcttgggccagtggatgaactatttattgatacatacgacagatttgaacctactaatgacccatcttcagacaattgtttcatctcaacagtaagtcatcgcagaaatatcaagtgtatgtaggttagacatatgaccaaaaaactgcatttgaaataaacatttaattcgatttgcttttcagagttatgatgccacaacacactttgagtctactgtgatggatgttctttccatctatacaaagatcaccggaaaggtacatttgttttctgttcaacttttaatggctgcactagagtacaaccccaaccttctgaattgaaccttaccagcactaattgaaccttaccagcactatgagttcaacattgtttgcacttgtgctattctaatcttgtattccacgtggcaactataatcaatctattctatcatgagaaggaaatgggcttttcaattccacagatacagtgctttataaaaaggcagctagttgagtagcaaccttgtaagaatatcagtatataactcttagcatcatattcagactgtatcaatcagagtaacttacattccaggatcgcaaagtgataattgaactaatattgcatttttcatgatcttgtatcaacctaaaaaaacgtgtgtttaatgttttaaatttcctttgtctcgatagtgatttcctagttgcttatgctaatcgacatgccattttatccagacggttgatctcagtgtggatttaagtgctgcgagtgctgctgaagatgatctctaatagttattggactgtcctttggtgcacagaggaaaagatttgtgcgttgtttttccattcatattaggtttatatatgattttttttcttttattccaaactatagtggctgagttttattaataatttgataatgctgtatattctaggttcatagcaatttagcctgtgagtaaacagctgtttttgttgttcagtttacttaatttcacctttaaatgttgtggatagtgctaatgaacaccgaactggtacctccaattattttgaagaataccttgtaagatttctataaaatatctttgcaaaacatgttttgagatgcaaattgtcacgtaagagctatgagatacgcgaccatggcatcaattgatcattactatttgtgtcatgcatgtgctcaactgctcaggaaaatcataattactcattccatattgtgaaatatcaggaatttagcatgtgcggtataaattgcgacttgatttccaaaaaaaaaaaaaaatagggcttcagctgaatccccataccccttgtttggtcctcctcagtacgtactgatgagctttatttacagtttactatcttgctttttctccattccatttatctaacatcaggctacatttttatttttgaaatttcatattttcagcgtagttgcaatagagaaactggggttcagctgaaccccatacggtcataccccattattttttttatttatcgtcgacatgactatggtctgatgtccaatctaagccgatttattgaaaggtcaaatgttcactgaggctgtgctcctacgtggagcgttgcttcgttgcgctagcgggaagattcattgacacgtcggcaccatgtgcgtcccaactgagccgctcgggccttcgatgggggacgagttcctcgctcgcgctcaaggacgtgcggcgaagaaacgaggatgcgctaggcagaaataacttggccatccgtattgtagaggtcctgccctggcatcatgtttccatcacatcgtgcgtcagactatgcagaggaggtcacatgcactgtgaagtgcatggcatacggatgcttttggtttgatttcattgcacataccagctagagacacgcgatgcatagtttgcactgctactgccctaagagcaccacgcaacaaaggtgaaacatactggaaacagtaagatacaaatatagtgaagatatgttccaccaaatgtgatataaaaaaatatcgtgcgacttaaaaaaacgtaaaatatctcaaaagcaattggtgatgagcatcgatgtcgtcactacataccacattattgtgattgtgctggtcaaatcatttccattatggtggttttgcaattgtgttgtggtcttcatggaatacatcatcgtcaacacgaacatgaacataggtcgttgcattaccaaaggtcgttacatcacccttgttatttagccttagttgtgtgattactcttcaccatcgtgaatgctacctagcaacatgctctagtcttatatgacttataacaagagagcagttcttttctccaacaaaaactaggtaaacttttagataaaagtggcacgctttttaaactgctaaacggtgtgtttcgtatgaaaactttctatatgaaaattattctaaaatatgatatatatatatatatatatatatatatatccatttttcaagtttgtaataattaaaactcaattaattacacgttattaccaccttttttgcgtgaaacacttacaaacaccacctaaaggtgtgttggagaatactacctccgtttcaggttataagactttctagcattgcccatatttatatagatgttatatgtctagattcattaatatctatatgaatgtgggtaatagtagaaagtcttataatatgaaaaggaggaagtagcagtaatgggcatggaggattgcgctctagtttgtcttcgtcgagaagaaatatcacttcagcgaggaagtgagtgtgaacataacttttgttcgactcaactaaaaattgtctgatcggcttaagtaaaagtaaaaaacacttggttaaagatagcaaatatattattatattctgacatgtttaacttataggtctatctttatcttgcgacttatacattatgatactatctccgtcccataatataaggatttttagaatagtgctaaatcaaacattttttttaactttgactattactagtgaaaacataaaaaaatcaatcatataaaattgataaaattgatgttactagatttatcattgaacaaactagattccgtaattctatttcaaaaaagagtgagactcaatctccttatgccatcccaaaattgatgctactagatttatcattgaacaaactatcataatatgcaactctttttatttaaaacatctcacttttatatatattgttagttaaagtatacctcgaaaatcgtttcaaaatttaaaaatacttatattttgagacgaactaagtacatttcaaatttttacgatcacccggaagatttccctactccaaaatcttacaaaattttaaccatcagattggaatccaacgtcccacatccatccgccgccactcgtctcgtccgtctctctctctctctctacgaaccacgcagctcgactcgcgagctctcgccgccgccgccgcctcttcccccaccgcacgcgcttccactccgccgccgccgccgccgccgccgaggctccagcactgccgttctccgcctccagttcttccctcccccgtcatcttcgtcgtctcgggtgtccggtgccaccgcgccgccctcctgctccatctccggcggctcctgctgcccgccgcctccaccgactaccccctcctccgccctcccgatctccgttccccgcgccaccgcccaccgcggggcctccgccgccccggccgcttccgtctaaccctggatccccaccacgaaacctaactagtaagcgccggagccgccgcctcctccgcctaagttcgctacactcgctggagatggagaatgttactggagaaggaatctcggatcagatagagaggttagcgattattaagattttgccaccattttttttcagtcgaatgttgtgtagcaaaccgattgattttcctcttttttctttcagatttcaaacacagctacaaatggatgggcgagggagaaagcacaggattttgatggtgtcagatttcttctttccaaactttggcggcgtggaaagccacatctattatctgtcgcagtgtctccttaagcttggccataaggtccctaatctcctgaatggtctatttactgccttgttcttttcatgcataattttagggactatattagggtctagatcaactcatggatatgcttttgattctgccccagctcacttgttatatgtagtttaaatattggatttaatatctttctgctataatgagttgatgccaataatggttagaggatttttgttacatatcttatccaatcgttaaatgataggcagagccacacaacggactaaattagtgctactgattttgttgcgaatgtttagacaacttttttgtttgattcccaggtgattgtcatgacgcatgcatatgggaatcgttctggagtacgatatgttacaggtggcttgaaggtttattatgttccatggaagccattcctgatgcagaatacattgcctacattattcttgacatttccgattgtgaggaccattcttattcgtgagaagatctctgtggtgcatggacatcaggctttctcaacattgtgccatgaagcactgatgcatgctaggacgatggggtacaaagttgtcttcacagatcactcgctttacggttttgctgatgctggaagcattcacatgaataaggtgctgcagtttactcttgcagatattgatcaggccatatgtgtctctcacacaagcaaagagaatactgtcttgagatcagggatatctccagagaaggttttcatggttcctaatgcagttgatactgcaatgtttactccctctccagatcgcttgagctgtgatgaaattgttattgttgtgataagtagattagtgtatcgaaagggtgcagaccttcttgtggaagttattccagaagtatgccgtctttttcctaaggtgagtcacaaccatagcactctttggagtcatgcatgaaataaaaagggtgaactatgggtatggtagaatcatttcgttatatgacatatcaacataaagcaaaatgcatacacaatagttgaactctccttatattccatcataactttcccatcctttttaatgttcacaatgttttggatttagtaaatggtcatatttgatcaagtaagcaactgtacgaactgtcaggttcgctttattgttggaggtgatggtccaaaacgtgtgcgaattgaagaaatgagggagaagttttcccttcaggatagagttgagatgttaggagctgtgcctcatgctcaagtgcgatctgttctgatatctggtcatatttttttgaacaggtagctatttaatattttcattgctttatgttgaaacttttttatttccttagttcctttttttcatcagggattgttgatacacgtaagactgctttctgtctatccctttaaattaaatatcatctttcataatacataatgttaactagaccctaatatcattacaaacatagaagaggacatatcccggggaaanttttttaggttttaagcccgggctcaaatttaatgtttgtttggggggttcttttaaaaactcccttgcggccttgtaagtttgagattcttttattgcccccccaaagagcttgagatttatttgggcattggtgatcactgtgtgaaatggttttcgtttcaatttcccccgtaatacgattcggggccttatgtgtaaattcttgggggcctaatgagtaacttactccccattaattggggttgtgtttaatgcccccctttccacattggtaaacctggtcagcccacttcattaatggatttgcccaattccctgggggaggctgtttgcgttttgggcgctctttcgtttcttttttatctattttgtgtcgctctgatcttttggttgttggcaatcgtattactttcacttaaaggttgttatttcgtttttccccaaaatctctgtcatacctcttggtaggaatatttttacctaaacgccctgtcaaggggtctgaaaccttttcaatggtcctgctgtcctgggttct

SEQ ID NO: 21931 - DNA, 6819 bp, Oryza sativa
  unsure (1)..(6819): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttgaacttgagatttggtgagaatgtatttcatatctacacctatctctagtatttttttcatgaatttacaaaacttttaggtatgattttcacgagttttcaacacttagctcattttcaccggatatgtccccaacatagaaatgaacaagtaatatgatatgatattttaacgatggcaaaagttcaactatatggatgatccacaattacgctgaaatttaatctttgccattttagttcgcttacagaggccttttgtatagccattttggaagcagcaagttgtggattgttgacagtaagtactagagtcggtggtgttccagaggtatgtgcatatatgtttatacatttctcttgtagaaaaccctgtactgtagttaattaggaaatttggagttgctgtcaaataactttttcctttttcaggttttaccagatgatatggtagtacttgcagaaccagctcctgaagatatggtacgagctgtcaggaaggctatcgatatgcttcctggcatagatccccaagttatgcatcttcgagtgagtctcaactcttgcatgttgcatgaacttgctgtgcatctgcagtttaccgtttcagctatgggctctgtgcattacatttcctttttttttctttagtttttagtggaaaagtgatttgcaagttcatttatattgatttggttgtttctaatatgtatctagatgaaaaagctttatagttgggacgatgtggcgaaaagaacagagattgtgtatgatcgtgcaatgcagtcaccacaaacagatttgctagaacgccttccacggtgagtatattgcttttgaaacattaacctatttttgtttacaatttttatgcactggggcatcaaatatatagggatgcagtccatctgatttttctacaatggtgtagatacctcagatgtggagcttgggcaggcaaactgttttgtcttgttatgatcatcaactacctactatggtgcctcctagaatatctgcaggtgaatttctgcccatacttttatcatcttctggagatctggaggaaatctaactagttcttttcccctcagcccactgaaggtattgaagaggtcccagatatcaggccagtacatgctcgtttagaatcagtagatgatacatgtgaaactcaaggaaaaggaatttagaatttgccattatcgaatcattgaccagcaccctttcctggtctgtagaatttaccttctctttttaattttacttgccctgaagcccaggaaacattttcgacagtagagtacccatgacctagtcaccccacatttggggaaatcctttgacatgcttttgaaagctatgttgtttgtaaatatcagtggtaacaccactattttgttatgtaagtggatgatccatgctcttgaaaactatgctgttaacgatcaatcgacaacatcctttggatttggaatacatgtactaatatttgttctttgtatgacgccaaaagcaccaaaaaaacaatttggagcgacctcaaaaaacttatcattaagaaagtcccattttgtagacactatgcataatgtcattaggaaaaaattctccagctttgatgaaggctgattgtctaagcacccaattctatgataatcaagattgtaccaacttcaatgatccttccctacgcctgccaattcgaagggaaacgaaccaaacagggtgttcaaaggcaggcaaatgaccggttggaagtgaacaattcctcagtctatatgccccagctagaacggaacaagctataataatcagattccaattccagtggaaaccatccaatgatcattttaaaccagagagtttgatcaaatgttgctgcaaaacattaagaaaattactgcttttggtggacgtagcggttacaaacagattgtttgtgacgttggaactgttaagatctgtgtaacgcaaaacacccgcttgcctaagagccaaattggatggcttatccgtcgatggataagttgatacaaacaaccctaaacaactgcctcaggccagagtgagcatcttcctgtaaagtgcttgctgcaaaataatgttacacttatcttgcaatttgaacgctaaacctaatagtttgccaacatataaatataatgttctatgccacaactcatcttgatttctcagcaactaagtctaagccaatctcaggtacaaccaaaactgacagcacagcaccccgtggcatatgcaattgaagccagtgctcgcacaactcacattcgcgtccttcgtctgatacccatgtcatcatctcgttccacctgttccatacaaaaaaaggagtgtaaataaagcacgtagtatgcccacttatcactaccaattagttttaacataatggaataacaaaatctcaagggctgatgctactatcaatagtagaggcaggtctaacgcaggagacaatatgtataatgtcctcaagaaacagtattgagattgtggtggttgctagctctttacctcagtgataagcttcttggattttttccctatatttgatctcaaatcagaacctcgccctttaggtttctttgctaccggttcatccaaaagatcatcttcatccgtctcacctgcaatcatattttagattctttttcttagtgaaggtcaaattggaaatgacaggctattaaccattttggctggtaaaaatccaacagatgtaacatattagcttgccaaggcatatcaaaatttccttcacatcatcacagtactctgaaatatgttgaagttgaatcggaacaaagggaagtaattaccatcattatcatcatcttcatcatcatcaggaaggcctccaaaatcttcaatgtcttccatgtcatccatttcatcatcaccttcaacatactccacctcttcctgtgttaacaagtgaatccatgataaatggatagttcatgcaaggtgagatgagcaagtctgcactcagtaacaatgcttacttcttcctcttcctcagtaggagctacatcatctttttccatttcaagaatagtgtcaaattctttgaagggatagttatagatgtcaccatagacacctttcttcaaccgttccttcaattcactttcaatattctgcatgacaacaggtacatgttcaataaggcaaaccatcaaagggcgtggatagcatcagaaataataaccttttccaactgagcggccttttcagctttatccattcttctgagatggcgctgagtctccttcctgggcattgtcatcaccttctctctgataaggggagaggaatatgattaatctttccattgcatcagagagaacagcagaaagttcacaaaaagagtatacatcaacaagcaaatcagattataatgaaactattacactaaattataccaccaaagtagaaacttgtgagatattgctaccattattattttttccattagttttaaaaagttctgcaacaatgtgaacacagtgcatctaatacaatcttaagaccatagaacaagtcaacaaaatgtgcaacttcaaaattctgtaattgaatataaccaaacactgagccagttcttattcttaaatcctagtacacaatttggcactgacagtagcgctggttgtggcagtatgaaatacatagaatgcctataagacaatcaaccaaaatcggatccccacccccatctaaaagcaaacctataaatcaatagagttcaatctacagaaatctgttactttatactactatgtttcttttttaatgacaccctacaatccgcatcttcaacctttcaaaagttttactgctaatatatttggaactactgaaaatcacatcattaaatttgtaattaggaatactttcataataatataattttattattatacttaatgcaaaagtataaaaataaatggtcaaagtcacatcttgaagacagaaaagtaaaacaacaaacaagtaaaaaggaacaatgccctttgcaaccaaaacatgctaaacaggtaagtacttcagcaaccatcttcccacatggcatgtatctcagaacagttgtcccagatttaagattttcaacctgatgagttcagcactctaatagaattttatcgtgttcagcttaagaccataatgaaaacactatggaaataaacctaagagcctacctcactttcagttgaagcttcctcattcttatccgatactgagtcatttttgtcaggcgctgcttaattttgtgcacaagtaacttgggccaaaattcctacataatgaaagaaagacaagctatgagacttaaaataaaagttcacatccagatcgaatgacaaagctcgaagtgcatacaagatgcttattgatgacttccattgctttctcataatttctgggtagtttgaccctctcccataatttgttcggaagatgggctctttcagctgttttcatgtataggtagaaaatacctgcaaggccagaaaaaagagagagaaatgaaacagaatgtaacaaaaaaaatattaagatggtatacataagttgggaaagaaccgggagcaaaacaatgtgcttaacaagtatgcttagactgcaatctgtatccttggacgaaaggattctgaagccctcatgtttcatccagagagcaccacataatacagcgattcactcgtaaaaatgtaactttctgcagtaccgagttcttgactttaaaattaactaatgaaataagcttccatggtagaccgcattatcttaaaacagtcattggttgtgtttgaactgagggtttatcccatccatagactcacaatatcatcttgatggcagttaataataacgatcacagtcacgactaaataatttccctcgaataaagaccaatcgtctcccaataacaactgtaaatgtaacccaatgtttccaatagcaactgtaaacataacccaatgcttcctaaagctattgccacaaagggcgacacagtgcatcatcgaaacggttgagctaaaaagatatttcgccccgaaaaatggaggaaagtgcggggtagtagtactcaccgtcatggtcccggatggtggcgtaacggctgttggcgagagggcaggagctccggttgcatattccggtggcgttgtacgggttccggcagaatatccccgtcgtgatcctgccgcaaaaccaaaaccaatttatcgtcagaaatcaaagaacaccacagcgacgagagaaagaagataggattgctgctcgcatacgtacttggccatgaagctgcagtggttgtgccggatgcagtgccatatcacgtcgtcgctcatcttggccgccgccgccgccgcgggctcccctccttcctaagatgctgctattggtactagaggctggttaggcgagagagaaaagcttccagatctacaagggaggagtgagcaagaggatgggcgtgggtacgggtggtcacctcaccggcggctggcggcgcggcgcgggatgcagtgggaaggcggcgcggcgcggcgggcgaacgaaacggggagtcgagggcgcggccgaggagaaggggacatgacatcatcatcatcggctagggcaaattaatactgacaggtaatgggctttggcccactcaaggcccatttattcttagagcggcccaaatccaaccctaggccactatatgaaggaataagtccactttgaccataatctactctgtgatcatgcaccacaaaactagatatcttgacccctatatggtgctgacatggctaacacatgacacctgctttgcttctttctgtctcttgctcactcctccattgtactacctccgtcccaaaaaaaattgcatttctagctctaaggctttgtcccaacaaattgattcatctagataagtttccttaagttctctcagcttgtaatttaggtatgctaattatatgggttaattctctaaacttacttttaatcatttgtatatatgaaatatgtgcatgcaatgggttcattaaataaggtcattgtggtcatttttcaatcctactgttttgtcctaaattagctagaaatgtaatttttatgagacggagggagtattataataggaaaaagtacaaattaattaccccctcccgaactatcacggtcgattaaattacccccttaaaacataaaaccagacatctcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaggcg

SEQ ID NO: 21932 - DNA, 1425 bp, Oryza sativa
  unsure (1)..(1425): unsure at all n locations
ccgtatgatgtcancctactctgnacccactcatcatattatatgattttttagctaaggacgcagtattaaattcattgacattgagagtgtgctccggatgccactatatataaatatataaatagacagagggagggacagggagagagaatgggtatctcaaatgctctgcaatggtgggaggagtggcagctccgggttcttctcttgggcagcctcgctttccagtacttccttttcattacagcctcccggcataagtttcctatccgatcctacctcagatcctttatctggtttgtatacctcggtagcgatgccctagcaatatatgcccttgcaaccctatttaaccgtcacaagaaacaggatgttggtcacacacacaacaacgatgtcttagagattctttgggctcctatcctactgattcaccttggtggacaggatagcataactgcctacaatattgaagacaatgagctgtggatgcgacatgttctcacggcactgtcccagatcaccgtagccatctatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaacggaatctgccctcttttccttggagaaggggggcttttaaatcaccttaggtttaattgggtaggagttgctcaccaggtgttgacaaaaccccttaacccccctcggtttaatgaaatattttggtccaccggggaaaatattttctctggcccccgttaatatatataagcggtttggggggccaaacattgggggggcccccctccacaaaaaaatatgtttctctaaatctctta

SEQ ID NO: 21933 - DNA, 9218 bp, Oryza sativa
  unsure (1)..(9218): unsure at all n locations
tgagtccntttaanccttgggtaagtacgaaggaataaaaaagtacggtacgtacataagcacgcccagccccacgtctttattttcattttttcttctttctcacttattagattagatgaaaaacaaaactaataatttaagctcatatgtaaaaatatatgttattttgagttgtattataaccatatttatgctantcggatcatacccataaaagataccaaaccaanantnncngnnaanaaanaaannaaantttttaaaatttttnaaaaggggngnnaaaaaatttttttttttttttaaaaaaaataattgtatatcactttaagaaattagacttgcattttcaaaattaaaaataacatagtaacattcccaaatgtcactcaccctatttaaaaaaaatactgatacaattaaacaacattactaaatactgattctgctgcccccagactctctctacccgtctctgtgactactactctctggactactttttttaactcatccttccattcttccttgttcaatcgggctaactgtagcaagatgttcccgatctattcgcagcaaaacatcatacgctccaataattctctcagtttttgttttgttcacaagtgaataaatttgtgctgcactcaaaacctgttcacaagtgaagagttgactagttcataggatggagcattttctagtttttatcccattacgtgtctgagtatttccctttttcctggtgagacaagaggcggcaacatgagaactttgcaattctgtccaccccaagaagcacaagaaaagctaggcttgctacattttagtgtaccatagctagcagctctctgattggtatttgatctcgaaccgtagcccagggaggaaaccatgatgttacttggacatatgacgttgatatgcaggcaagatgtatggctaacttgctcaaaatatgacaataatgtaactatttttaccagttttttagtcacttaatttggagttaccgacagatccatacttccataagatctcgacaaattccatgcatctaatccaaaacaaactaattgaatttttataacaagctttagtctttttttttcgaacggctggtcagaattgactggcgttatattgatagaaggacaaaaagtacaaatagccaaagggctaaaaaagagaaaaactgtacatgacaacatgcaaacaagcttgcacgtagccttcctagctcctcatggcaacattctcccaatgtgtttagcgccggccatactccaccaacctaattcctcttggatgcgactaatcatctggtgtactgtcgcctcctttgctctgaagattcttgcatttcgttccttccagatttcccaagcaatgagcaagaagagagctctgagtcctttctgttttgttgcttccgggtcgcttgttccttgtgtccaccaatctaagaggtttctacttgtgttccatttcgggatgatgtgcccttggtgcagccatgtgagaatcccaaaccagatttgctttgagaccgggcattcaaacagaagatggtcgattgtttcgagatttcgaaagcatagctggcagaaataattatttggccatcccctgatctgtaaccggtcagttgtccacacccggttttgaagaaccaaccaactaaagattttgcactttgccggagcccatgcctcccaagacaactttgttgatggcgagagtaccattccattgaattggaattggtacgcggattttgcaccgtattccccattagttgtccattgccaaacaatcgagtcttgtaccccctctgttagttgtggggtgtcacgggctaaaatttcccaaacatggaagaattcatcaagaagaggaatggtgaggctgtggcggacgtcgttaatccatcttccttgttgcagggcgtcctagacggtgcaggttttcctcttcgaatgcctataaagattaggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctttggcatcctccattcgaaccataaccatctcagtcaaagagctctggcaaacttttctaagttcggaacccccaaaccaccgtaccggacaggtgagaaaactttaagccaattgaccttgcattttccgccatgcatattctcattacctacccacaggaaccgccttcttgctttgtcaatttcttgaagagattgtttcggcggtttcagcaccgtgagggtgtaagttgggatggcacttagaactgagttcaccataattcggcgcccccccatgtacaacaatgatggcttccatcccgagaaccgacctttgatcttatcctggagaggctggaaatgcaccttacgtaggcggccaggagtgagtggtagccctaggtaagttagtgggaagctggctcttgcccccgaataactacgcaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcatcaagcgaagtcctcaatctagcatggcgacttccgatgttggttagttgcccaccttcggtcgatagatgtagaagcctttgtagggggtcgatagccaggataaagagatagggggatagggggtccccttgcctcaagccacgtctgtgtgcaatgcattccccctggtctccatttaggactaccttggaagtggcggtggaaaagagcaaacagatccaatttctccactgggggccaaaacccatgttttgcatcagttcaagtagatattcccaggagaccgaatcaaaagctctagcaatgtctagcttgagaaaaagtgttggctttttgctggcatttaggttcctgagcacgttccgaacatacaggaagttgtcttgaatgcatctttttttgatgaaggcgctctgtgcaacagagatcaggccatccatctgcctggcaagccttattgctagaactttggatatcagcttggcgacggagtgaatgaggctgattggcctaaaatcggtcaccaaggtaggggcattcctctttggaagcaaggtaattgctgctctgttgagtgctccaaagtttcatcctgacaggttatacaaacactggaaaacatccatgatatcctgtttaattagctgccagcatttcttgtagaaggtaccattaaagccatctagacctggggccttttctgccggcatctgctttaaagcggcccaaacttcctcctctgtaaaaggttcatctagttcatcggggttaacctgtggtagatccatcgcgttccaatttagggtgcaatttcacgcctccttgttgcctaggattgagttgaaatggttgaaaagcgcgtcacttttttcctcatgttctgtcaggatagcacttgttgtatggagttggtgaatgtggtttttccttctcctcgagtttgcgtgaatgtggaaaaactttgtgttggcatccccttctttcagccatgtcaatcgcgatatctgccttttcttcgactttgccactgctgctagccccaaaattcttagcttgaggtcattcctgagctggtgttcatcagtcgcttattatacgattgagttacggttataaattagagatacatagctggatgcatgagttggcaaaatattcagtagtcattgttacatatctaaccaacgaaacaaaaatgtacataaatcaatcacatgtttttcccccttttttttccctgaaaactatccacgcgtctacaccaaattaagttcataacctcaaggagtgatgagacccatggtggtttacagcgcgtcgcagccgttggaaatctgtgccagtgtcagcctgaccgcaacgcaaaagccggtaagaccatgcttgccagattgccactaatgctgcagcaccaagatgtcaagtgatcgatggacttgaactgaacgctccagcggtaatgctctcggcgactatttcttgagcgacatcttcttttcccgtggcctctcatttctatggcattttttttgttttcggtaagcaataacctcaagctgatgcaatcgtggaagtatatatatagtttatgagagttgttctatatagcatataaatatggtggaaatatgggaatgtgccacctgtgagtattcctttctcattttacatcgtctccgtttgttccactcttgcaattcacactaatgaggaaggcccagcgtacgaatgggaggacgacatatgaacggtcacaaatgcttagttaccggaatagcaacagtctcaacatgaggagttgaaatcttacgaaagaacagtggaccgacaagctacaaatgttgaaagaatagtataacaaaaagtcaaaaacttgatgagcagatagccatatatttctcaccttcgcctcttctaacggagtttctgttagatttaattgggtaatttatccatttaaatcaattaaatcaaataaatttcaaggctcattatgctaggaattcatgtgtattcattctcttatgggacatcaatgggacgaagaattttcagaattattccatttgattagggaattggtaacttatatcaattactcctaattgatggatggttgatggttgtgtagtggaggatggttcatggctagatgatgacaattagttgctctattcctcttcctattccattgcattggtaacctacactaattactcctaattgatggttgattgatggttgtgtagtgaagaatggttgatggctaattgatgagaattagttactctattcctcttcttattccatgactcttactcttcatcttccattcctcctataaaatgagaatggatttgatctccctaaggagaagtgagacacactttcatccatttccaaggctgttgctgctacggtaatcccatcccgacgagtgtatgcacacgcgttgggagagtaggcctccgaaaccacgcactgctgcgacgtatgcacggacgggcgggcgatcaggtttttggggagcgcaagacgagactactcactgttcatcaacgtctacttcgtcttcaccaacatatcgagcactggagacaacggcaacactagagacaaggagaaggaggttcccgtcaacaccaatgaaggcaatactgcctcaaactccagcggaggaccattcggtataaccttcttatattatttcacttagaagttttaatgttaatgttcatcgcaatgtcaacattgcgttattatgtgattgttgatgcttattctacgttaagcatactcatattgattacattcgccactatcattggatcaaatcccattgtaaatatcatgtttattatcttgctattttggattaaaatatgccgaattatgaccaaattctcaacaatccaaaaacctgataggtccttttaggtagttggctttgctgcaatactgaaaccacatgtttttgatggttctaactataagagatgctaagcacgtgcactactgtggttgacagcgatgcaatgcttctatatttcacggaaaaaacgaagtgaactgcctctctctcctgaggaggaggctaggttcgaggattcggattgcctgttccgtggaacattgatcagtatacttgctgacaatatagtggacgtgtacatgcacatgccttcggggaaggtcatgtggaatgcatttgaggccaagttcggagtttccgacaccagcagcgagctgtatgtcatggagcagttctatgactatgagatggtcgattaccgttctatagtggaacaggctcatgagatttagatgctgacaaaggaacttgagaacaaacaactgcgagttgccgaacaagtttgtggcgggtggcattattgccaaatttccaccttcttggtcggactttgctacttctctagaacacaagaggcaagagttcggtgttactgatctcattggctctttgggtgttgaggagaaggcgagagcaaaggacaacagggcaaaaatatcgagggaggttctagcgccaatttggtgcaaaagaagaaccctcacgcatcccacaacaacaacaacaagaaagtcaagcctgatgtcaaaccaaaggctactaccaattttaaggataaaggcaagggaaaggccaagggcgactgctttgtgtgcggtaagcctaggcattgggccaagaattgtcctaatcgcaaggacaagaagtctgccaacatggttattagcgagggcggaggaacatcggggtatggtaaatttttacctacaattctctctgtttttcattcacctgattggtgggttgatactggtgctaatattcatgtgtgtgctgatatttccatgttttcttcttatcaagtcgggagagattcctccttgttgatgggaaacgggtcgcttgcggttgttcatggtgttggtatggtcgatttgaagtttacttcgggaaagaccgtgcagctaaagaacgtgcagcatgtccctttaataaagaagaatctagttagcagctctctactgtgtagagatgcttttagacttgtgtttgaatccaataaatgtgccgtatctaaatatggaacttttattggaaaaggttatgtcagcggagttctgttccgtttttctttggatgacatgcgtaataataataatgatgtgaaccatattagcgagaatgatgagttcaatgtgtggcattcgcgactttgtcatatgaatttcggttgtatgacacgcttggctaatatgagtttaattgcaaaattcactttagtaaaaggttctaagtgccatacttgtgttcaatcgaaacaacctcgcaaacctcacaatgcatctgaggcgaggaatttggcacccctagaacttgttcatttcgatctgtgtgaaatgaacggcgtgttgagtaaagagggaaagaaatatttcatgacactgatagatgattgcactagattttgctatgtgtacctattgaaaccaaaggatgaagcattgtattactttaagatctataaagctgaggtagaaaaccatcttgaaaggaaaatcaaatggttgaggtctgataggggtggagagtatttttccaatgagtttatgtccttttgcgaagagtttggaattattcatgagaggatgcctccctattcacccaatcaaatggggtagccaaaagaaagaaccgcactcttactgagatggtgaatgccatgttagacactgcgggacttttcaaggaatggtggggtgaggcaattttgactacttttcatgtcctgaataaaattccagtgaagcataagaaagtagcaccgttcaaggaatgggaaaggaagaaactaaatctctcatacctacgcacatggggctgtttggccaaggtaaatgtacctatagccaaaaagcgtaaacttggaccaaataccgtagactgtgtgttcctcggttatgctatccacagcgtgggttatagatacttaatagtaaactctggagtacccgacatacgtgttggtataattactgagtccagagatgccacattctttgagtgaatttcccatgaaaaatacacctagcacatctagtcaagaacctgttttaccccatgagcactttgcaccgatagaacacagtaatcaaacgcctgaggaaaatcctgaggaggataacattgtatactcgaaagagtaagagacaaagggttgcaaaatcctttggagatgactacattgtatacctcgtggatgacactccaagaactatagaagaggcatattcatctcctgacgctgactattggaaggaagcggtacgcagtgaaatggactcaattatatctaatagtacttgggaagtcgttgagcgtccatatgggtgcaagcctgtaggatgcaaattggttttcaagaaaaagcttaggccagatggtacaattaaaaagtacaaggtaaggcttgtggccaagggttataaaaaaagaaggtgaggacttttttgacacctactcaccagttacccgcttgaccacgattcgagtactacttcatctggtagcctcttatggtcttctcgtccattagatggatgttaagataggctttctaaattgagagctggaagaggagatctatatggatcaaccagacaggtatgtactagaaggtcaggatggaatggtgtataaactgttgaaatccttgtatggccttaagcaagcatctaagcaatggcatgagaagtttggcacaacacttacatctgctgacaaatgtgtgtactatctctatggcgggggagagggagtgatcttgtgtttatatgccgatgacatattgatttttggaaccagcctcaatgtgattgaggaggttaaggactttttgtcccaaagctttgaaatgaaggatttgggagtagctaatgttgttcttaacattaagctactgagaggagatgagggtgggattacactcgtgcaatctcactatgtggacaatgttttgagtcgctttggttatagtgactgcaagccatctcctactccttatgactctagtgtgcttttaaggaaaaaccgaagaatagcaagggatcaattgagatactcccatatcattggttcattgatatacttggctagtgcaacgagtcctgacatctcatttgctgtgagcaagctgagcagatttgtttcaaatccgggagatgatcattggcaagctctggaaagggtcatacgctatctaaagggcacagtgagctatggaattcactatactgtgtacccaaaagtactggaagggtatagtgactcaaacttgatatctgatgctgatgagataaaggccacaagtggatatgtgttcacacttggaggtggcgctgtttcagaccatcttaacgaggtcaacaatggaagcagaactcacagc

SEQ ID NO: 21934 - DNA, 4007 bp, Oryza sativa
  unsure (1)..(4007): unsure at all n locations
ggggaaaaaaaccccccccgggggggttttcccccaaaaaccccccaaagggggcccccccccaaacttttaaaaaactttaatcgtggcaatagcagtgcccacttgcagcaataacaaaaaaaatatagtggcgatagaagtggccacctatagccaccaaaccaataagcgtagcaataccgatgcccacctatagcaaccgaaaaaattcaagtggcaatagaggtgcacacttgtagcaaccaaacaattctagtggcaatataggtacccacttgtagcaaccaaatattttgagtggcaatagagggtccaactatagcaagagacatgtgtagcgtggcaatagtgggatctatcagtagcaaccaaaactgtgagcatggcaatagaggtcgacctattaccacgtttgaggcttgttgtaatacacgttttgcaacgcccaaaagcacttattaccacgctttgctgcgatgcgactagttcgtacagtaacgacatatgacgttgcaatacgtttctattaccaccaacccaccattgcattatctgttaaattgccacggtttattcagttgcaaaataagtttttatttgcaacggcaaagtgatcaagtggtaaaaaccctattactatggagttttgcgccatgagccctaacgacaaaaatccgttgcattttctcctattgcaacggttttgggcatattgcaacgaattctagccattgcataagtccgatttcctagtagtgtcctacaacaaattattctccaagcacaagtggaactatattattttgaaataaatatgcattataagcatagctaattctcctttattatagttatattgacggtcgaaattagtctatagcgatcatcaacatacattacctttattctatctcttttgatcaaaatattgtgttagtgactatttctataatattgtctggaaagcttaaaaaaacctaataaatgatattacagccgatgggacatatttagggtttgctttacttaattttcaactcacagccgatctggggaaaccaacataggctagatctactattgatacatcatcggcttatcggccaatcatctatcggttatttaactctgttttcttgatttccttgttggttgtaggataaaaccagctggcatgcccttgacccatgaggcaagccttggacctgaacatgagttaaccagatcgcccaagccgccttgttttccgtcaacaaggttttaacgaggaaacagatgcatcacaatattcaaagtgccatgcactcttttctcccaccttcttttccactgggttttcaggtggagtttttgacgaggcatgtgcataattcaaattcgtccaaggggggagtgttatgaaaactattttgttctggacaaattaagatattagtgaaaagcttactgcagaaggaggcatacattggaagccagcttccaagagaagccaacttatgacgtaagctggcttatgagagaaggcaacttacgacgtaaacggcgtaaaccaagtcagcttgtaggagaagccagcttagagtgtaagccatcaacttcctccgccaataaataggaccctgaaggcactacttggaaaagcattatcgcaagcggccgaaaacggtcttcacaggcggggcggccgtccgcctgtaagccaatgactgtgaagatcgccgatcttcgcaagcggtgcggccgtccgcctgtgaagataatttttgcgggcggacgttggctagtccggtccgcctgctaaaataggaatcggccgcctgcaaaaaaaaaaattccgcctgcgaagtttggtaggaaatattggaatttaataataatttgctcgtaaattacttttaaattatttaatagaaattcttgccggtagattattatgtacatatattggaagattatcaaacatttggtactgataaatgtacatatattacataactcaaaagtgttgccaaaaatattacaatatttttttacattgtcacttcaaatacgccatctaattaatacattatggcatagcactgttccactcccaaagatccttgaattcgtcacttgtggctagggcaccctctgggtcgatgaaatctcctttcacatggtagcactcatggtggatgaaatcgcacagatcacgctgaacatttctgatgcctgtatcttcaacgcttgttcgacgttctaatcttggcatctgcatgcattgaagataaccaatatattagtatcataaatatgtgaagctgtctagcacatagtatagatacttacatcctttgcgttagtcctgtacctcccattaactctaaggaattcgcaagcgtaatacccacaaaggaccgttccttgcggttgcttgtgacacttcaggacatatcataaaaaaatagttaaaatttgtaattagtgaaacaattggtatacattaagtgagtggagtattaccggccaataggtacgtactagtagcttctcccttgttcggtctgttctccacccttgaacttgtagtactggtacgcactgtacggatgtcgtaccgtttcacattaaggaggatatttacttataatacattcatataaaaatgcaagagtcataatcacttactactgtaagattattagaaattctttgtatgactgttgtttttaatcgggagggtccaagactaccacggttcagtctttagggtggatgagtaaacagatataatgatcgctaaaataagacatatgcgtagaagataaatgtacgggacgtacttaaaattataagctaccatgacgactctcttattttgaaagtgcaagaaggctcgtccaatgtactgtgcgatagtaatcaacttctccttgtgcaagcccttcttgtattcacctatctcttttgcagtcttgcccttcagctggtcagaccctggtgctagcctcacggtatgttgtgtttggcagatccgagttggatctaagaagccgataggtttcttttttcttcttagtatccatgtattgcatcctacagaagaagtttgttagtaacaatcacatggatttgtattgtacatatttttcatataattaattaaaactcatacttacatgcaccaaacaccgacatagttgacgtccatcttatcccgacgatatatggcatggagatctgagaaatctagccatacgtaaccttgttcgccgaaacaatatgccggtgatcgagctgttatattgcccaagcctttcttactggcctccatgtagaaggtatgttaccttctcatctcccatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggcacgttggtgtaaaaaagattccctgaattacccgtgggctttcgggattaactggccatgataaccccgtttggcacgggcccggtcccttttcgggaaaatgctggtctatccccggcgaatagcatcaaaaccccttacctgtgttttgggaaataaattaagcctttagggcaggaaccccccttacggcgctataaacggggtgtggggttacccaatgggaccttcatttgcaggcctaaccccgctttttgtttttctttctttgcccgatgcgcgttcccaaagtttaagggggcccttgggccatatgatttcgccccgcccaat

SEQ ID NO: 21935 - DNA, 1081 bp, Oryza sativa
  unsure (1)..(1081): unsure at all n locations
tgatgtgccntttgatacctctccgatatctctgtatttcatcatcatttatagtctatttcactcgtcggcgtgcactggtaatcaggagatcaggtctacctaactatcgcttttaaagtcctagaagggtgaatggtgaatggtgaatgagatttttgcgaagcactactcatgattgttcactgaccattcaccacggtccatgttgctcacccgtggcgtatcgtccaacatcctatacagtgagctgtccacctgatacctggagcacctattatggtgtattttgatggaggaatatccctagatgggagatgacgattcaagttttgagtgtgtttggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21936 - DNA, 4979 bp, Oryza sativa
  unsure (1)..(4979): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagctagtgagctcgcagttgctcgggttcgtcttcgagcagcaccggcactgcaggcacaacggcgccgccaacgtccctactacgccgccgccaccgatggccaccaccaccggcttcgccggcttcgtcggcaccatgtcgtccgccacctgggcatccagcgcccatgctagttgattgatacacgcacacacaccgtggtaaattaaatgtgtaatccgtcaagaattacattacaagttcagagatgaatccagatcgagcttagaatatataccttgggattgcacggcgacgacgatgaggaggaggacgggggacgaagctcgagagaggggaggtcatgctcctgcagtagttcgccattgctgattcgatggatattacgctgttgaatgatgtaaatttggaaatgggaatggttgaggagaccgagtggcgagtgacgacgagatatactcgtttatataagcgaggaggcgtttgcatgccaaggcaagaattcatttcctgctaacgttgatatgcataaatttagaggggcgtttaatagattaattctatcctaatttgagcaaaacgctacttcatcgaattcatgaagctctgcgaaatgtatcgattggagctcattgtagatagacgattttcaaatggaccatcaaagctctgctaaatgtatagattccgtgcctaagtgcttatctcgaacagtttccataccagctttcttcttgttctgatcacttctctctttggagatatgcaattagttccttccatattgcaaaaccttatccatttctttagaggaagaaacttactttcttgacgattcaaaacgagctagatggaggtgggggctaatcgaagcccttaattacaacttgggcctaagttgtcaaacatagggacatattgaagggaaaagaatccattttgtttcccccaaccataggcccggcttgttcacatctcttacccgcaaaaccagatagaaagcctcgctcgcctatcaatactggattgttttgtcttatcgagcagtttgcatgtatgtttcgtcctacaaagtgcccacatgcatggcacattgacttgatttttgaccgatgtgacgactacatggcagttctaaggaaaaagtaaaaaatatatagctagacccatgtaaggcccatatgtcagtgaccaccatctgtctcccattcccccctctcctattaattactggactaatgcggtggtgaattgaggaagggaggaggttgctcgtccaagggttgtgtcacatccctttttcaaatttgcctaattttgaaaattcacattcatatttattcgcttaaatttttttaatggaaacttcataaatgaaatatggtttaatttgactaaatcaatcctcctctatcttttctcctaataaatctccaaaaatctcaaagggaatcccactgattttgtcgctgttccatcttggtcaactcgagataaaccctagtttcttcgctgcctctagctatcaaatccccaccggtcacttcctccttggctaataaatagcatccccttgtccgagctcgtcccataccccagccgccttcccgcatgctcattctctctcctccaccatcggcgccgctccggccgagcagtatcattgccccggtaatcgtcagtcaatgccacctcctccttcggcactgcagcagccgtgcgaccggcctccacttcccggaagactaagaccaccgaaagttccaagtgctcctacttgccgtcgtctctagccgagctgcgccgatgatccccgccgaagccgccatcggcatctgaaggacacagggaaactcggtcaccacctcttctttctcaagtcttgttagagcactgtcattgtcgttgacccttgaagcccgtcgctggccaccgttcatcctcatcagtggttgccaaagtgttgttaagtgtcgcctcaccattccttgtccattggtgtcctcagtgtctcgctcctttgttcgccgtgtgccgctgctcctgggtctgcctttgttgatccaacatggttgccacatcagcattttatcagctaatccgtcctctgtggctgccacccaggctccacgtggcacctctctgcatcactagatcagaattgatctgaatagtcagattatttcggtcaacagtggccaatttatcttaggcatccatctctatggaccatagtggacctcctctatggactagatccatggtagacccattgcatcctctctatgacatgcgggtccctcttgtcagtgaccttagcctatcctctctatatggcatgcaataaacagtttaattgttttctatctcttcttcttcttcttcttcttcacaaacatgatacattcctcattcctcattcatcatatccaacgatcaatattcatctataacagatcgaatgggtgagattgtgtcacacccagaaattctcgaaccagaatttctaagctgaatgtgcattaaatccttgtccaggaccagccagggtacacaaacgacaattgttgacatacagacccacgtcttacaaaaatataaaagattataaatgcagcgggaaagataaaagtgagctaaaccaggaagcttgacttcagcagcgggcgactccactccacaggcaaaccttgacggcagcgacgaaaccaacctctctgagacggctccaactgagaagaacttcaactctagtgtgggggaaaagagagcaagactgagtactacccactgtactcagcaagtcataccggaagaggaggtatgatgcaggatataaccaaaggaagctaggggttcttttgcataaagcaggcatttcaaagcagtagttggaagcagtaaaacagctgtagtaattaatcaatattaaccaatcattgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaattgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccgaacacctcggccgacccaattccatcacgcccattctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcactcacagcccgccatttagaatattttaattaactgacacccttgcggtggcaccaatctaaagctatgccaatagtcagagtctatgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacaatatgatcaaaagtattgcatgacttgccttggcttcgaactgatgagaccttagcaaccgctttcgagaaacccgcggatcgacgaaacggcccaaacctatgcgacaaacaaagcacaacagccaaacatgctttaagactattgaaacaggaaacaaaacacttttaatagattctttgcatttttctgatttactggaaatgaatggcttaaacggagctcggtagaattacttaggtatttagaaaaaaaaatggggttttacctataaagaaaaaggcctaattaattattcgccataatattcacgggtgacgtcatacaagggcgcgcacaaggcggggccacaggttaacggtttaaagggaaaagaaagggcccccgcttattggccccaggcgagtgttaaggaggccggtctaccgggacgggacacccgttgggtccacccgtcacaggaacccagaccgaattggtcgggagcccctggacgaccgcgggcgttagagcgctctaattcttttataattggcggcgccctgttaaatgggttacccccatgctctcatcagaatatatggcggaaacaacgatcaggtcataaagcgtgttctcaaagaatcatcttgtggag

SEQ ID NO: 21937 - DNA, 1084 bp, Oryza sativa
  unsure (1)..(1084): unsure at all n locations
tatatgnnnnttttgaagctctctgaatctctcatacctacgcacatggggctgtttggccaaggtaaatgtacctatagccaaaaagcgtaaacttggaccaaataccgtagactgtgtgttcctcggttatgctatccacagcgtgggttatagatacttaatagtaaactctggagtacccgacatacgtgttggtataattactgagtccagagatgccacattctttgagtgaatttcccatgaaaaatacacctagcacatctagtcaagaacctgttttaccccatgagcactttgcaccgatagaacacagtaatcaaacgcctgaggaaaatcctgaggaggataacattgtatactcgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21938 - DNA, 3049 bp, Oryza sativa
  unsure (1)..(3049): unsure at all n locations
aaagtttccggaacctttatgtaaaacaaagggcctggcccgggggtcaccatctttgggcgcgggggtgcaataatatccttgtgtgatgccaaaaaaggggaaagggctttttttttttatggtggaaccttaaattgcggaagtaatagttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttttccgtgagacgtcgccgtgcacacagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattcctcaagattggattaatgatagttcacgatggtcaatcgtgttggttgatttaatacatgcaacataaacttgataaatgttgggttgtgagcacatggttttgagagtcgtgctcatgacaattaagagcaggtcacagagtttaggttgtgaaacataaaccgtgccaaccacaagccagcgtgggcacaggctttaccttttgtatagcatggttcattgcgcagcaccagactgagaagtgccggagataagcccacgggggtcgttgaggagtctataccttgtttataaaggggtgattatgatccaggaacggtgcactgctttgaattgtgttgtgcgaggggaactgtcacagctcctttccaaggtaccgtggtggtattgaggcacatggtgacatgtcgtggggctgtgtcttgtgggtacagtggtacacctctggccagagtaaaactattcgaatagccgtgcccgcggttaagggcgggtcgaacaatgtctttcgtgattagtctcacacttctcatcataataaaagatgctataactggtaataatttgattagctcctggtttggaatggtatattcctggtttgaagatagaactgtgcagccgggatggttgttcagaatggttgggcctatgcaacagggtatgttgtatagcattggattaatattgtttaattattacttaactgttttattaaattctgaaatgtttattaaatgctgtttatgcaaatgaaaccctcctatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctagtcaagctgcctgtggagtggagtcgtctgcgtcgtttatcttattttttccgctgcttagatctttattgattgagaggaactatctacctctgtaatgacattttattcgcttattaattagagtgataattgtactctattatcaatttgttattgtgtgcctcggctgattcctggacgagggttcacacacatgtaagcgtttggaattttggatagaaattccgggcgtgacaaaacttatccaagagaaaaagagtacaatctatccaaattattgctttgatttttgtaattggttttgggtacttgattattcagatcaagcttttgttaatagacatgcaaaatatccccctaaattttgcatctcttttaagtgtgaaccatcaaaactcgttgcgtgtatcatttttttcagacatagtgcgagtgatgttccaatggtcaaatcttgcatgtctatgacttgtagagtttgtatagtctatcagtgctgatgcgacacacatatcattatcttcttaataatgattttggggtttggacaaagttagaaccatgttacttgctagaaatggcgaactatgtccatggaacttatgtattttcatattctaacatagtatggttcactcttcacatggtgtaggcttacaggcctaagcaacataagtttctcccaattttattttaaactcggtccaaagagtgagcctttattttttatatgaggatattcggaacaacatttggtttggggctttaaatacttgtatgcgaatggtcaaacccaaaatattttatgcattattattaacttaggtcaactgcgggtgattttaaccatagcaatgccaagtagttctttggttaaaaggatatgtccataataggtttataccaattccgggaacatgctttttttattggcatggccaatagtggacctctcaattgttggaaaaagtttgtcaaaaaaccaatgggtttttaaaccgattttttggtgtactttaaagaaaaattgttgtgagttacgctttttttgccacctccaaaattggataaatacgctcatgtgcaaccaggttgggttgtgcacacaacaattg

SEQ ID NO: 21939 - DNA, 3243 bp, Oryza sativa
  unsure (1)..(3243): unsure at all n locations
gagagccnnttgtatganctccgttagaaccattcttttactaacttattacattttctctaaacagttcaatttagaccctattgacattttctgttagttgctttattttataacagttcaaaatataggcattatggatatttaaatcattggtttaactataaatacaacaatatttatattagaaatcaaatgtatagcttaaaattcatgtatgcttgaatatttttgattatttctcgctataaaaacaggaagggtagatggagagctcaagcgaagtagggaggtttcggtagtgccatgttgtgcatatgtgtgggggagggcgaagtgcaggggacatgagcggtttttttcttttttttctaaatgatttaagtgaaactgatgatccagtttttctcacaacttttgttattcattttttctaatttttaatatgtaacacatggtggcttaagatttttctaaaaatatatctattggctaaaaataaggatatacctatttaagtagaacttgatggatagatggttttcttccaatctgtaaggttttatttttatttaatgcataactcgtaacgccttcagtgcacttcagaggatatacaatgatttccattgatgtaatacttattttaattttattattaggttctctttcctttttgctatttggttacaattcgaaggatcagtgtctacattcaaatgatgtatttttaattttatagagtggaatgtgggtaacatgggtcttaaaatatttatttaattataaataaaacacaattcagataaagtaaaaattggatttaacttaagaactataatcatttagctttctaattattggactgtttttttacttagttaaaaattaggagatgaaggaattaaatgagataggagaggaagagagagttgaagagaagagattacgccgcatataattataatatttctttttatgggttatattgttttagttggtattacttttttagctaaaaattgataaatgctttattgtatgattaaaatctatctttttttacttgtcttttcctatggtatattcgcagtagatattaaaaatataaacactatattctaataacgttattttgacttattgtaatgttagaatggacgagtaattttttaaaaacattactcagagttaggttcattttgcttttatccatatagatataatttaattattctgacatcatatacgatgataaaatctatatcactatttttctataattttgtattttttcgaatgatatacaaaaataaaatattgttgcccaaattgacagatttcttctcaaagatgaattaccgtggatatgggtctttaaatgtaaaatagtctgattaaatattagttgtgtgatacttgtcttttcctatagtatattcgcagtaggtattaaaaatataaacactacaatctaataacattattttgacttattgtaatgttagaatggaggagtattttttaaaaacattagtcagagataggctcttttgcttttatccatatagatataatttaattattctataattttgtatttgttcgaatggcatacaaaattaaaaaattgttgcccaaattgacatgtttcctctcaaagatgaattaccatggacatgggtctttaaatgtaaaataatctgatcaagtattagttgtgtgaattagatgttaatgttgcttacttttagcataagttttgcttttaaactcacagaatattcattttacttttatcattatggacatagtttaattattatgaagttatatacgatgataaaatctatattattattatttcatacttttcacaattgcttgaatggcacgtaaaagtcacaaaatataaaccaaaatttcatttcttttcaaaagctaaattgtgaaatatgatcttcaactgtaaattgagttataaataatttaaagatttaacgtgtaggatcgaatcacaataactaagccaaccagaggggggtgaatggttggtatacccaaaaccgaaaaattttagccgaaataaaagttgccctcgaaattgacggaagtcagtctgaccaagattgatctgccagtctgaccgagtggatgttgccagcctgaccggtatagattacccggtctgaccgccgatgtcgcctgctgcgcctgtcgccgccgctggtctgaccgccgccttgtcgccggtccaaccgccggtgagtcatcggttagaccgccgaaacccgatgaaacacaaatcgaagaactcttaaagtagatgacgactttattacttctctatgtgtttacaaagtgccccaacagcactccttataaaaatctcgactaaactcgaaaccctaactcaaaactcaactcaattgctctcgaaagcgataccgctaagcctcacgctccccctctattttatacatgaggtaggcagcctaaagccacgaaccaaactcatactaagagtcctaaacaccttaggaaaccctctagtacaagaaagaaactttatataaccaatcgtaccaaatttggactccttccaaattcgactccgcatcccatacgtacacaatacctccatcgtataccatatagaatctccatcaaccacgtgcatcaactctagcctaagtatcccgcatgatctttgaccaccatggacgtcgtcttatccccaagccgacttccggtccatcaccgcaaatattctcccgaggtatcaagtcacctacacatgaaataaacaaagaaaccatattccgagaccaagttatctcaaacttgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21940 - DNA, 1290 bp, Oryza sativa
  unsure (1)..(1290): unsure at all n locations
tgagattnntttttggcgctctcgtgatggatattttactatcgaaacagcaaaaaattcaaaatccagcggtcgccagctaacttcaaacactaaaacatagtaactgaacaatagctgggctggcgatagctagaagcctagaaccagaggaagaatatgcacgaatcactgaggtcgctgagctgaattccaactcgaaaaccactaaatcagagcgcagaaaaagcgggttcgcccatcgccgaccaccactcctcctcgccacaaatttacccccaaaatcacaaaaactcgcagcaacccaaacctcgagcagctagggctagaattcaaactcccgagagcatccggatcagcggggcgcctcacctgcctggagcccctcgaaatctccgtccacgctccccattcctcgccgcccgggccggcgcacggcggcctcggctcagatcgaggccgccgccggcgagattgggcggattcgagctcgggcggcgccgcctcggggcaatgcgggggctggttttgttgctccgccacgcgtctcgtcgccgtcgtgcgcggtgcgccgccccccggccgtgctttgtgttgtcctctgtgtttcgcttttggttttggtttgggttggtttgtcctctcgcgcaggtcgcgggtttggttgtgntcgcgtgagtttttttttttaatttcgttttcaaaattgaaacttcgcttgcgtgaagtttgctctggtcgncgttaccggcaattcgaattngtttaagaaatagtcgnttttttccattaacgtcacaactactcacatgtatatacactatacactatgataaatccctacacagtacacacgttaagactatatatgacacaagactaaaaaagtaccacgttaaaagagagcacgataagtttgttagtacactaaataagtattgaatgatgttgatgaaagtgaagtgggttgaaagttatggtaaagtgagttgaaaagtgaataaagacaatttattgtactttgcccagataattgggtaacccacaatatnttggtcagatcataacgggggtcaagtgttgataaaaataccttggtgcttagatgaaggaaataaaaaattgttgttttcctttgccttttaacagccgacccccccacaactcttttttttnggccgggatgcagcgatgcgccgnaatttagggggggggaaaaacatgttaagaatcggggcggttttttaacctcgcccggaggaatttctccaacttctttccgccgggttt

SEQ ID NO: 21941 - DNA, 2568 bp, Oryza sativa
  unsure (1)..(2568): unsure at all n locations
taaaaaaaaattnntttttnnnnnnctgtcttatctgtgttgagagannanaaaaaaatcctttcccccgnngnnnnaaaaaaaaaatatttttttttttttggatttttcaaaaaccccgcttgtgttgaaaaccttttgtgagggcgagcagagaaaattttttgaagggaggggcccccaattggcccccaaccccttttattcataaaggccagcaagatattgtctgggtgacaaaaaatacaaaagccagcgcgataggggttcncaccacttgttgacgactctcncattaaatctcagggtagtatagacgcctgttncgaagaaagcgacagtacgtacgcaggtcgacagaagccccagacctcaagggaacgctgtatcttatgtctgtcggttcgcactttgtctgagctcattttgtatgctctcagggcgaaacttatgaaaacgcagcaacgcgctttttacggtcttgccttttctggcttttgctccatgtccttctgcgtatccctgatcgtgtgatacgtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagccttacatgcgcacggacggtgtgggaaaaaatgttaaagggtaatgattgttgagtcgcatgtaagcatctaagaagttagtagttatgtaatagtggtatataaggtgatgtgtgattatatcgcaaattgacgaacatttgcactcaacattttgcatattagtttgtactattttttatgtgcaattaccatttgtagggtaacatttacatttttttatattttaaaagttttatttaaaagaggcttaaaaatttagcccgagcaattttttatgttcacttaccacataaaaaattgctactatatgttttttttaaagtagtaatattaatgtttcaaacattgaagtaatatttacatttgaaaagtagtagtcctaaggtttgtctatttgtatgtacaattaccatttttattaaaactactgtagacaatttcaaatcacaaaaattaattaataattattatgaaataaatatactcaacactgtaaaaatcttcgcaggcgggcggtccgcctacgaagatagttatgccgaatagggtttacatcttcgcaggcggaccgtccgcctacgaagatcgtttccctatagaaggacaagctcgcggcaccaaaatttctaagtccaggcgggaaccctagaaattttggcaccgtcaggctgccaaattttttcgcctcccccgtcctccgccgccgcccgcctgcgaccttcaccctccgaccgtcgtcctccgcgcgccgccgaccttcgagctcgcaccgggcgcgcgctccaccgcgccgctagccgtcgatccagctttaccaccaaccgctcccgctgccggccgcatcgccgccgccggacgctccaccaccgtgctccaccgaccgcgcgcctctgccgccgctccaccgctacgccgccgccggcccatcaaccgccgccggccgctcccccccccggcccctccaccacgccgacggtctctccaccgccgccggccgctccacggacgncggcaccatctctctctctctctcgcagtagcagtctcacggccgaacggcttcatcggcctttcatcgtacacgagtgaagacgtcctcggccgaacggcttcatcggctggtcgtcatccatggccgaacctcgttgtcggcctttcgttcgtcgtccacgaccgaagctcgtcgtcggccattcgtcgtccacagacgtgtgtgcatgtgggtgtttctttttatatgtgtgtgcatgtgggtgtgagaggtatatatgtgtgtgcatgtgggtgtgaatgggaatgaanggggtgggagcctcnattaagggcctaacaaactggggaaaatgggtactttattgtcataatttggaccaatgtagccattcatcttgcctggctatcaccgcatatgtccagtaacattatggttcctcctcggctccggtcgggacaaaaacattaaaaatgtgtgcttgttcactaaatgtacaggccaacttncttggttcttggggggaagaatggaaattttatttccccttttgttcccaggaaaggaaaattctaaccgtatgggttaacttaaaatgtccttctggacagacatttccttt

SEQ ID NO: 21942 - DNA, 4473 bp, Oryza sativa
  unsure (1)..(4473): unsure at all n locations
gatgttnnttatgagcgctgtcgtgtgatggatttaacttaaaaatgtatatttagttctataggcctaaactcgtgataaatgttacattgttttgcatgatcgacaagtacaaaaccggacatctcaatcgggctatccgtgacggaggcgagcggcctgctgaacactaggtgagcaataggacactaggtacatgaaggagcacaatgactcaattaaagtggcacgtgagaagatgaacatactgaaagattttaccagcgagtggttgaatccaaattaacaatgtctattcaaagcacctattggagaggatattcaacttcgacaaggacgatggaattcatgtacaaccaagaggacaacttcacaaattgccgcaatctcaaggataccatccattcgttgctgatagagtcattcatgatccacatttagtattggcaattaacaattagttgtatgtccaattgatagtataatgtgatattagctcatccttatgaacccatggggtattttagttagtgtgtatatagtaattttggttgggtggatgagcctggatgggagatggccgcctgattttctgtggtgtttggttggatggcatggtgtatggggcggcccagaatagagaatattttcgcaatatgctggatgagtgcatccgaccgatttggctggatgaagccatccagttttggtctgggtgatgtgtcctgttctgattggctgtggttggtttgattttcggttaagcaagctccaaatgattttttgtcctaaaccgtttatctaatttatgatttgattacaccattatatttgttacaattaaatctttaaaataatatctcggatgattatattttgataaaaaaataatatataacaaatgggtctcactaacttttggctttttccatccatgctacatcctccaatcaaacaagaaattggatcgccatatccatataaaccaaataaaaaattggatcgctatatttaacaaaatatggatgccatatcccatccatgcatgaccgtgaaccaaacccaccctaagtgtcatatggggtactcttgaatataatctccattttggatatcaactactgtgtacactttagtaattaatcattgtcccttgttgatcacattttttgatgtccttttttctcatataaatgaagagtaaatattctgacctatgtatacatccagtatatatccacccattatttacaacaaaggtgttgaatgtggatagaattgattgagtacatcctctccatcttcctttggtataaatggatctttctccacgtctagaaatcgaaccaccataggggttttggaaggatatgacttgtccatattaaatttctccaaaattttctgggtatatgcactttggtgcacaaggattccagaaggtaaatgctcaagttgtagacctaagaaaaatttggtttgacccaaatccttcatctcaaattccgtctttaaatgatgacgtgcttcattaatatcttgtgtattgccaatgatgttgagatcatcgacatataccgagataatacaaaatcttgtgggggactttttgataaagacgcacgggcaatcctcatttttagtgtatccctttagtgaaaggaattcacttaatcggttgtaccacatcctgcccgattgttttaagccataaagtgacttctacaacttaacacaatacatgttacgatttaccttctgattcgggatgtcgattccatcaggaaccttcatataaatatcagaatcaagcgacccataaagatatgctgtcactacgtccatcaactgcataaatagacgattttgtactgccaatgatattaaatatcggaaagttataccacttgtactgccaatgatattaaatatcggagacgattttgtactgccaatgctacaagccttgctttatatctcaccacctcgttgttttcgttccgtttccggacgaaaacccatttgtatcccacaggaaagataccacaaggagtaggcattacagccgagaatacatctcttttgtaaagcgaggctaattctacgtcaattgcgtcgttccatttgttccagtgagagcccttttggcactcttttatagacctaggttctggatcaacttggaggcactcagcaatttgttcagaaaaattagtatcgacaattgtagctcttctattaaaagattctccagttttagagtagttgatggcaatttcatcaacccttatagactcatcgtgatctcctgaaacaatgtgtctatggtcttccgaattcctagtctcaacattgtgcaccaccgagctaggttgtagactatcacgatctgcttgatatatagtatcaatttggtgtgtaccaactaaaggttggtttgcatttaccgtctttctttgcttattaacaattgtttctcgctgagtggccatacttcttcctctttttttagtgagtggaagttgagtggttttatttggtacctccactctttctggcgcattctgagcaggaattaaagatttagtcacacctttataattggtaaatgcatctggcagattattcgcaagtctttgcaaatgtataattttctgaacttgaagatcagtttcagtagtacgtgagtttgtggctggaataccatgggcatcccaattaatttcgtggcattctttctggtacttgaagtctccccctaatgccgggaaatgttcctcatcaaagatagagtcagcgaaccgggcagtaaatagatcacctgttaagggttctaaatactttatgatcaacggagatttgaatcccacatagatccccactttcctgtgtgggcccatagcagtacgctgtggtggtgagatcggtatgtatacaacacaaccgaacttacgcaaatgggaaatacttggaggattcccacgtactaagtgcattggggaagtttcatgatatgcagttggtcgtagttggacaaggtcagcagcgtgcagaactgcatgaccccaacacaatgaaggtaatttgcaattcatcaataatggtcgagcaataagcttaattcttttgatcaacgattcagccaaaccattttgtgtgtggacatatggaacagagtgctgaacctgaattcccaatgccatacaataatcatcgaaagcatgggatgtatattcggcagcattgtccatacagattgattgaatcctatgttcagggtaatttgccttcaaccttataatttgagacattaatttggcaaaggcatggttttgtgtcgatagaagacacacatgagaccatctagtagatgcgtcaatcaaaaaccataaagtacctgaacggtccagattttggcacaatagggccacagatatctccttgaatgcgttcaaggaatttaagtggttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21943 - DNA, 2394 bp, Oryza sativa
  unsure (1)..(2394): unsure at all n locations
tagtggnnttgttggcgctgtcgtgtgatggataatatcgcatatcgaacggatccaagaacacggagacaatggcgacctagatccccaaatcaatcgccatcaaatcagatccaatccgagaacgggtgggtacaggagcgaatacctcggcggcgaggtactcgaggacggcggcgaggtagacgggagcgccggcgccgacgcgctcggcgtacttgccggccttgaggaacctggcgatcctcccgacggggaactgcagcccggccttggagctcctcgacgtcgccttcttcgcggccccggcgccgatcgccttcccgcgtcccgccatcctataccccacccaccgacgagagaagaaaccggctgcgcgagcgagatcgacgcggcggcggaggcggaggaagcgcgcggcgaggcgaggggaggcggcggatgagacgatgttagtggtcgggggcgagagagagatatatatatagggttggttttgggtggtgggtgcgggtggctagccaatgggaggcgatcacgcggatcgtggacgtgggccgtcggatgcgatgggacggacggcggaggatgcgcgtcggggatttcggtggatccggaagcggcgggaagacgggcggagttttcggtttgggagggagggagggaggtgcgcgcgaagacggagacggcggatcggtgacgtggctctctggttttcgtgtcggacccactggtcgatctctcgtcgtggttcgagttttgtatgctgtggcaaattggcaaatagggagacagggagggacgtgaaggagagtatgcaacggcgcaaacgcgtagtagaaagcaatgagggagtagctattttcggcgtagatttattttttttcacgtaccgtttgtcttaaataagtacaactattatccatttaatttaataatttcatctatttttttcttttttcaacatattatataaccccatgctacagagtagtccaacaaggttgtataattcagtgtataaagtggagatacaaagtctagaggtgagactctcttgtcttattcaatccattcaccaagtgtacaaatgactggcccctcctctttttatataatgcattcgcaaatatgcaaggttcggtgatgggtccaattagtgtatttagactaggccttcatggactcccccttgacactcaccgtgtgatgtctatgccctattaaagcttcaaaaaaacccagtcggataaattggagaaatagtacatagcgtacgcatatactccctccgtactcgtaaaggaagtcgtttagtacaatgtttaagtcaaaccttaagaatataaatcatgaataactctcaagttattgagtttgaaaatgtaaaaattatatcgatagatttatcttgaaaaataccttcataaaagtatacatatatcacttttcaataaatatttttatagaaacaagaagtcaaagttgtgttctatacaccatgtcgctgtctaaaacgatttcctttacgagtacgaagggagtatgtcgcacgaattgcctcattaaaacccttaataagaaactagaggaaaacttgtcacaccctaaaaatcctaaatatataaattgttgtttaattggaattattagaatttattttaaaaagcctagaagagaagatctagttttaattaataaattccaatataaaatgaggccagataaaatttcattaaatactttgcttaattctataattcctagatttttctgggatttatttgagctaaggaagtatttttaataaatggaattgcatttcatgaataatttaaattgaaaaaggtttttaaaagtcttttggctttgggccgaaagtcggcccaaaacctctctctctccctcggcccagtcggcccaatccggcagcagncgnccgcgcgcgcgtncgnccgctgacaggtggggcccacctgtcagtcttcggcttcctcgcgccgntgncggcgnccgagccctatcgtcgcgccggcgtcatcttcttccaaattcggccacgcctttccggttccggtgaaatccatagaggggaaatgaatcttcggatctctacctttccctttttggaatcgtcggcttaaattggttggaaattcgtggaattcatcttcaatcggattcgtntctcttcccgaaccctagaaccttctttgncggnggcgggcaaccggggcctttcaacgctggcttctagccccttttaaaaggacccccaagcccgtggttaccggcgcaacccttggctttggctttttgtggccggttgaagcctaacatcgggtaaccttaaggcccccgttgccgcccaaatttccaccctggcgccgccgt

SEQ ID NO: 21944 - DNA, 2629 bp, Oryza sativa
  unsure (1)..(2629): unsure at all n locations
tttttttttttttttatacaggaagttctcttttttcaanagggggtggcacaccatatgtgtttaaatttttattaaaaatggttttgaatataattaaaagaatttgggttcatataaaggggtcctaaaaaaagtttattgaaagaaacaaaannnnnnnntnnnnnnnnnnnnnnnnnnnngaaaagagaagaaagtccttttgaattctttgttggggtgggccacggccccggtaattcataggttttttcccatcaaataaataccccaggggggaagccggtgtattggtccaaaaccccccgcgcgttattttttgacttccgcgagtttccggttgttttgttatccatgantttatagaaanatctgcaaaactattnnnccccaannnaaaannnaaaaannaaaannanaaannnntcaagtctaacatgttacttattatatgtaagtgaccgacaagagacttagatcttcatttaatattctaggctatgtgaagagaatagaaaagtatcatcccttacttctaataacactcactttagtntacattngctagtgtacagttttattgaccaatacccctanncagtgccctcctagggcttcgagagaccaccccgggttgccgagtttcttacgacaacctgtcatggccgtccaactggggctaaatacggagcagtaacctccccagaaaattgtcttaggaatatatattaacgtagaggaatgcccgtactgagctgtcaccatcagcatcccacttctactgtcccgcatcatatatgcccaattaatgatatataataatctaagcaccatgcttatattgtcaaatattactctgtatcctctagaataatatagagcaatcatttgcatgaacattaaacccacaccattgcacctctctggtaggctagtcacacaactatatcaacacaaatacaatgtaaaaccagtactcagataaagtaaagtaccaaaggtatataaagaagaatattctattaattctggaagtcttacaaaataagaaagaaaaactactagagtcataccgaaatcttctgaagactcgaggactccgagaactatcctattctattccacttagcactagagcactaaactaaacttgagatagagatcaaagcttcttgcttgagtgtgtgatggaatgaagaagtgacccctttatatagcctcccaatgacggttatggcagttgaaattgtcagaaatgccccgcaatagtcattgggagtgcatctgaagcgtccacgtggagggacgaactgaacggccactgtcagggttcggccgaacctgggccggcccagtagacctccagatttggtagaggggttgacaggtaagtcctcatggcgtttatgatagttatggcggtatctaggatggttgcacctgacatgtgggcccctttatccttgagcttgcttaggagtgagtttttcttcatttcttcttcatttatgtgctaatctctgcaaacaaataatactctaagtacaagtggaaataaattattctaaaataaatatgcattgcaagcatagctagttctcctttatttttagttatattgacgatcgaaactggtctataacgatcgtcaacaaatccgcccaagcttgaaactttgcttgtcccgagtaaatgactcggaaaaataaacttggttgttgatcaggagtttctaccatgatgtatatctcaaatgtacaagtgcaaagtttgagtactctctcttatattagtaagtaagcacggtggcttacccataagcccaatccccggggaacacatgccttttcgtcactgttgaccgtcgctatcgaacaattttggccgtcaatattactaaaataaggaaaactagtttttcctggcatgccgatttgtgttagaataaaaatattttccactagcactaggctttcaaaacttttgtagagaataaacataaaatggaggagaatcgacaataatttgacgatcattcaatcggacgttatcgagaatcaaacatatggatggatgggccaagaactcagaaatgacatgaccaactgagccaaaattcacgagtctcaagtgaggaacagaaaaggaggccatcgaccaaattgtgggccggttgggccacccctgggttcggccgaacctacccagccgtagcgccaatcgattcaggttttgactagacggctcagatggactccctatgacggttggagggtattatcgacctttccaaccgtcataactcagctataaaaggcattcacctcacttcctccaacacacacctcaagcaagaagaatcaagctctctctctagtttactagtgttctaaagttagtgcagtaggaatagaataagagtcttagtcctagaagtcttcggaaggattcaggtatggttctagtagctctactctcttttgtaagacttgtactttttccggnngctgntacaagtgtcagcctnnnnnnnnggggggnnatttaaattccttaatgttgaatgcaaaaatgaagaggataagggattccttcttaatattacacatccctcttacgttccata

SEQ ID NO: 21945 - DNA, 2584 bp, Oryza sativa
  unsure (1)..(2584): unsure at all n locations
aaaaatagagagagaggggggggcgccaaataataaaaagggtccccccttggggtggggggggggggcacggggggggnnncnccccggngnccccncnnngtggtctttcagatgaataggtatgttttctccaccaacaaggtgtttttttttttttnnnnnnnntngttggggggngagaagagaaaagaaaaaaagatgaggggagaagntgtttgccggccccattcaaaaaaagggggatctattttttttttttnttagagcacccaaaaaaaaaatatttttcaaaaccggggtgcttctctttagagagggtgtctcatagtgttgtgaaaaaagagtgtgaacaccacaagagagacaagggggggttttattcaacaaaattttcttatttttttagggacaagggaatttgtcaaaaaagcgtgggttaagatattaaatccttagtggcaaaataaagggacaataaagtggattacttatgttncatccagtccgcattccttncgttaataaaaattctaagcaattttctgggagggtactggtcngtatttagcnccagttgacggccatgacgaggtgtcgtaanaactcgcaaaccgggttgtctctcgagccctagnaggcactgtaggggtatggtcaataacttgtcacagcaaatgtaactaagttgagtgtatatagaagtaaggaatgattatnttctatttctctttcacatagcnntaganttattaaatgaaagaatctaagtccttctgcttcgtgtcactctaccatataattaaagtaacccatgtttagactttgatatatatatatatatatatatatatatatatatatatatatatatatgtaatatatataagttattagcagatttctctttcttataaatcttccattgggattaaacaaatacgataccttggaatacttccgggtgaaatgctacaatagtatatccgtgcgcttgcggattacttctgtaaccataaatataccagggccatttccacaccattgctgggaattcatatttctagtaatgtcgttaagaaataccaatagctgtcagtctgaccgtcggtgtcccgccggttggaccgccgaacccgagcaaacacaaatcgaagatctctctcaaaatagattgaaactttattacttctctccgtgtttacaaagtgcaacaacaacactcttcacgaaaatctcgactacactcgaaaccctaacttttctctcaactcaactctctcaaaaacgataccaagaggacacaccctccctctctttatatacctgagataggtagcctaaagccacgaaccaaccttgtactagaagtcctaatcccatagaaaaccttcccgtataagaaataaactttacatactccaattataccaaatttggactattttcaaattcgactccacatcccatacgcacacaatatctccatcgtatgccatatggaatcttcaccaaccacgtgcattgatctttagtctaagcatcctgcatgatatcctgatcgtccggacgtcatcttctcccaagttgactcccgatccatcaccggcaacactcacccgaggcatcaaaaccacctatacatgcatcaaccaagaaaccatattcgagcacaagttctcaccaacctgactcattgttagcaaacaacagtattgcatattcatagtacccatctagaagtgataaacatgaattatccacggatatccagcgaaacaatccgaaaccgaaaccgacacagagttggctggtcagaccgtgggctggccggtctgactgcacgcatagctccgatctgaccggtccaaacagtcagcagcagttcctgttcatcacctacaaatcaatcatctccaaaaccacttcgctaataatcttcaaatatcaaaaccaataatatcaaatgccaattggtcatttaaaataaggaccgacacacttttgttttacagcattgattacatgctaatccccaactaggacatttcaccagttaggcttgccagaagtcattccttcgcctatgctatagtccctatgcacttaccgttaggtgttgcctctttatttaatcgnagtgcttatgatatgangtccgaatataantctattctaaacattatgaaaactacaagtnctgctcatcgactacattcacatattcatctcannactcaacatgtnntcttnctacatctcatggnaataggtctncgagggcatgcatttcagaagtaaaagctcntcaaactgatgtgnccatggatccaaccacgaaagctatcttgtacaantgacatcatggacacttgtataagcanggnncaaactangtnngaagggggaaggtcccanaaccanttaggaaatttttagcttccattcattagttnacattagtgtcaccgtccccttnaattaaaattggaaaatggtcggggctttttattgagatgaaaattaccgcggcacttgcgcattaaaagcgggggtggactcagttattccccccgttttttgg

SEQ ID NO: 21946 - DNA, 3547 bp, Oryza sativa
  unsure (1)..(3547): unsure at all n locations
tngaacccgattttttaataggagaataggggtaggagcggcgcgagacacacatctttttgttttttttccccnnnntttttnttttaaaaaaagaggtgtggtgttgttttatatatatagggggaaccaaaannnaagacgccaggggnnnnaacacccacaccccaaaaaatataataaaagtatgtgaagaaacaacccccttttagcccaaaatttttctttacaaataaattaggccacccccaccagctctcaaaaatagactctcgaggaaaaaaaaaacaagatgttttccacccccaaagagaggcgcctcaaccggcgatgaccgtaaaattcaccatacgttgcccttaataccttgacaaggagaggccacacatggtgggtcaacaggcccaaaaactttgagttcctgcacacacgatnaaaagcgttgtaactctgttccccacgtagttccgtgaaagataccttgccttcgtggttcacatgaaagccatgagaatcatgtagtcttctcaactcatatctcaatgcccaacttctgacaacgagtatggcatcaattcacagtggcacttcatcccacaagcatcttagagacggcntttccatcnatatgacntttgagatagagaggcttcatatgacggtntgattcatcgggcttctcaaaaactgcatctttaggacctagtgaaaagtgagcaccttcggcttcatccatagcaaaaattccataggcaacatacataccatgttgatatccatgtcttctttaggagatgactcatctttagcaaccaattgttcttccttcttctctacaacaaccggtttttccttctctatggttttacgcctccataccggtggtggtcgcaactcattgaaccttttatccctttgctcttcagcctttttctctcttatttcttgggcccgaagacgttgcaaccttctcctttgagtagccgttaaatccttaggtatccacctaggtgtcacgtcccaaaacgaccctaaaatatatcctttaaattatgcctagaataattaaaatccgtgcgaaagcctccaaaaattaaaatgtgcaaagtaaaagtcaaataaggcttagaggatttttgtatatttcctaaaagcctaaaatgtgtaaataaattttagtggaattttcagagaacaaataataattgttaagaaataaacaaagttaaaaaaggtttcataaaaagtctccttccctctcttgggccgaattcggcccatctccctcccccctctctctatcctctcccccgcggcccactcagcctctccccgcgcgcgcgccgctgacgggcgggcccgcctgccaccctcgctaacaggtggggcccacccatcatccccgtcctcccgccgctcttgccgccccgctcgcaccaagcgccgccgccgccgccgaatccgccgcatcccgctgtccccgcgtgcaattaagtggggggaattactccccgtgatcccctccccctttcccccccatttttccctctctttctcgcattcaaacggccggatttgctcccgcaaatctcgccggcgccattgatggcggccggacctcccggccgggttccttcctctcctggccgccctctcccccttccaaccctatttaaaccctctccgcacctccttcgcccgtttccaccctttgccgcgccgtctccccgccggaaacgagctcgcgccgtcgccctctctctcctccgtcgccgacgacctccggccggccctctccgcttgccgggactgtctcccgcctcggcgtcgccttctccggcttcgccgcaccgccgtcgaccccgtccaccccctcaccgagctcgccgaccgctggaacgccgccgaccccatcgacccgagccacgccgccgccttcctccgctccggccgcctttttcgtcgtcgccgtcgacctagggtgagccgtggaccgccgcctcttttcccccttcccttcccctctctcggccgccgcttcgccgtgcctatggccgccgccggcgaccatagggtcgcgggcgccgcctcccgccggctgcaccatcgtggccacctacgggcgcgccgtgtggccgccgcatggggcccagccgtcagccggtcgcgtcctcgtgtgtggctgacgcgtggggcccacggcgccggccggtgcgagccgggtgcgcccggtccaccgtggactgtgaggctgccgcgtgggcgccacccccccgtggacccggtccgcgcgccccctcccctcggctgacgcaataaatcttttttaaattaaaatttaaataaagaaattcgcaaatattcacttaaagagcatatatacttcaaatggccataacttggtcatttgaactcggaattggaccgttcaagtctctaatttttccttaagaagtcaagaaccatttttgtgctttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgaacatattgaatcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcgggcacattaggaccggtctttcggccttttgttgcaaagcaataccctactttcacaagtctaagtggttaagcttaatttgtgactcagcttgttataaacaaaaggtcccggttggagaatgacaaatccggggtccatggccattttaggccattgaagcttaccaacttgggtttggattccagaatcattggccagggcgtggtccggggtagggctcaaacggctgcctttcccagggtcccgccaaagggggttggccggccctttggtttgggaggaggggtgggaacattgattgtttccccctttcccgggggattggcactggttttttaagaaaaaatgtttgggggtaatccacttgtacaggttaaccttttcaaagccgccctttttggcgcccccaaggcccaaagggttgaatttaacaccggggaaaaaaatataagggggccggttgttttaaaaaagacccccccggtttatgggtataataaag

SEQ ID NO: 21947 - DNA, 1636 bp, Oryza sativa
  unsure (1)..(1636): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatctatgcaaactctaatcttaccactgccttttttttccaccgggactatactagaaacccactccgcataacgacatggcctaataaaccccgctttcaacaactgatcaatctcctctttgactcagtcatatagcaaaggattaaaacgacgaggtggttgcttataaggcctaaaacccggtttaattggaagccgatgctcaacatgctcacggctaagacccggcatctcatggtactcccatgcaaagcaatcaacatactctttaagtagctcgattatcttaaccttataatcgactctcatatttttgtttacaaaagtcagccttggtttggttccatcacctatgtctacttcctccaatggatcggccgatataaacccttgtccaagcttctccacttcatcaaaatcttcaatagtttcaccaatatcgttctttgtagaccgatattcttgcaccctcttttgtaaccactctaaattagtctctttactcattatacaaatttatatggcttagccatgctacactagccagctttacagatatatgtacaaatttgccattggagatactaataaaatcatagcattgaatatttcccatgacaccactcaaaagtagcatcggccattgcaacccttggcgatggattcggtttaacaattttaacattaatggttgtcccattgaataaacaatgatgccagggtgaaagcgcacaacaattggcattgattccaacacggacccaaaattacaatggtggtaccctgcacaatcgaccatgaagaaaaggcggtgggtacggcttggttcccaaccgaaagctccgcttaaaaagaacacctctgtgcttcggtgggttaacattggaggccattggattatggtaaggttntttaaacaatataatcattgccaaactttttggaaacgaggtttgctataaaatacaatggacccttctttccaaggatctcaagaacacgtttcattaaaagaaccttggaaagaagggtttaattacggttgaataattggctttcaaaaacggtctttgggactctgaaaaggggaacctggttttccatggaaaattcttagccaaacacccagtgttatccaattttttgaaagactaattttgaccaaatggtttcttttttctaaaacgcgtttttttttggtttaccccccaccggggggggaatattaactttatttttgttttacatttttttattttgggccaaa

SEQ ID NO: 21948 - DNA, 1813 bp, Oryza sativa
  unsure (1)..(1813): unsure at all n locations
ntttcagagaananatgaaaccttnaaaanccccnanaattnnananncctcanacaccaaaaaaaaacccccccaaaggatgtcncttttttcaaccctaacagggagaattggcaagcgggcatatgctttgatagaatattatttggcttatgaaccattaaaatctatgaaaggccaaattgtatgtgattttatagtggaccatcatgtagatattgcttatgaggaagagatttgcctagttgaagttataccttggaggatttattttgatggttcttcttgcaaagaaggtcaaggcataggggtagttttgcctagtacgtgaaagcttttggtgattcggaattggtggtgcaacaagtcgccggagtttataaatgcttggacagatcactaaataagtacctcgattcatgtttggatattattgccaattttgataattttgctattagacatattgctaggcatgataattctagagcaaatgacttggcacaacaagcatctggctataatgtgaagaaatgattatttctgatattagaagagcaggtgcttgattttaaatctttgtgtgaaattggcaaaactagagaccaggggtggtctgaccggccacatgccgtcggtctgaccggcgaccccgagtggtctgaccggttcaatcaatttagaggccgaattaattataaattcgaacatttgtgcctaggaaacagaggaagattggaggattcatttgattcgatatttgaaagatcccacacttaaggttgatcggaaaattcggcggcaagcattcaaatacacattgcttgatgaagatttatatcgccgaaatatagatggtgtcttgttgaagtgcttagatgaagatcaatctaaagtggctatgggagaggtacatgaaggaatttgtagagctcatcaatcggcccacaagatgaattggttgcttaggagagctggattttattggccaaggatgattgatgattgcttcaaatattatagaggatgttaagcttgtcaacagttcagcaatgttcaattggcgcccgccgccatgttgaatcctataatcaaaccatggtcgttccaaggttgggctttggatttcattggtcaaatttatcattcgtcattaaaggggcataggttcgtgctagttgctacagattacttcaccaagtgggctgaagctgtgccgttgaagaatacgactcatacggaggtatttgactttattttgaagcatgttatccatagattcggtattccacaaacattaactacggatcaaggtgcttcttttatatctaaggaagtgaagaattttgccgaatcctatggtattaaattgttgagttcttctccttactacgcttaggctaatggacaagccgagtcgagtaataagacattgttgaaactagtgaaaaagaagattgaggaacacccaaagaggtggcatgaagtgctttccgaaccattttgggcgcataggatatctaaatatggtgccactaaagtcactccttttgagttggtttatggtcaagaagccattttaccggttaaggtaaatcttggttctcttcgttatatcaagcaagatgatttgtgaagtgaagattataagacgttgatgggagacaaccttgatgaagtcatcgacaagcgcttgaaggctttggaagagatagagaaagagaagagggtggccaaggcgtacaacaagagggtgaaagcaaagttgttccaagttggagacttggttggaagacatttgcctaagagtct

SEQ ID NO: 21949 - DNA, 2523 bp, Oryza sativa
  unsure (1)..(2523): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatagcatcttttattatggtgagaagtgtgaaactaatcacgaaagacattgttagacccgcccataaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacgatgacgtcggcaatgacgtcatcaccggcggcggctcgggcggcaagctcgccggcgaacaacggcgcgacgacgcgaacggaggacaccaactcgtagagggcaacgtggcgaacttaccggtgaccaaaacaacggcggaagatcaacggacggcgacggcgtcgaggaagaagcggcggcaaccttcggcttgacaacgacggcggtgctccggcgacctacggcgacggcgaaggggtggacgagatcggcgacggcttggtgaccacgacggcgacctcctcgagcagcgacgacgaccggagcgacggcggcgcacggctggagctgcggcggcgacggcggcgctaggctacacgatgctagggctctaccggcgacgagaggcgaaggcgagggtggcggcgggtagcgacgggcttgggggtccttttataggggctaggaggcagcgttgcaggcccacggtgaccggcgacggcgaaggaaggtctagggttcggggagagagacgaatccgattcgagatcgaatccacggatttacaaacgattttagcggacgatacaagggtccacatctg

SEQ ID NO: 21950 - DNA, 1443 bp, Oryza sativa
  unsure (1)..(1443): unsure at all n locations
cagagtgantncagattatttatagccaacttctcttgaaatttagaatcttaaaaatgaatatagtacaaacaatctcacatcgtctattggaacacaacaatggcatatttgtcacgcgcactgtctgagcgcctcgcgccaaacttgtgccatgcatcggcatgaaccatgacgcgtgcaagggccgctactagcgtcgcacactagatgtcgtactatgcactaactcgcaaacccgctataccgagcactggacgaatcatgctgcgctagcaacgcgccatgctactccgaccatgcgccataattgcatcggttgtataccttgtggtcgctccgaccatgcgccataattgcatcggttgtataccatgtagttgctttggtcacgcataccaccgaaccttcgatgtgcatcaaactgagcattacattaattcccacatatcttgaaaggtatgctcgaaaaagaaacggtaatactcacatacatatttagtcctttgaaaggatcatccgatacataatgcgcttatgaaatagctgcaattgtgtctatttgacactacgctcttcccaaaccaatctagcaagatcacacatattggcacctgcacaatgagaaaaagcactaggtaccggaaattggtaatgaaacctattatgggcaatattctcttcatacaacagaaactcattggcattgacctatggttgaaaatcaacctgcaagttgacctatagttgataatgaatggctaaagatatttttggattgagcactcgcatacaagtattaaaagccccaaaccaagatgatgatccgaatatcatcatataaaaaataaaagctcactcttttggaacgagtttaagataaaattgggagaaacctatgttgcttaggcctgtaagcctacaacatgtgaagagtgaaccatactatgttagaatatgaaaatacataagttccatggacatagttcgccatttctagcaagtaacatggttctaactttgtccaaaccccaaaatcattattaagaagataatgatatgtgtgtcgcatcagcactgatagactatacaaactctacaagtcatagacatgcaagatttgaccattggaacatcactcgcactatgtctgaaaaaaatgatacacgcaacgagttttgatggttcacacttaaaagagatgcaaaatttagggggatattttgcatgtctattaacaaaagcttgatctgaataatcaagtacccaaaaccaattacaaaaatcaaagcaataatttggatagaatttggtgcaaaagaagaaccctcacgcatcccacaacaacaacaacaagaaagtcaagcctgatgtcaaaccaaaggctactaccaattttaaggataaaggcaagggaaaggccaaggacagtgactatcttcg

SEQ ID NO: 21951 - DNA, 1635 bp, Oryza sativa
  unsure (1)..(1635): unsure at all n locations
gcccacccgaccggtatcaaacggaggtggcgaattaaatgcccnctcataaacaatggcgcggtctattcacctgtaaaatggccctaactanncccnnnnnnaaggagtgtggcactgtggaaagcaccccncanacgattgggagaaataacccgcctaggcaannnannncagccagggtcacatcatgatacgcacgacagtgcatcactacaagttttactaaacggtagaatgaagcgccggacaaagggggggagcaaaacgaggcacattaggggcacgcaccgaaacaaaagcagcagctgcggaaaaaggctatcctagcggggctaaaggtccactccacaggcaaaactcaactaggggctgagcctgggtcctcgaagtccgtcttcagctcagaagtactacacttctgaaaagggggaataaaagcaagactgagtacaaccaccgtactcagcaagccacaccaacgatacagatgtgcaaggggatacaaggatggtttgtggctatttgcataaaggcggttgtaaaacattttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaagccgtcgcagggcccgccccgctccatcacgcccacccttgcctggatgcgtcagctagaggtaagctacactacaagcccagcccgtgcccacgctggcttgtgggaagtacgattagttctttcaaggcattccgcgaacccgtccctaactacccatggtgcgaccagcaaaaccatgcacccacaggccaacattcagtcgcaatttagtggataattacgaccatgaagcatggcncagagtctcgagcacgcagctctatctgatactaaaaagtctcatactgtatntnccatcaactggagctatggtattaagcatggctatncatatantctagtagtcacataagtacatgagcggcgagcacaatagtatacctggtncctgtatnggccaccctgctatttattggaacgccaaacatcataaaaatggtcaccactccaggggggaggtggatggctctttttncactgactttgaaatttttcttgggaaaccaattccaaaagagttttaactctgccccaacggggaaacttttttaccccgggatgtctaagaggaacacaccgcggctcttttaaaattttagtggggggtcatcggtcgagaaaaaaataaattaaattgcccctaagtttttaattataacaaatggt

SEQ ID NO: 21952 - DNA, 2740 bp, Oryza sativa
  unsure (1)..(2740): unsure at all n locations
naaagatgaaaacaaaaagcggttaaggctcaaatataaggtcattgggtaccccacncccgcgtttaatcgcggaaagggggccattccttgaggctaattaaattcccaaacccggttagcggttttaaatttctttcgggggataagacaccattctcccgataagagagccggcacatgccaattcgttgtcttcatggcaacttttatcccataatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcggccacataaggaccggtcttcgggcctctgttgcaaagcaataccgtacttccacatgtctagtgggtaaggcttagtttgtgactcagtctggttataaacaaaagtacacggatggagatggacgaagtcgggggtcgatggacatctctaggacaaatgaaggctacacgagctgcggctcggtagtcgagatgtcatggcacagggcgggtgtcctgctgctaggggctcaatcctgcctgcctgtcccggaggttccggccgtaggtggggttgggtcggtactcttgtctatggctaggatgggttggaaactatgtcatgtcttccgtccgtatgccgtggtggtatgtggcacgtggttatatgtgaggaagacatgtcttgtgggtaaagatgtacacctctgatcagagtatcacctattcgaatagccgcgtccttggttatgggcaagcctagcaatgtacctaagttagtgttttaaattcttaacacctgttgaacaactaaaatatggaatggatggcctgggttgacttgggacgagttgggaccctgggtcgggttgctagttcggtttgaatcatcgcaggccttgggttaaggcaggttcgtgtgggtccacggccttgattaataatattgtatagctctaggatcgtattaacaaaatagctttgagcaactaagtgtcttttaatgctgtttactgcaaaccctaacccccctatattataactccattgtactcctttgcatttattctgcactcgtgggtgtgtcttgttgagtacggtggttgtactcagtcttgctcaatttttcccaaacccagaagaggagttcctataagatgtaggctttggtatctagctcgtgcctgccgtcaagcgcctgtggtcgtcgccctagtcttccgctgttttttgtttgtcttcatgtgtgctggtccttcgccgcccatgtaataaattaactatttacgcttccacttgttaaactctgtattgtatcaacttttggtgtaccttgcctcctgggacaaggaataatacacgcacgtaaggaacgcccgttgggttatttctggtcatgacactagtgtaacgccccgattttagttcggaattaaaaatcaattaataatgcatttcaagaaattatataaaatttaaatcaatttaatcaagtgaaattatagaggaaattaaattttcctttaaaaatcattggccgagaatattttgtaatattctttgtgccctaatgtactctgcggattttttccgcaaattttcggagctcaagaaatagttttaatagcacaaagatcattgcatcaattaaaataaaaagaaaacaaataaaaatctccttttcctcttctttggncgnnggngcagtncanncnggcgngcgcacccttnctcttgtggtncagnncaagncgnnccttcctttttcccnggacgncacaggtgggccccactgtnnggccngnntcttnnctcannncgggcgcgngccngnaaccggncgcgngtcacgtttncgctttttcaagcacgtaacacagccccgcgtgtgcgctatttccgaaccaatttttanttttttttcggnccgcaccggccccgggcagaagagcggaataaaatttgaattcgncccctttctctccctatcagatgtgcgggaattcgccntaacggcaaaatcgggttcct

SEQ ID NO: 21953 - DNA, 1556 bp, Oryza sativa
  unsure (1)..(1556): unsure at all n locations
actgatgttattccgtgttatttataccaacccgactctttgtatattgcgccaatgcacggcgacttcctaactctttgagactaatgaccttctgagacactgcgtttaaaaagtagcacaatctggagatagccacctataaatgctccggatgtatggtctttattgcaattgccagaaacacagtgagcacgacatgactgtcgcgtgaattatcaccagatactgataaatctttcatggaaactagtccactgatgtttgatgagaaacctatgggcactctgacatcacggtgtgacttgcaaaatgacttctttaccgcaggagttagtgtgaaacaggccggtggaagatatactttgccattcttctctccttctttagggtgtaactcttccctaattcccatctcgactaggaccatccttgattgcagaacatctttagtcttcttcggcatgtccaacaatgttccaactatgttgtcaaacacattcttttctagatgcataacatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctcttatggaatgctggttggcatcaataacctttttcccacttgaaacccctccaaaacggcctggaaaccctgaaatcgcatgagatctcgccctatttggcatggggttaaaattccccaggcgaaaacgggtgccatgaactgtccctaatgccccgtgtaaataaaaacggcggaaattacccagggttggtgttaccaaaacaatatttcatcaaccccttggggatacggcgagttttcccggtcaaccccctttctgtgatttatgtggataaacccgcggaacactgcggggtatcactctcagacgggaaaaacgctcactctgtccttgacaatcgggtgactccggtgataactctctctattatccaccttcctcgtttctagcgccttttattctcgcaacaatcatccgcgtcgcaaaacttaataacggccgcaaacaatggcgtctctttttcggcggcacaaaaggccatatataccctcacgcgtctgatttagcaacgccccatcgcgtaaatccacaaactctttcaagcactcggatataaacactgagcggcgctgctagtattcaaggatcgctcttctttacatgcggatcttatcactcgcc

SEQ ID NO: 21954 - DNA, 2779 bp, Oryza sativa
  unsure (1)..(2779): unsure at all n locations
aggaggccgcactattttgtttcacggggctcgcgttctttgtgggcgaagatggataaataataagacgncggcgcgtgactctccaaatgtgggtttccctaccggatatccccggcactcccgttttttgtagccaaaaagtacgtgttcttttgtcttagagcggagtttatttttcccccgaaacaagttttagggtgtttttatatctttcccggggtttaataaaacctttttttcccaaaaaaggggacccgcccacggtgcatatgtgggtttttttaggcgcaacttttatcccccattaggccccgcgggttaagttcccgggttttttttttcgcagcaagcttgcccggccgagggatccccctccgttgcccggggggttcaataatacctttttggccatccccagccattaaagcggtttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcttatccttcccccttttcgttctttcttcccctcttctcgagaaaagtgcacagtaagtagatgggtagcgattggcgcgcgcggtggctgacagagccgacgacggaatcttcgtgcgcttcaacatgtcaccaaggttgggttgtgggcacggtaagccggaaacccccggcttatcgaacggacggcatggtcaccgcaccggcgacacggccccgtggtggatgtccgagcacagctcccgccacaccagctcgagcgtttggagcgcgaccacgacggtgaatgtccgcagcggaccccgacctcgattgcttgatccctacagcacatcgtcggcgacgatacctcccccatcctcaccgccaagcccatcaccacggtctccaaagggttggttggttaattggtggtagtagcaaagcctatggcctccggtgatcagcttgctcaagctcatgctcgtggtgtgcctccgtgtagcactggcacgacgcaggggaagggcaagtacctgctgttaaagggaaaattggaatcatgtcattataattttataaaatttaagatatgctattctgacccacatgtcattgactcatgtgggtcctacatgttattgagataccgatgacatatctcaaacttagctaaattataatggcatggttctaatttacccgctgttaaatgacgagctcgtctgatcgttgatatggttttaccgaacatccaccatctcgttcatgaacaggtgggtaccacacattgtcgctacagtgttttttcttttttttaagttattttattacctgtcgaactgccctatcgaactgccccagtttgacaggtacccttttgaactgccccagttcgacagggtgctaaacttacgattttgtctaaccgacctataattttgtgattttctattaaaataatattatttccacaaaaaattcactatacataacggaagcaggcgaagctaatccagctgccatgtgtaagtgcacaagtgcataggatcctagctaatagtaatacctgaaataagaggcggtagacggcagcggcagcggcagcagcagcggcgctaggcgatcgcagagtcatgctgcacctcgtgccctactgccatcgaccgttgtgcggagtagtggaaggaaaatgggaagccggccgccggcgctccgatgcgtggccttgcgctgttgcgccgcgcgaattcggcgccgtgaggagaagatcagaagacgtgggcggtggcaatcgcggcatcgtgttctattcgccttctgcttgtggctttcgcgcacaatgcgtttgttcgccttcgtgctgggccaggcctcaggcctgaagatgcctggggtttgggacgggaggccccaccaccccagggggggggggcggcgtgctctggggtggccatgctgtggtacgcataggatgtttgtcttgacgtgcaaacataggttcaaagacgacgcctttcctgtttctctgatctcataaaacctgagtagtcaataagaagaagctaagncattactaaaatttcgaattcacttctatattatgtaaaaggcctgatataggcatgtaattttacccaaaaacttctacaatatacaaaccggtactttgatattgaacatctttctaaaaaaacgtaattttcgagtacattaaaggtacgtgctcatgttttcaaaacaggagaagtttgcatccatttcttagagaacctaatattaccctccctcccctaacacaaaggaataagtttggtttccagttgacccttattaatcaattttttgaaattaaaaaaagaaatgggctaagaccgtnnataatagtggcccaataaatatattatttaaaaattggaataaacatttgaactcagaaaaaatcaaacctctttgggggggggggttttctcaaaaatcaccttttataagaataaagggggggtgggaactttgggggggtttttcgggccaacaaagagggtttttttaaaacaaatatttttttgcttcttcgccgggaaaattaaaaacggatta

SEQ ID NO: 21955 - DNA, 4707 bp, Oryza sativa
  unsure (1)..(4707): unsure at all n locations
tttttttttttaaacagggccggggaactctttaaaaaaaacaccaagaggtttttttcttttccaaaatccttaaaaaagggccccgcgaaaggaaacccttttaggggggtgcccgggggccctcccctaaaatttttggggggggggcccaaaccttatcgcccccaaaggccccccttttaccttccgggaaccccccatcgtgccaaaagaaggaaaaaccaagggcggccaaaggcttgaaagtaaaggtcacgtgggttacccacacacccccgcgtaaggcccgctaaggggggtccttcccattaagcctacattaattccccaaaacccaggttaaggggttttaatgcattttcgcggggtaagaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgattatgacgggttatcgtaagaaactcggcaatcagtgctagcttctcgaagcactaggagggcgttggaaagagggtattagctaagtaatcgtataactaggatgtgtatataatgtgtatgtatattagaagtgtaggaatagattctttctactcttgttgtgtgtcactctaccctatccattatcttaaccactgcttagactttgattattacaagtaaaatataagatattagtatagttctctctattataatctttccacgggattaaacaaatacgatactcttggaatactcttgggtgaaatgctacaatgatatatccatgcgcttgcggatgaattatgtaaccataatataccatgagtatttctacgttattgctaggaattacacttctagtaatgtcgttaacaaataccaacagtcgccttgagtggttggagacagaacagatcatagagtatcattctctcattctttgcttaactcttattccaaaatttttcaaatgattttgcaaataaaatccaagttcctcaaatgattctctcaatcactcgaagtgtatatttattcctcgccaagatattgccttgagcttgcttaggagtgagttttacttcatttcttattcatttatgtgctaatctctgcaaacaaataatactccaagtacaagtggaaatatattattctaaaataaatatgcattgcaagcatattgacggtcgaaactagtctataatgaccgtcaacaacggcatcgcaccgattagaccgacaggaacgtgtcggtcagaccggcggcagcgacaggaggcagaggcgatcgcagggcggttcggctgggagatcaacaccggttagaccagcggcataggcgcggtcagaccggcggatcaaccccggccagaccgatctacatcggattctagggtaacttttaattccattaaaagtttagattttcggctagtttagttcttgctattcgatcctacaaatgctttaagaatgtaggtttaagatgaacctcgtaacaaaaaaaaccgtattatattatatttatttatttataaataaatgcatgtgcgagatggtgatgagctaaggcaacatttttttcctattgattaggggttaggcagggcaaaaagtgtgggtggggcgtgggatttggcaagcgaaggggagaaatgcggtgggggaaggggaggcaatctgtcacgcccagaagtttccccctttttccttgctgtaaatatttgttaaataaatcgtctgaagaaattatcttaattaacctagagctaattccataattaataaatgcaattaataatcggaaatagcgtggtggaattgttccccatgctccaatgcattaacaagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgtgctcggcctccttcctttgggccggcccgttcccctttcccctctctccgggacgctgacaggtggggcccacctgtcaggtcgtccccttcctccagccgcccgccccacgacggcaaccgccgccgaaaccgtccacgccgccgccttctccgctccatgccgcgcccccactccacgtccccacgtcgccgccctccccgccattcctgcccgcacgcgcgcccgcaaatgggcgggattcgatttgaattccccccccccactctctctctctctctccccccacgtcgccggccaaatcggggggtttcccggccgtttccgcccctccctcgcccataaaaaccctcactcgagctctctctctcatttcccccattcaccgtactatcccacgccctctacagccgtcgcgccgcgctcgccgagctccgccgtcgccgcccatcaccggccgcgtgccgtcgacactagggccgccgtcgcgccaagccgncgncgncgctagctccgccgccgtgtgggccatcttgggcaccgcctcgcgtcaccggaaccccaccggaaccccatctccctcgcgagccggtgagctatccattctccttcgtctccggccaacaatggtggccgccgtggtcactctctctactcctaatccttctcaactccctccgtaggtgccgccgccgcccgtccacccctcctcgtcaccaggtcgtcgccgccaccttcatcctccgctccggccgccatactcaccggtgaggatccccccctcctccctcttcccctctctctcatttgcgccgcctctctccacgcgcttgccgtcgccttcggtcgacgccgccgtcctgtaccccgtctgccgtcgcttcccgcgccgccgattgccgtcgccggcgaccgtgcgcgtcgccgccggttgccatggccggccggccggatatgaagccgagctgagccgtgcctagccgccgccgtgccgtccgatcggcctcccggccgatccggaccgtcggtcccgtggaccggcggtggaccacccgcgtggtcccggtccacggtagaccggccaccttgagccactgcccgtggggcccatatgccggcgcccccttcctcttccctttgagcccgtgacccgtgggccccgcctgtcggcgccccctggatgacgtcagcccctgatattattgcgccataataattaaggactttttctttattagtaaaaacacaatttatcctcttaaatacataagtaattcattccagcttcgttaaggtcattcaaggctcagtaaatcaggaaaatgcaaagaatctatttaaaaatggggttgttttctggttctataggcttatagcatggtttgcctgtgtgccttggtttggccataagtttttggcccgttcgtcgattcgcgggttttttgaagaccttgcttgaggcttattagttcgagagccaagcaaggcatggcaaaacgtttgatcatattgtgccccaattcaaaattcccgcattttttttaaagtggctttttttacaaaggatgggggaggggccctttctcaaacccatattggtcacctatgcactggtaacttggtttcaaaatgacttaaggtggcttaggaaaggctatccatgctttgttcaacaagtccacacaaggggcgccactttncataaacatcggctttgtgctacaactaaaaagaggcccccccggggggcggcgagtaaaaatatataatatatgactttgaggccgtggtttttttgttcccctgcgggnataaaacgattacggaaaacattcggtggatatggtgtgtctctc

SEQ ID NO: 21956 - DNA, 2248 bp, Oryza sativa
  unsure (1)..(2248): unsure at all n locations
taaaaacggcttaggctcgaattgacgtcctgggataccacacccccggtttataggccctaggggggtctattccctagagcttacttaatttccagactcagtaaaggcgttttgatgctttcgcggggtgagacacatttctccccaaaacgagcgggcacccgccaaaacgtggtcatcatggcaacttcatcncgttagcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatctttataggcattcgaagaggaaaacctgcaccgtctaggacgccctgcaacaaggaagatggattaacgacgtccgccacagcctcaccattcctcttcttgatgaattcttccatgtttgggaaattttagcccgtgacaccccacaactaacagagggggtacaagactcgattgtttggcaatggacaactaatggggaatacggtgcaaaatccgcgtaccaattccaattcaatggaatggtactctcgccatcaacaaagttgtcttgggaggcatgggctccggcaaagtgcaaaatctttagttggttggttcttcaaaaccgggtgtggacaactgaccggttacagatcaggggatggccaaataattatttctgccagctatgctttcgaaatctcgaaacaatcgaccatcttctgtttgaatgcccggtctcaaagcaaatctggtttgggattctcacatggctgcaccaagggcacatcatcccgaaatggaacacaagtagaaacctcttagattggtggacacaaggaacaagcgacccggaagcaacaaaacagaaaggactcagagctctcttcttgctcattgcttgggaaatctggaaggaacgaaatgcaagaatcttcagagcaaaggaggcgacagtacaccagatgattaggtgcttatgatatgagtccgaatataattctattctaacatttatgaaaactacaagtcctgctcatcgactacattcacatattcatctcaaactcaacatgttttcttcctacatctcatggaataggttctccgaggcaatgcattcaggaagtaaaagcctctcagcttgatgttgtcattggatccaaccacgaaagctatcttgttacaatgacatcattgaccacatgtaataggcaggggcaaagctaggtaggaagggggagggtgcccaggaaccagttaagaaaaattttttagctacaattcatctatgttcacaatatgtccaccggtaccccctcaattcaaactcgagactcgctccggtgctttctacttggagtagaaaataatcccggccattgatcgtatttaatcgtaggggtgagaactagttctacttccaccccaatttattggagaaaaaatgtgggacggctatatttgttccaccgataataaatcacctaagggtattaatcccaaaaccggcattatctaactgttcaccctgtccctattctattctaatcgaggccatttccctccatttgcccgccaaaaacaaagcccacagccttatctgctcgaacccccccccactgtttgtttgggaacatccccaaatagttcatgaaaaaaaggtttctcaaagcgaaaaataacctgccttccttaaaaaaccaagtccccgacccccttttggaggagcgtaaaacagcggctctctgtgtaaaaaaccgcgcccaaacctatccctggcaaagaagacccaacccaccccccggacaaatggaatttccccccccgcgcggggtacccgccctcttatggaactcttattcaaaacccccgacacaaggccttggtgtttctcccactcaccaagtttttaacccctcccctttatccgaagcgagccctcatctttgtgggacttccg

SEQ ID NO: 21957 - DNA, 3049 bp, Oryza sativa
  unsure (1)..(3049): unsure at all n locations
agaaacggtctctggtgcccacggaacaccttctcacaccctgtgttgttaagaggtaacacggttgagacggccccatccattttaaaattacaggtctcaaaacgaaactccaaggggtccgggaattggtctggttggccgccctcatttctaataggatggaaccgtggctttaaccggcgcaaaccccgaagagagaaaggcggccgtgcgacaatgattgtggatgccacacgttggggaacgaattgggatccaccgttgtggcggcgcgaaattgaagaagggccgcggctatcatgatgggcncggtacgggaatatggggcggcaaatgttcggcggcgcaaaagaaggcgcgcccccctggggtggcgtcgttgcgccccacgcgggggaagaaaggcaagcgccccctgggcgtcccctggggggcgtcggttgcgcccaccggcggcatcggtagcaccaaaaggccggcggtgtccgccaaaaagggtgacggtttaaccggcgaaaacggcggcagcagcgaattcgtgggggcggttagggttaaaccctacccccccgacggcttcccctgcttttttgctgagggccggatgggcgggcccaccgccccccttgcctgccagcctagtgccacacggtggtaggccgaatcctttagatttcggcccacacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattctgtattttgatttagcaaattctcttaattatgtacaacataattaatggaggatttaatacatgttccacttcacactttgacttggaaattaatcacatgtcgatggagtcctatactttggtcatatcgaccataacttaggcaacgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctggagaccgtgttttaggcagcaagtataacttgcccaccattaagagatctactccactgtttaattacttggatattatccacattgtgccacctaacattacagaatatgaagtcttacatttcgcattgagattacaaccacaatatcatgtttttattaatttacctctgtaaattaataatgttaaccatgattgtagggacatggcaacaaaagagttcgacgaactcgccctcgatgggactaactatcccatctgggcttctgatatcaaaatcaattttgcctctcgggggattttaaatacaattgaggaacccaatgatggggacccagcaattgagcccaggaagctcaatacagccctttttcttttaagactctacattcacaaggatctcaaacatgaatacatgttagagacgagccctctcaacctttggaaagctctaaaagagcgttatgatcagcaaaaggaactcatttggcctgaggctaattatgagtgggttcatttacgcctacaggactttaaaactatggcagaatacaaccatgctgttcataacatttgttccaggttgaagttttgtgaacaagagccaacggaggtagaaaagatagagaaaactctatcaactatgcttccggaggacagaatactgactcaacagtatcgcgcttacaatttccagaaacattctctgcttatacatacattgactcaggcaaaaagacaccatgagctttctttaaagaatgcccaatagcgcccaccgggctctgctccactgcctgcacttcaatgtacagaataatgctgagaataagaaaggattcaaaggaaattcttcgaataatcctaagaatctgactggaaagcacaaacgcaacaacaacaggcgcaaattcaagggtcggaagaaaggaaaagggaagggtaaggcaccacaacctcgtagcaatggcaacaagcattgcaacaggtgtggatctgacactcatgtcgctaaaggctgccgcatcccgaaacatcttgttctcttgtaccaaaaatccctcaaggacaaaaaaatcttctgagaacccaagatttgaagcccacttcaatcttacacatgaagagtgccctgaggttgcaagttctcaccaggctcctgctgacccagagagcaacctcaatgttctcccagaagatgtcgctccactctctgcgatggatgatatgttcatcgaatactgctcaacggacccacttgttgatgcattccacacttggcatgatcgacttgggcaccccggtatcgagatgatgagaaaaattattggcaactctattggtcatcatttgatcactgataaattttccaaaccctctgatttcgtatgcactgcatgtgctacttggaaacttgatttgagaccatctttatctcaaattagagcagaaccacttaaatcncttgacgcatttcaggagatatctgtggccctattgtgcaaantcttgacccgtcaagtacttnatggntnttgattgacgcatctactagatggnctcatgtgtgcttctatcgcacaaaaccatgcttnngcaantatgtctcaatatanggtgaggcaanntaccctgactangatcaatcatctgttgcatgctgcga

SEQ ID NO: 21958 - DNA, 9582 bp, Oryza sativa
  unsure (1)..(9582): unsure at all n locations
tgggtaaatagagggcctgtgaaaccacccccgcgtgttataatggcatagagggttctctttcctttcgggcggatttatttcccaaacaccgtgtaaaggttttaatgtcatttcggggggtggaaaacccatcttcccccaaaagaagaccgggccctgcccaatgggtgtgttaagggccattttatccccaataccccacgggtaaattccggaagcttttttacaacaagtggccttggcaaggggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatccccgggatcccctctatcttttctcttatggaatcgtcgccaattcggtttggaaatccgtggattcgagttcaattcagatcgatctctctcctccgaaccctaaaccttccatcgcgtcaccggtcgccgtgggccttcgccgtcgcctccttgcccctataaaaggacccccaagcccgccgctacccgccggcaccctcgccttcgcctctcgtcgccggtagagccctagcaccctgtagcctagcgccaccgtcgctgccgttcgtccagccgtgcgccgccgccgctccggtcatcgtcgtcgtcgctcgggaaggccgccatcgtgatcaccaagtcgtcgccgacctcgtccgcccctccgccgtcgctgtcgaccgccggaacaccgccgtcgtcatcaagccgaaggtcgccgccgcttcttcctcgacgccatcgccgtccattgatcttccgccgttgttttggtcactggtgagttcgccgcgtcgccctctacgtgttggttccctccgttcgcgttgtcgtgccgtcattcgccggcgagcatgcacgcccgagccgccgccggtggtgacgtcaccgctgacgtcatcgttgccatccgtcgtaggcctgtcgtggaccgatagatctcggccgttcgtttttggatggatcggtctcggtcgttcgtttccgtgagccgtcgccgtgcacccagtccatcgcgaaccctagccgatgacgcagtaattcccttttccttttcaaaaataattcattattgcgtcataattcaattaaaatccatacaagtgttttaatccgatttaatcttttaaaattcataactaattcatcttagctcggatttagttggttcaagtctctaaatttttctaaaattgagatctacatgttagaaatatccacatgtactgttcatgcttgtttatgtgctgttttggtgattttactcttttctgtttagattccgacgtttccggagagtccgttttcgcaggagaagaatttgaagagtttcaaggccagcaaggcaagtcacacagatcccaaataaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgattgtttagccatgcttagaaacattagcacactattgggataacttataactcactattattcaatgttggcttaatgatagctcatgatggttaatcatgattggttaattaattaatttgccaactaaaacctgataatggtgggttgtgagcacatggttttgatggtcgtgctcatgacaattaaggaccggttcacgagttttggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattcgctcttggtttggaatggtatattcctggttttgagatagaactgtgcagccgggatggttgttcagaatggttgggcctatgcaacaggatatgttgtatagcgttggattaatattttttaattactacttaactattttattaaattctgaaatgtttattaaatgctatttatgcaaatgaaaccctactatgccatcctttgttatcctgtgcacttgcatatttgctgcgtggcttgttgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgagcgtgacaagttctcatctagacagcatcaccacatcactccatgcctcattcttaccattccctgttctagccatggactgtaatcgtcatgcaccaagctctaatcatcttataaaccacaaacacaaaggatacggatgaagccgagtgtccccattgtacatagtattcgagtaatccaattgttttggcattaatagttacaaattctgaaattgaagcagtgacaaataagatggatattcctcatccaaatatgaagacacgaatgagatagcattttcttgggaagaaatgtttgaatcaaaacaagagcggaagctggcgaacaatgagcatgattatgaatgcattaaaacaacagcgaaatttcttcgtcttcatctactagtttacaagaagacatgcatcacattcaccagaaaatatataccccccacaatttccgtaatgagcaactatagggttggcgcacagtatagtagtatagtagtaaactacggtcaagtccgcaatgagcaaaatgtggatgccaaaacttaatttttgcacttgcgaaagggttccgtagagaagtgctctgtaggcaccagcagcgcccaccccatcttgccattcgcacgggagtgccactattgcgaaattcttattggtgttggttgggaacaactataggtgttggtttaacagtaagaatcaacttggaaataccaatgcctaatagtatagatgtcgatttaataactggtacctatataattgataataggtactggttttgtctagtatccagtacttataattgataataggtgatgattttctctaaaccgacacctttaacctattatttagggttttgtagtagtgtgccgacggcattcaggtgccgttgcgtctgccagtttggttttgtattatactagcaagactttaaattgaattatttgagcactattttacgtattatgtattttgttcttttttgccgtgtacggtggcagaacaacatacatacgacaaatgttgggttgtttaatttcatttcttgctctcacttagtgccagacacattgcctagtaaatttcttcactacaagtaaattaaagcagaataaattgctctaccaaacatccatccctcttctagttatatacttcgtcccagggctgaatcagctggagggcttcctgagaaacggcgacagaaatagcatgggaaggttcttcgtcactcaaacaaataccccaaatttaggccttattagttttgaaggattcctaaaggaaatctcaattcctttggaataagcaatattcatgcattcggtttgtaggattcattggaaaattttccataggaacactatgccaatcctccaaaaatcctccaaaatatactaattccataggaatgaaaacattcactctatcctcttttgtttagctcggtggaggaaaaattcctgtgttccaatcctttgttttacacatggattcctatattattcctacgttttttctatttctgtgatttggaaatcctgtgaaccgaataagccctacttaggaagcggcaatgaaaaagaacgcgtaccatggcaataagagaaccttgtaaaagaagaaaaagctcctggaaatccaaatgttaccgacaactttagaacatataaaaataaaaacaagatctttttactaccaatagagaacaccataaaatggatttttttgtacggtggcgctaatacgcgcgctgcgcgtggaatattagtttgagcaccgcacaaccctctctccttccggttttctcttttttattatcactccaccttccatgtttcttttttctcttttccatctcatccgtgcttcatcaaaaggcccggaaaaatattaaccatccatattttttcctctttcattccttctctgcattttctttagcattttagttttctttatctttttagtaaaatatttatcgtgtagtttttctttccgggttttctgtttttctagtgtctatccacgtttcaaaagcaatgaatttactccatagaatttttcatttactcccagcctaccacatctgctcattcaaaagtaacaaatttactcgcatgaatgcccgtcatcatacaacaccattcctagatgtccgtaaaagaattactaccagcttgcaatgctagtaattcttttaccacagttatcaatattgtttagacttcgtgatctacgagtaaaacaacaccttcctctcgttatagcctatgatctcgtagccactatgcagtaatatgttactgatgtgttcaatacacagtataagagtaaaaactaatataggagtattgttaatatccgtatcacaaaatggttgtacgaatgaaaaacattacaggctcaatcacacacgactgttaatataactcacagatgaattaaactaaaaaagaaaaaaataattcagccaaaaattcatgatgacgttgggatcctggtggctttgctggatctttctataaggatagagaggttggtttgtgtcatgtgactggtagtggagagggcaaccaggtgacgagcagtagtcgatgatggaatcatggaaagatgtagcggcgtggtacatagatgagctcacatttgcgcagtagcaaccttccatcatctagcgagcatgaaataaatgcaaaaacattcttgttcatgtcattgagacgacgagcaaaaacattcttgtagcggccccgctcgcttctccgccccgtgcgcgcgcgcgagctgcgccgcgggcccgccatcgcttccccctcccttcgacttcccccactcgcttccccttccatctccttctgccacgcttgcttctccccccatgcacgcgtgcgcgagctgcgtcctggacctgccgcggatgcagccgcttcccctccccgcgtcgcactgcctcccccatcccccacgcgccagccacgccggagctgggaaccctagcgccatgccggcctcaaccgccccctccctcatcctgttcggcgttacatgcggtattcacttcatcccttaatcacgcgtatttacaatagaaaccgccaaatcaattgggtgaggaggcgcactggttaatataattcatgtgcctattctgatttgtctttcataagtctcttgcaaacttgataggcctcttgcaatccccgctgcaacccggcctctcctctgatctatacctccctcacatcaaccgttctgtgtgcaagcctcaaccctgcaccccttcatcctacaggtgcacatcattgcaatcgagtcatgtaaggttagttgtcaaccaacttaatcggttcattgcatgtaaacttatttactgattttatatgtctgaattggttatttgccatgggtactgattttaattcctgaaaaaaagtgtcaatttattctatttggtaaacctgaacttggcatgaattttgaccagattctattggagtatacattatgatttgaaccaagctgaagcattatgaaaggtctatcgattggtttctcccgcccgtccgcgagcgacctgaagcggatgtgggtgcggttcaagaaagcgccgcgcggcggcggtgaccgacattctccctgtgagaagattgagagagaagagaagagagataggagagctgccatgtgggcccaagggcatttttgacattttacacgatnttctctctcctcttcaactgaaattatatttctaatcggcgcggtgtccattggtaaattagcacgtntatggaatgttttccccaaaaatgagttcggacagtatcctacggctaaaagcacgaagtcgnaagtgttctgtagcaaaatttgccataaatatataatagatgtcggttttttcaaaaaaaaattatcttaatcttaatcttaaatatttaaaaaatccataactttctgatcatcacctctctttttttccgtattttcggtcgtaagtccgagagtccgtacattgtcctcccccgcttaagcaaaatcaaacaaaaacagggagggcggatctgcgtgagagagaggcggagagacaacgggaaacaggcgccgacggcggatccacacaagcagcaacgatggcttagagccggtggtcgatctggtcggcgacaactcgggtggaggagggagacagacgaagaaagacggagattggatcagggagagtaggggagaaaggggatttcatcggctagcgatttcgtcggacatcaaggttttcgtatgcccccctctggccggttatttcatcggtgcaggaccgatccgaactgcgccaccaccgctgttgggccacggaagacaactgggccacgcagagttctccccgcattgggccgtcgccgttagatgggccgttcgccgcgcgatcagctcgtgcgcatgtgctaaacgggtcgggccaattttttgggccggttatggaagtaatgggccaaaataaagttttatttaatttcgccgaattaattcatttgattatgtacataattttatttggcattattttgatccatttaaaattgctggaaaattatgatcaattactcagaaaatatatatttatatgtatatatatacctaataaaaaaacacaaaggttccgatttattttggtctgttggtttttttggtttcgtccggttttttgtcgttgttttttcccgaatgcgaactgatctattgcaccgtgcgccttctgtagccgnccaagccgaatctgaccgattggtgatctttctggactttttattccgaattttaagctctaatatggggaaaacagaaagggcatactagcgtagggctaaataagaaggaagaaatgggctttcggtgcaaaatcaagaaaaaaatttcatcaacttttaaattatagtgtatagcaatcccaatattaaaattctcattaaccttttcaatcgacaatcgcaatgtgtagcgagagggataagcctatctaaccaggccactgatatttttttaaaaaaactacaattatagtagacttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21959 - DNA, 1081 bp, Oryza sativa
  unsure (1)..(1081): unsure at all n locations
gagattttgacngatcttgtacataaaaaatagtacaaactaatatgcaaaatgttgagtgcaaatgttcgtcaatttgcgatataatcacacatcaccttatataccactattacataactactaacttcttagatgcttacatgcgactcaacaatcattaccctttaacattttttcccacaccgtccgtgcgcatgtaaggcttcatggtcttctaagtagatgtctcaacattcttaatcttctgtacaaactgactataaagtggcatactatcatattgattgtaatcttcgacatcttcaaccccatccactcccaatatcttttgtttcccgggtagcactatatctttcttaaaatttgaagggtctttcacataaaacacttgtgccacgcgattggcgagtacccaagagtcatccttgtaacccacactcgctaggtcaacaacagtaaggccgaacttatcaacattgaccccgttcgggtattttacccactggcacatgaatatggtgaattgcattgtgtgcccatagtcgatttcccatatttattcaataaacccaaagtatgattgtttttccccggctttatcaattacctccacacggacaccgctattttgtgtacatgttttattatctcgggctcttgtactaaacgagtatccattaatgtcatatccctgccaagaatttactgtagttgatggaccacaagccaaccgcttcatagttatttcatcggtagtttgtccctcaagcaagtctaggtctcgcaaccaatctatgaagagtcgcttgtgttctttcattatctactcggtggtgcgacccttattgttagctcgtattagttcgatatgttgttcgatgtaaggctcaacgatagcaaactgatgaaggacgctgaagtgagcttcttggaatgatttgtgatcatgggtgatgaatctcttctttcctatcgttcccttgccactcaatctgccctcgtgtcggggcacaggtactccaattgcatatccatctttgaggtaatcgatacagcactcgacaaccgtncacatctc

SEQ ID NO: 21960 - DNA, 2655 bp, Oryza sativa
  unsure (1)..(2655): unsure at all n locations
aagatatgaaacaagagacgaagagacgaacgggaggaaaaangagagacaangccgacgagatagcacagagatagacaggagagcagaggacagaggccgngcacacagtaaaagnggaacgggngcgngngnnnnnngnnnnnnnnnnnnnncnncgnnannnnnncgcagcagancnncnngacgnnnnnnnnnnnnnnnnnggcgacacgatcccgtagatattcttgtgaantnnnnntntttnnnnnnnnttnttttntnnnagnngcngttgtagtatatatacatagtgtagacagagatattttcttttcgngcaacaaaacacatgtttgtgtagaaatcatctgtagtaggagagaatattttgtaggagaggccccaagtacccacaccctttatatgtagagcagagaatttttcgggacacaatattaagaacgaggtggataggggtgcccaaccggtgacgcctctccgcgttaaatccgcggttatataaaacctcntttcaaaggaaaaagcacagttcgtatacncaggtgaaaagaagcccagaagttttncggggaacacgtgtgtttatatatcnctggggtttgccacccatnaatagacggtcattatgtgagatctgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaggccgtcgcagggcccgccccgctccatcacgcccacccttgcctggatgcgtcagctagaggtaagctacactacaagcccagccgttgcccacgctggcttgtggtaagtacgataagttcttccagggcatcccgcgaaccggtccttaactaccatgggtgcgaccagcaaaaccatgcacccacagcccaccattcagtcgcattttagttggataattacgaccatgaagcatggccagatgtctcgagcacgcagcttactctgatactaaaaaggtctaatactgtaattatcccatcaactgagctagtggtaattaagcatggctaatcatatagttctaggtaggtcacataagtaacatgagcggcgaagcagataggtaatacctggatcccatgtaattagcaaaacatgcatatttatttgtaaacggtaaaacatttataaattgggatcaacatgctcaaggggaatgtgtgacttgcctttcttcttcacttggatcttctgaactcttatccttgcgaacgcgaacttccgaaacgacggattctacacgctggcacgcaaaacgaggaaaaactctaataaaaaccaaggaaatagtacataaaaagtaaacaaacatgtagagctcaattttagatgaattttgcaagttgaatggctcaattcggagttcgaatgaattagatatgaattttagaagttttgagccatttaaatgaatttctagaattattaacgaattatgatgtaattattatttatttttccaaagaaaaagagggttgctggcgtcatcaaaggggaggggcggcgccggcaagcgggccccaccggtcaacggcacaagggggagggcggttcaccgtggaccgggtccacgcgggtggtccactgccggtccacggaaccgacggcccagatcaccctcggggtcgatcggacgggcggcggcgacctggctcggctcaaggccggccaagcggccacggcgacggcgacggcacgcgcgaacgcgttgccggcgacggcaaccggcggcgnagacgagnngtacatctca

SEQ ID NO: 21961 - DNA, 4009 bp, Oryza sativa
  unsure (1)..(4009): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaggtatttcctanngnnnttttacgaggggatattaacccacnntttttttttnncttctttgccagcggagattgtgccaggcgcgtttgtttaaccatatatagacaagtttgtgtttttcaacaagattcaggggcttgggtgttgagagaggaacttaattccaacccaggtttcccaaggacccgaaaaagattcnaactttggggtatcgtgcaaaaaaccgcaacggtgtgtgcggtcaaggccatcttcaaggatcgtacagaggcaaacaacgtgtttatgtacggatagccacttcaanttgtagcggctataccggttgnaatctgtacagtgttntgcagggaatagtcgtctnacnggtgaccccaacnaagtaccgataagccacggtccggtnacgggggtcgtgcaccagccagcttgacgaccgacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccaccttggatgacggcggtttcgtcatggcgaaatcgaagttgagttgacgttgaacggatctccccagcgaagtcgccaaaatcgtgttggcaactttttgtgataagttgacaacaacgattgcaacaccttatgccttgcggtgatcctattgtcacgaaccacctcgatctagcaaagagccaaacctagatgggttttgacaaataaaccggctagcggagccaatttaagataattacccgtctcgtgggcaaaacggaaggttttcaggacaaacctacaaagagatgttgcactctcgcagcggcggcggacggtttacggcgcaaaccgacaaagatggacaaactaagagaaaactaaaagcaatatgaaaaacgattgaattgattgattgtagattggtttcttacaatagaactggccatgtaccttatataggggttggtcttgccctctacaggccctcctccatgtccaacttgggatagaaactaaaggaaacctgaaacatgccttcccgagcaaggaaacctcgagacctgacgaaacacagtcggactcggacctgccggtcagaccggccacacaccgccagtctgaccggccctcaactggcggtctgaccgcccaacacacggctgtcagaccggccgactcgaaggaaaccgatagacttctaaattttggcaatctttcttattttgatcctaggtgccaaatttgggtgtaaacacgtacttagtaccattgaaaaaaattgatgatctttaaatatgagtttctattatttaaagataaaacatacgattctataaatttacgtaaatatcattcatgaaacgtcctataaatgatctcaaaccatcatgtgttacttgtacaaacactactagaccaccacgtgacactgtcattgtataaatttacgtaaatatcatccattaaattttctatgaaagctctcaaatcgccatgtgacacttatacgaacgctcctaagctgccacgtggaactgtcaaatctcaccgatgattttcactttagcagtggatccgatattttaaaccattatattattatattagatgtattttattttaaaaactaattccttaatccatatatgtatatgggagaattatataactgtactagaaaaaaaatacttgtccattgctacggatgaaggctattttaatcttattcttattatacggtttaactaggatgaaatttactctggaaattcgcttttttttttttgaaaatcattagctgcaattaggagtctgactttcatctcaagttagcatgcgagtttgtttaaagatattttttatataactatttttgtacttccaaaaatgaacgaacataaaaagtgactcaaacaagaatcaatattttcaaaaacgaacgaaattaataaccgactcaaacaagaatgacgtaccaaaatatcggcaaaaaacttctttaatttttataatagtggagaagtatccatacatacgtacgactgaaaaaaacaatgaagctttacctactgttcatctaaagaaacaaataaacttacgcacagacttactataaagatcaataaagcataaaaaaaacatacgtacttagtaccattggagaaaaatgacgatatttaaaatatgattttctattatttaaagataaaacgtatcactctataaatttccataaatatcactgttgatttcatttaaattgataggcccgatcgattctttagaacattggataatgtatacattatatactaaaagtccattaaacttcctaaaagtgctcctatgttgtcatgtgttgttctacaaatgatactatgttcatcacgtgtcagtctaataaattactgaaatacttaagaaatctagaaaaaaacaaagcaaattttcattaaatttgatggacccattatttataactattggattatttttttttagaaaatcatctccttaacccgggcctacctaaaccagtacgtataagtttcattttttttaaggaaaaaacaaacgaatatatgtatgtatgccccctcttccctcaattcttttctctacatttttacccattccttcttctatttgcatgctttattagttagaaaagcaacaattatgtgtaaaacaataaagcatctacatcatataaataatttttgatccgttatgtaaaatcaaaggtgtttttgattattattctgtgatgaaaaattggcattgaagattattggttttgttatttagaatttattcacgaagtggatttcagaggtgattacaggttcattatttcatgtgaccgatcagaccgggcaggtgttgccggtcagaccggcgtgtaatgcgcggtcagatcggcgcagcccgcggtctgaccggccgactctgtgtcggtttcggtttcgagttgttccgtgattatgtcatgattatgggcttctagatggatactatacgtatgtaatactgttgttcgctactaatgagtcaagtttgagataacttggtctcggaatatggtttctttgtttatttcatgtgtaggtatctacttagaagcccatgaagccatcagtttgtcaacaatct

SEQ ID NO: 21962 - DNA, 1645 bp, Oryza sativa
  unsure (1)..(1645): unsure at all n locations
cagagtantagcccttgtgtgatggatgtgtacgtttatgcctgcacatgtattcggataaatctaaattcttaaaaaaatagatccactatatttaacgaatatcaatggttaaatgttttcttttttcatagaatttttaagaaacttttgaatttataagagtgtcacgtggcggcttagaagcgtttttaggatgcgacgtagcagcttgaagcgtttgtaagaagtttaatggactctagtatataatagatagatagatagatatatgatctgtttggtacaggtctagctctagctccatgtctcctagagctggagttcaatcaaacagtttcaactatacgtaaaatcttagttattaagaccggactggaccagcggttggaccggggaaaaaccggaaccaatgccccaaccggtccggtccaggtaaaaagaccggcatgcaatcggcccagcaataaaccggttagaccgcctggttttagagaaaaaacgccattaaaccggggaataaaaccgcttccaaccaggcttggcggctgctgtacgcgcgcatgggtgctgttgggggaaaaatgagagaaaatgtgcatgggtagcattcgaaccggttagactgcctggttttagagaaaaaccgcctggttttaaagaaaaaacgccattaaattggggaataaaaccgctgttgggggaaaatgaaagaaaatatgcatgggtaggattcgaacctagaaccataaacaccccaaccaccaggctatcatgtcctttgtgtttagatagaatgcttaatgtatttaatagttattgaactggattaaaccaacggttcaaccagttgaaccagtgaaccattgaatcgagagcctcaccggttcgattaccagtccggtcttaataactatgcgtaaaatgggagtgagaggagctggatggagttctctttactaaatgaactatagaggtagagctgggcttaggcaactctaaaactccactccagacctaatttctagagttaaatttaggagttagaaatctactaaataggcccataaatttgcaattcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaatagaggggaaatgatcnccgggatcccctctacatcatcta

SEQ ID NO: 21963 - DNA, 2402 bp, Oryza sativa
  unsure (1)..(2402): unsure at all n locations
aatgaatcagatcgcatcactacaaaccaagagagacggagtaagagttgagagcagataggagcccagagatcggatatttctctcgaggcagcgcgagggaagggcgaatgcattataantttctcatcgcgaatggatttttaacanatntnnnnnnnnnttgtatcagtaagatatacctggaggtgtttgtataaaannngtaattatatacaaggtgtttatatattatgatatcccgcggacatctgtctcccgcgcggatgttttttaacacatcatgcgacagtctttgtgntnttataaacacataatagggggcttnggtttttagaaagagtatctttattccacaacctcgttttctcgggcaccagaaagaattctttatttttgcgagatagccgcacaaaaccgccacagggttttgtcgcagaaacacttctttcagagattgtccacagccaacaacatgtgttttaggagcccgtttgcgccccttanaatacttgtagcgnccacatacctcntagttatatctgtaccagagagtccgccaagagaataantgtttctcgcgggttgatccaanacattattccgataaagcccacgggtcggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcgagtatgcagcattgttcgaggaaacgcatattttttggagacacttcaaggggagtgttttcagcgagcaatcaacgggaagtacttgaagaaatacttcccgagcgtttggcaacacgcttaaggaggtactatgacaagtacttggattatcgtcctaagaccaaaacatgttctacgcttttagattcacgttgttcatcaaaaaggcaggggggcatgtgttaacacccaaatttggcacctaggattaaaatagggaaaattgccaaaatttggaagtctatcggtttccttcgagtgggccggtctgaccgccggttgagggccggtcagacaggcggtgtgtggccggtctgaccggcaggtccgagtccgactgtgtttcatcgtgtctcgaggtttacttgctcgggaaggcatgtttcgggtttcctttagtttctaccccgagttggacgtggaggagggcttgtagagggcaagactaacctctatataagggacatggccggttctattgtaagaaaccaatctacaatcaatcaatcgaatcattttttcatattgcttttagttttctcttagtttgtccatctttatcggtttgcgccgtaaaccgtctgccgccgctgcgagagtgtgatatctctttgtaggtttgtcctgaaaaccttccgttttgcccacgagatgggtagttatcttaaatcggcttcgctagcctgtttatttgtcaaaacccatctagatttagctctttgctagatcaaggtggttggtgactctaggatcactgcaaaaataaggtgctacaatcgttgttgtcaacttatctcaaaaagttgccaacagtacgtatgatcgtgcgctctgaagggttcaaagnggacatggggggggnaaaatatgaaaccgtatagagagttgagggggatgcggcataccgctaaaagagagattacggctctaaatctgaatcagcgaaggggg

SEQ ID NO: 21964 - DNA, 1709 bp, Oryza sativa
  unsure (1)..(1709): unsure at all n locations
cagatttatacgcccgctgtgtgatggatctaatgattgcaatgtgttttgacgacaggttcaatcggccatagatgaaggacgattgaagttcaccgatggctccaagatgaagcttgatcatgatccttttccggtgaatataattaatttcaatgacaagaaggtgttgattcggccggagcaagccgaatctactaaggaaaaaggaataatcattggtgaatcaaggccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaccactttgccctgtgaaccctcgtaaggatataaacggntattagcgggtactaatttgaaggtgccactacggtccctcaaaacatnnngtttctttctgacactcctctcaaaaatgttgttttcgcaacaaccccgtggcggttttgtgcgcgctatcccacaagagntcaaactttcttctcgttcgtctgcgaaaactaggtgttgtatataaagtctcttcttttagaacncaacaccccccaaatttcttttgtaaaaccaaaaaanatgncttatattagtgttaaacacactcctctcggaccaaaaatctctcttgnngttntttnnnnnnaananaaaaaatntttatttatatattattntttgtcgcgnnnncccngctcgctgcatgtgcatatgcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21965 - DNA, 3286 bp, Oryza sativa
  unsure (1)..(3286): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccacatagaggttctcgcgcggggagaataatggggaaaaattttgtacacccggtganatttgggagaatatcgtgcgccgtgcacctttttggggagatggngnngggaaaaaaaaaaagggggggggggtcaccctacccccctataacggtgataaaccttcaagaaacgtttcgtaggtgtcaaaagccatttccggacctgttatacctcgttccctcataggcatttggcttaggggagactagaaccaaaagccctttggttcggcttgggcttgcaatgttttcgggtaacctatgtggaaacgtaccgccttatgagtacctctccccaccgacgccagccacagtcagtacaggaacgaagcggcaatcgcaacggctctccggcggtgcgaatcataatcaactggcagacggttttccgatgaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatccaatgcattagctcacgctcggctcgccggctagctaggaatgcagctagcagccgcagcgctgctggacgagggtgcacttgccggcagggtcgcagttgaaggtggagctgcagctagtgagctggcagttgctcgggttcgccttcgagcagcaccggcactgcaggcacaacggcgccgccaacgtccctactacgccgctgccgccgccgccggcgatggccaccaccaccggcttcgccgtcttcatcggcaccatgtcatccagctgatccaacgcccatgctagttaattgatcgatatacatgcatacacacaacatagtcagttaaatgtcatccgatccgtcagaaaatacagtacaagttcatagaagaaaccagattgagcttagaatacctcgggactgcacggcgacgacgatgaggaggacggcgaccaaactcgagagaggggaggtcatcctcctgcggcagttcgccatggctgtttcggtcgatccctatatataccacgctgttgaatgataacaacttgggaatgccaacgcttgaggagatcgaatggcgagggacgacgagatgtgctcgtttatatatagcgacgacatgttgcatgccgagggaacaatataattcctaacgtccatatgcatacatttagagggctgtaaatctatctatctatctatctatctatctatctatctatctatctatctatctatctatctatctatctatacctctctctctatatatatatatatatatataacatatttaactaaaaactttttatatgtaataataataacaataacaataatatatatatatatatatatatattaattatacacttttcaggagctttaataataataattattattattgttattattattacatataaaaagtttttagttaaatatgttggttatttatagcggcttaggataaaaaagatttcatttcatttataactttcaaattattaattttagaattaaattaatagggagctattaatttatgaaactcatatttatgaattcaaaattatttacgacctatagggtttaggttgaaaacaagactcaatgctatcaattacaatttgcaattatcagtttagaattttaaatcaaattaattttatattataaatcattttgatctttcttctagtcgaacttatttatgtttaatcaagattataaatacttcgtatatctattaattctaagttctagaaaaaacaaatcatgatagtccttagttttgcctatccttaccttgcctctctcccctctctgttgcgatgcggtggtggatcgggtgagggaggcggttgctgatccgacttgttgtgtcacgtcctgttctttaaatttttaaatttgcctaattttagaaattcaaattcgtgtttattcatgtaaaatagcttaaagaaaacttcataaaaatggcctaattactaaataaattaattaatgccgtgctagtattctttcttttgttaattggagttatttgactaaaatttcacattcgagaacaattactcaacgattccaaatcctccaaaatttgaaatttccagagaaatcctgttcctcatctttccttcctgcttcctcccaatacgtcctgttcttctggtggtctttcattcttctncccccttcccccccccccgacacacacatgtaattctatcggttaggctgatttgatggggcctcaccggaatgcttgaatttcgaaaatttcggtccgaaattttcaaaattttgaacaaaaattagttgaatttgaacaaatttaccaaaatttatgaaaaaatttaaaatttcgggccgagtaatatcgtatcggaaggggtccgacttttcaaccntggacacacacatacgaaacatttctattttcgacccgctattcttttatttcccatcacctaaagctttcctctcccccggcatatcacaattttcctcccttcacaatcaaaaaattggttcttattattaccccccggccgtgttaaaatttaaggcgccatgtggacaacccttttgccgctggttgcggttgcaaaaaaaaaaaaaacaggggtgttttttcccccaaaaaaacaccggttcttgtttgtcaaagaagtctttgataaacccacataaaaatttccccttcccaaaaaatttttttttnaaaaccacgcgaaagggtaaaacggggggggggttttcgttcccacccccaaggggggaaacccccctttttgggggcccccccccccaaaaaaaaaaaagcgggggtttttttttttttctgtgggggggggggggggggggggggccccaccccctttattaatata

SEQ ID NO: 21966 - DNA, 4197 bp, Oryza sativa
  unsure (1)..(4197): unsure at all n locations
ctgcttatttcccaacccgttaagggttttgagtccttccgggngagaacagccttttcccgaaaggagcccgccctggaaattggtgtcatctgccccttttcatcccatattcccnncggttatgtcgcggaattttattttcaacaacggtccttgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacagcccctctaaatgtatgcatatgnacgttagaaattatattgttccctcggcatgcaacatgtcgtcgctatatataaacgagcacatctcgtcgtccctcgccattcgatctcctcaagcgttggcattcccaagttgttatcattcacaagcgtggtatatatagggatcgaccgaaacagccatggcgaactgccgcaggaggatgacctcccctctctcgagtttggtcgccgtcctcctcatcgtcgtcgccgtgcagtcccgaggtattctaagctcaatctggtttcttctatgaacttgtactgtattttctgacggatcggatgacatttaactgactatgttgtgtgtatgcatgtatatcgatcaattaactagcatgggcgttggatcagctggatgacatggtgccgatgaagacggcgaagccggtggtggtggccatcgccggcggcggcggcagcggcgtagtagggacgttggcggcgccgttgtgcctgcagtgccggtgctgctcgaaggcgaacccgagcaactgccagctcactagctgcagctccaccttcaactgcgaccctgccggcaagtgcaccctcgtccagcagcgctgcggctgctagctgcattcctagctagccggcgagccgagcgtgagctaatgcattggatgccaaagatagttcttgctgaaagtataagcatgtatatagagatttaatttatgtcatcaataaatcttggcgttaaacaaagacaaactgattaaaaaaatgtggaacttaatataataaatgcgtactggtggttctgttctggatgatctctggactccattaaggacgtgtttggttcgtggtgaaggttggataggatatagacatcagatatggtggggtctaattttttatttggttgggtggatatcacaatccagttttttttgttaggtacatgagaatgagaatggattgaatgaaaaacaataacatattaattaatagtaaaatatgttaattatcatgactatagccattctttatactaattaacaacaaaataaactaattatatctaatcaacactaattttgataagttaattactaattaacaacacaatacattaattattgttaatcaattactaatgatcaagattagcaaaggtggatatcctcatccagccgatacacttatctagcatcttcgtggaatatttccttttcaggtcgccctatccacccttgtccaccaaccaaacacactcaaaaactgaatcgtcatctcccatctagggatattcctccaacaaaatacaccctaataggcgcaccaggtatcacgtggacagctcactgtataggatgttggacgatacgccacgggtgagcaacatgggccgtggtgaatggacagtgagaaatcatgcgtagtgcttcccaaaaatctcattcaccattcacccttctaggactttaaaagcgatagttaggtagacctgatctcctgattaccagtgcacgccgacgagtgaaatagactataaatgatgatgaaatacagagatatcggggtatgtgatcagaacaccgtcacggtctccacaactcgtatctgaaccagataagtcgcacataaccataccaaattttataccactctaatgcatgcactgggcaatccgatgcactcgctagacatgtcattcgtttctactacaaaacgaagccacgtatgtgtgagcacaaagagtcaattattttttatgaggcaaagctatcgagcgctcgtgccttcctcaacaatgtatattccccatgtgttagtgtgtatgtgcaatgggaagcagatcctttgacttaactgcacatgcagttgagtcactggcatatgggtcccactttgctatggcccacatgtcagtgactcaactgcacagcagttaagtcagaggatccctttccatgtgcaatgatatagcaaaatacaccaaactagtacgctaaccgcctttattatttacaagcaaagtgtcagtgcattccaataaaaaatacgaaaaaaggtaggaaaagaaatagagcgtggttagaaaacggtcgagacgaggtgattgttgggaaaattgactctcagtatggaaaccgggagacaatcacacacgttgcttttccacccattacccatgcgagattaacgcgattaattcatagttatttccataataacgcattaacgtgattggtcatgcatgaacattccttttgggattacccccgatacccacagcgccatataaaaagggaacgccagcgtcgtgtcatggtgacgatcgctacacgatcatctcgttctcgataaacactaactaatctcgatcctttactaagtgctgaagggtcatcaaacggcggtaccatgccagtgcaggtggcaccccgaaggacgtcgccatcttgcaattgatcgccggcaatccctacagatcaagccggtgaccttacctaccccgctgctacgactactttctctacaccgaacaccggagcggttcgaggaactgctatctctacatccactccggccatcggcaacctcaggacaactacggcatccatggcttccaataatggtcagtcaccctaagtttctgtattatggtgatcatgttaggctaagcacttatgatttagcctcatgatcccatcatcccatttagaagccataagatgcatctaagcctctatctattgagtgtcggtttgatgcaaaatttggtttcgatttatgttagttagtccttaattatcatcagattatgattagttaggttcgattaggttttaatttcttgatgcccatgactaattaaatttgtgtctgcattttaagatcgattactgcttgggtagaaattaggaggagaattgcagcggataaccaaaatctctaattttcacaaatgctaattcaagaaaatccccaaattagaacccaaaaattccccacaatccctgcaaatccctaagaggataagattgatgtcttaccgattcctcgaatcataacgcgagcaccgctgtgcacgcaaccccgccgtgtcatggatcggccttgcgcctactctcatggcccatgcagggtgagactcaccgtcatgttttgccgcacgtgaggacaatcgagattgcactgttgcactagcattagccttgctacgcactcaccgtcacgatatttgactagggctcctacggcaccagtgtgttgcacgagcaccgggtaactcggtcggccacgaccccttcgttgcacgctgctgggcaccacaaccaccgcctcgcacatcgccggcactccgatgcctcacccgattcgccgctgttgtcgccattaggagtagaagaaaggggattggaagaaaggaaatgggttttagggctagggttttggccaatcggccatttttctcaatccaatattatctttcattttgctctatgatgaagttttactccttgtctggaaataataatgttttaatttatttacatagataatatgcatagcttaaagtgaagagaaacattgtggatagaagcaccacaaagtataatctcaagagacacacgacaaagtccagtcgatacaaagacttcacagtcgcacacaatgattatgaaggatgtagcttacaaagagtcta

SEQ ID NO: 21967 - DNA, 1616 bp, Oryza sativa
  unsure (1)..(1616): unsure at all n locations
gaatcctgtgttatttgatcgtaagtgtgtttcgcaggttagctacttacacccttatagatcggtgagcaccaacgctagtctgccattgccgttcactggtctagtccacattgtgtcgtcttctcgttgggagctccctcaactgcgggtgagtggtgccctcagcgtcgtcattgggtggcgagcttcaccgcatgatcgccattgcatttcttgcgccaccaccatctacgagagctcgtgctcctttgccgtcttctcaatccttcccttcgctaggagacgtcgttgttgccatttcttggcagcagaacacctgtctatactatgtcctacacccagggatattttacttcccttgggttgctttagcagctctagggaacagtttaaaactctaggggatcgatccatggaattctcgtatagacataggaccaatttaccataaaccccactgggtttttggtagtagtgtagtaggaatcaaatctaaccatccattgctatgggtttgctatcgtttgtttaatgccaagatttattgatgagatgaatcaaatctatacaagcttatactttcaacacgaactatccatgggtaaccatgcatcagttcatgcatcagcatcagtagctaggcttgcagctagcagccgcagcgctgctgaacgagggtacacttgccggcggggtcgcagttgaaggtggagctacagctagtgagctcgcagttgctcgggttcgtcttcgagcagcaccggcactgcaggcacaacggcgccgccaacgtccctactacgccgccgccaccgatggccaccaccaccggcttcgccggcttcgtcggcaccatgtcgtccgccacctgggcatccagcgcccatgctagttgattgatacacgcacacacaccgtggtaaattaaatgtgtaatccgtcaagaattacattacaagttcagagatgaatccagatcgagcttagaatatataccttgggattgcacggcgacgacgatgaggaggaggacgggggacgaagctcgagagaggggaggtcatgctcctgcagtagttcgccattgctgattcgatggatattacgctgttgaatgatgtaaatttggaaatgggaatggttgaggagaccgactggcgagtgacgacgagatatactcgcttatatagcgaggaggcgtttgcatgccaaggcaagaatcattcctgctaacgtgatatgcataaaattagaggggcgttgataaattaatctattctaatttgagcaaaacgctacttcatcgaatcatgaagctttgcgaatggatcgattgagctcatgtngatagacgattttaaattnaccatcaaagctcggctaaangatagatncggggctaatgctgatcttgacagnttcatacaagcttctcttgtctgaacactatttttttgagaatgcaatagatcctctattggaaacctaatcattcttagaagaagaactacttttggaattcaaacaccttagggggtggggtaataaaccctaatcaattgggctagtttgaaaaatggcattgagggaaagaacattgttccccaactggc

SEQ ID NO: 21968 - DNA, 1100 bp, Oryza sativa
  unsure (1)..(1100): unsure at all n locations
tgacatatcctcctccgccataaaaatttgattatagccagcactaccatctaaaaagctaatcaccttatgacccgaagcatcattgatcatcatgtcggctataggcataagatattcatctttgggagtggctttatttaaatctctaaaatctatgcaaactctaatcttaccactgcccttcttctccaccgggactatactagaaacccactccgcataacgacatggcctaataaaccccgccttcaacaactgatcaatctcctctttgactcagtcatatagcaaaggattaaaacgacgaggtggttgcttataaggcctaaaacccggtttaattggaagccgatgctcaacatgctcacggctaagacccggcatctcatggtactcccatgcaaagcaatcaacatactctttaagtagctcgattatcttaaccttataatcgactctcatatttttgtttacaaaagtcagccttggtttggttccatcacctatgtctacttcctccaatggatcggccgatataaacccttgtccaagcttctccacttcatcaaaatcttcaataggttcacccatatcgttctttgtagaccgatattcttgcaccctcttttgtaaccactctaaattagnctctttactcattatacaaatttatatggcttagccatgcttcactagccaagcttacagatatatgtaccaaatttgccattggagatacttataaaatcatagcatttgatatttcccatgacaccccctcaaaagtagcattcggccattgcaacccttgggcgatggattcccttaaacaaatttcaacatcattgcttgcccattggaattaacattgttgcanggtngaaagcccacaacaattgtgcttggatcaacacacgacccaaaataacaatgaggttcctgcgcacctacaataaaaaaacggttgtaacgtttgttcccaccgaagtcccctgaaagaaacctttgctccttgttaccattgaacttgtgaaaaagtaggttttaaccaaaatcattgccaaatttggaaacagttggtttaaatcacagccccn

SEQ ID NO: 21969 - DNA, 1167 bp, Oryza sativa
  unsure (1)..(1167): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttgtcttcggaggcaatatatagccgaaaaggttttccggctttaggcgctcgcacaacgggtaaagtagacaaatacctcttcaactcctcaaacgcctcttgttgttttggctcccaagtaaaatcggcttcttttttcaagagaagtataggaacaaaagcatcgatttcacctgctaggttagaaataaatcatctcaaataattcaccttaccgagcaacttttgaacttccttcttgcatgtcggcgctttgaaatcacgaattttttctatcttcttaggattgatctcaactcctctctcatgcaccatgaatcctaagaacttccccgccgacacaccgaaagtccacgagtcacaagccat

SEQ ID NO: 21970 - DNA, 1150 bp, Oryza sativa
  unsure (1)..(1150): unsure at all n locations
tgaagtgttctggtgaccagacatctgcgcgctgtatgactgggctagcaaacaccacttctggcagaccaacatcctgagtcccgaaagcctgcgtaagcagtgggacaagctgacaatgcagcgtaacgccggaggtgagcagcgcgctgtcaagccagatctggacttcaacaacactgactgggcctatggggtgatccgatgaaatctcttgcagagcagatgcgtaaccacgaccgcgagcagatgagccgcatggcccataacctgccagagcagtaccaggagtgcgcgccggtcgagcaggtggcgcaggtattcaacaagctgttcaacgagctgcgcgccgcgttcccggccagcatggcgaacttccgcacccaggaagacctgaacgaattccgccgtcagtggctgctggcgtttcaggagaacgggatccacaccatggctcaggtcgatgccggcatgcgcattgcccgccgccaggagcgcccattcctgccgtcgccgggccagttcgtcgcctggtgcaagcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21971 - DNA, 3336 bp, Oryza sativa
  unsure (1)..(3336): unsure at all n locations
tttaccttgaaaaccaaaaggggcctttgagcctccttagagaaaaaggaaaatgtggcaaagttaaaattgaaattttggtccctcaatgtgcccttttcaaaggccaaacctattttcccagggttttattttgagttactttgtgttagacgcctcaaattagtagaaaaggttggtattcctaacggctctaatatatttaatattcggaaggtagttccaattataaaaagattttttttgaaacatcatgagtgaagtgatgcctggtagctaagaaaaattgattttaagacaanctanatttccttggtttattgaaaaatacagcagaaggatagtaatgatttttgtcaagttaaagcaagaggcttgtaaaaggtcaagacttccacaaaacagttgacacattacgctgccataataaattaagtttttagcanccgaattgaccagnaaccttttttcctcctaagaaactgattgcgacgaacattcaattaggcatcagtattagattacaatgacaaaagcaggcagctgcgtagatttgttgtcatcattttagtagaagagacctaaaggacagcaacttggaagtaactgacagggccaccactagtatagtaccagtcaattttttttatttttttatttttttgcctttccatctacatcttgctttgtatacaagcaaacctgtcgcttgcgagcattaatgtcttttaaccccttcgttaagtttttggggctgttatttcttccctgctgcaaatggtaaccaaagatggtgacaaccggtggtctgagtcggagccagcaagaacggattacctaccctccttcccatcgtgttgtccctctcaaccagaagaattggaccttcatgtcgtggctggagatctgtgttgcaacctttcgatctactaacaggaaatactccagcaagaagggcaaagtagggatcttagaactcccatcgtcttcccctagctgccatagccagcactttgtatcttttttgctatccgtgatacggcttgcccaagctgaacttgttggttcctattaccaggggtgcagctggaacaaaaagggaaggggtatcattcgcttgctttactctattttagatcaagtttaagctaatatgagtacctgagtttgaagagtgatgctccgatgcaatatacttgaagtattctactccgagcagaattaatctggatcgtatattttaaaggacaggtaagtaatctcctaatatccttacgagagtggtggccgtgacgttctgcgtgacgctggtggcgcgccacggcgcgacggccatggcggcgttcctgatctgcgcccaggtctggctcgccacgtcgctcctcgccggccaggtgagctagctagctacctacctacatagcttagcctacattccgatgatatatgcatggctgcttaattaactttgcttaaattgatcaatcaacctcaggccttgcttgccagcgcgtttgcaaagaaggatcactacaaggtggcggtgaccaccgcccgcgtgctgcaacttgccatcgtcctcggcgtcgggctgacggccttcctcgccaccggcatgtggttcggcgccggcgttttcaccagcgatgccgccgtcatcagcaccatccacaaaggcgttccggtacgatggtcatcataagcaagaacagattaatcttcagatattagtaaacatttttctcatgaacatatctgacgattgtctccaaatcaatcagttcgtcgttggctcgcagacgataagcacgctggccttcgtcttcgacggcaaatggaggggaatggcatcgattaggataggatagggagagggtgaacagttagataatgacagtttacgataatacccctacgtgaattattatcgctggacaaatatagccctccacatttcttctccaataaaatcgggtgggagtagaactagatctcaaccctacgattaaatacgatcaatggcacggattaatttctactccaagtagaaagcaccggagcgagtctcgagtttgaattgagggggtaccggtggacatattgtgaacatagatgaattgtagctaaaaaatttttcttaactggttcctgggcaccctcccccctcctacctagctttgcccctgcctattacatgtggtcaatgatgtcattgtaacaagatagctttcgtggttggatccaatgacaacatcaagctgagaggcttttacttcctgaatgcattgcctcggagaacctattccatgagatgtaggaagaaaacatgttgagtttgagatgaatatgtgaatgtagtcgatgagcaggacttgtagttttcataaatgttagaatagaattatattcggactcatatcataagcactccgataaataaagaggcaacacctaacgtaagtgcatagggactatagcataggcgaaggaatgacttcctggcagcctaactggtgaaatgtcctagttggggatgagcattgtaatcaatgctgtaaaatcaaagtgtgtctggtccttattctgagatgaacaattggcatttgatattattggttttgatatttgaagattattagcgaagtggttttggagatgattgatttgtaggtgatgaacaggaactgctgctgactgtttggcccggtcagatcggagctatgcgtgcagtcagaccggccagcccacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtattggcaggtgccgtctncgtttcgngagaaatgtgactcagcaccgcgattgaatcaaacgccttaactgtgttttggaaataatttagctcgatgcnattgaccgcctctgacggctttaacccggggtggggtttccaagggcccttaattgcaggccttagccgtttttggttttc

SEQ ID NO: 21972 - DNA, 2126 bp, Oryza sativa
  unsure (1)..(2126): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcaagtttgagataacttggtctcggaatatggtttctttgtttatttcatgtgtaggtgacttgatacctcgggagaatatttgcggtgatggaccggaagtcggcttggggataagacgacgtccatggtggtcaaagatcatgcgggatacttaggctagagttgatgcacgtggttgatggagattctatatggtatacgatggaggtattgtgtacgtatgggatgcggagtcgaatttggaaggagtccaaatttggtacgattggttatataaagtttctttcttgtactaaaaggtttcctaaagtgtttaagactcttaatatgagtttggttcgtggctttaagcttgctacctcatgtataaaataaagggggagcgtgaagcttagcggtatcgctttcgagagcaattgagttgaagtttgagttagggtttcgagtttagtcgagatttttataaggagtgcttgtggggcacttttgtaacacatagagaagtaataaagtcgtcatctactttaagagttcttcgatttgtgtttcattcggtttcgggcgtctaaccgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccaattggggaattaaggctgtgcattaaaccacccaatatggcacaggtcgcgttccgttttgggggaaaagatgtgtgttaacccccgaaaaaagaacaaaaacccctttccccttgtttggggaatataataatgccccaaaaggaaagaagcccctcttagggccataaaaaccgggggggttgtgttgccaagaaccttaatttacaagcccaaccccgttcttttttttttctttttttttccgttccgggtttcccaaaattaaaagggggccccttaggcccttaagttacgcccccccaaaaaattaatggggggtcacgggccccccctaaaggttttcct

SEQ ID NO: 21973 - DNA, 1199 bp, Oryza sativa
  unsure (1)..(1199): unsure at all n locations
cagctgtttactgtcatattaccatgtttcttagttctatgcctatttccatatatcgttctcatattatatacagcattccattgtataacggttcatttttcattttattagtggctgccaaactgatggacaaccttcttgtggtgagcaacccatatagtctgataagctcaatctgcctcacacttcttccatggccacagaaacagctagccaggtaggataccaacattttcgtgtttaccaacattttgttcagctttcactgatatagctaatatatttgttgtcacttcctgtagatgaaagaaactgtatctgctgatgctaaaaagaaaaggtatgcttctatatactgcagagctagctaagtcatgtgtgttctttacctttcacgcacatttcctttcctattatcattgctgaatatcctttttcccttttcttcagcgctgcttcggctcctgcaaccacccgcacccctaaaatccaggcacagaagcgaacctaaactctgaaatggtactgggtatgcacctagcacccataagttcttaactcattggatgacatattattgacaaggaaactttacactaatggcatgttctatttagcactttaaatatgcaaatgaaaaaactatcagagagtgatgatgacatgtatttacaaactgtttgcatttaatttcagaagcaaactaagtataaggatgctccacccactgcaattgatcttttcaaggagtgccattgcaaaagcaagatgggtttaatgagcccgttaaagaatgtattggattacttttttttttatactttggaaattatttaatgagatgaaatggtttgggattcttaactcctgtgctaggttggaagaagtatcatgtaatcctgccaaaagggaaaattatgggcttttgaattggccagagaaaaattttttttatatagaaaaggggactttgtttctcaccaccaaactaaatgtttaaattatttgaaaggttggtttggagtacaaatgaaaaatattgttttggtgtcccgcgggcctaaagggggatcgggggagggggctaaaggcttccccttttttattataaaaaatatttgagggccaaaaggggcacatgggctttggttttnaggattcatattccgggaaaaaattggggaggaaggcctttt

SEQ ID NO: 21974 - DNA, 1195 bp, Oryza sativa
  unsure (1)..(1195): unsure at all n locations
nagactggtgttgtttagactttgatatatatatatatatatatatatatatatatatatatatatatatatgtaatatatataagttattagcagatttctctttcttataaatcttccattgggattaaacaaatacgataccttggaatacttccgggtgaaatgctacaatagtatatccgtgcgcttgcggattacttctgtaaccataaatataccagggccatttccacaccattgctgggaattcatatttctagtaatgtcgttaagaaataccaatagctgtcagtctgaccgtcggtgtcccgccggttggaccgccgaacccgagcaaacacaaatcgaagatctctctcaaaatagattgaaactttattacttctctccgtgtttacaaagtgcaacaacaacactcttcacgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctggacctttgttgagaataaagttcccggaatttacccggggccttttgggaataaagcggcccatataaccccctatggccggtggcgggttctttttggggaaaaaggttgtttaaccccccaaaagatataaaacaccttaaccgagtttggggaaattaattaagcttaatggaaaagggccccctttaggcatttaagcgggggtttgggttaccacggtgactttattgtgaggcttagcccctttttttttttttttttttttgccaggcgggttttcccagatttaaaggggcctttgggtgtttatgtttaggcccccccaaaaaattggggtgtttcaggggcccccccctaaagtgtttttttttgggcacttttatgggagtttacaaaaaacacaccctggtttttttatagaa

SEQ ID NO: 21975 - DNA, 2015 bp, Oryza sativa
  unsure (1)..(2015): unsure at all n locations
gggagagtggggccgcccccctaaacggtgtgggggaaaaaaccccccctgtttttttttttctttttttttatataacaaaaaaaatttttctttttttgaggggggttttttaaccctttttttacggaaggggtttttaataatcccgcgggaaaaaaagcccggggaaaaaaaaagggtgccaaaaatttaaaattttaaaaaagcccctccaaaaagatgaatttttttagctcaaaaaccgccatgagattcatgaatagcttcgggtcataagggtattgagcttttagaatggtaaggcgggccataatcaaatttttaaggggcggaagnaggatatgtacaacgcggcttttttaaggtgcccggnatattgtggggtttgtttgagtngggttgtcaagacttttgaattgaagacgtcaggggcaactatccaagggccaaagattttgattattcatggattggctaggtatnatcttagtgatctaaaatggagaatgntggtgtcaaatcggattgtatgnnatgacacagacccaatttgagaattagcttttagagnatgcgccggtatggtttaaagatgaacccacttaatatgtgcttttggtgtgtcgncgngnaagttcttaggattcatggtgcatgagagaggagttgagatcatcctaaagaagatagaaanaattcgtgatttcaaagcgccgacatgcaagaaggaagttcaaaagttgctaggtaaggtgaattatttgagatgatttatttctaacctagcaggtaaaatcgatgcttttgttcctatacttctcttgaaaaaagaagccgattttacttgggagccaaaacaacaagaggcgtttgaggagttgaagaggtatttgtctactttacccgttgtgcgagcgcctaaagccggaaaaccttttcggttatatattgcctccgaagacaaagtcattggtgccgttttgacgcaagaggaagatggcaaggaatatatcattacatatttgagccgccgtcttttagatgtcgaaacaaggtatgtctttattgagagactttgtttatgcttatactatgcttgtaccaaattgaggcattatttgttatctagtacatgcatagttgcttgtcaagccgatgttattaaacacatgttgcaaaggccaattctaagtgggagaattggcaagcgggcatatgctttgatagaatattatttggcttatgaaccattaaaatctatgaaaggccaaattgtatgtgattttatagtggaccatcatgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcccgcgatggttggcggttttttccataagggttcgaccccccctggagcaggcattaacaaaaaatcgaacccttaagatcaaaaggggggggaaaccccggaaagggactttaaagaaaaacccggggcgtttcccctcgggaaggctccccttggggcggctctccgggttacggaaccc

SEQ ID NO: 21976 - DNA, 4246 bp, Oryza sativa
  unsure (1)..(4246): unsure at all n locations
agattattatctgctcctctggatatcggttagaccgggccctggaccggttagaccggcgcaataataccgattcaggggatagatccaatgactaatgctagttatttgtatcatcttagaacatttgatcctcctgtatctactactgcaactaatccccgagttcccccacgtccatacctatactaattggacactttctaggagctctcacgttaatcagaaagatctagccgttaattaatttgttgaattatcataaccgtagatgaaaatacaatctacgtgtgatgtgggccacttttaaagtctatctattgacccaacagatcataacttgagagataaatgcatctactaaaaagaagatcaccgatcctatctccttaatgagatatacgaattcggctgcacaaagaaaaaaaaagagatatatggagcagctaaataagaggtccaactcgcggcacgacggatttcgctagtgacgggggacgccctccaggagtccaggttgcccttcgttctgatcatcggcaactatttcgacttcattggcgttgacgagagacatgcgtgcacatcagaggtcaggacacactgcactgtcatctgatgtttgcttgcatgcgcacaagttctggccgggtttcagtgaggaaggcgaaaggatatccatttagtgatggctgctacctgatcaattaatcatggccacgatgcttcatctcggattaagctttgctacaggatccgggatgatgaagatttcttattagattttctgataaaaggaaaagataacatatatattgatctatgcttttccgaataaaaactggcaactaaataatatgactatagatttcaggtgttgcgatgttgttcctctaaccgaaagttcactctttcctgcatgcacggaagatttatacaccgtcatcgcttcaaggaattcaagtaggttacttacatattgtatgtgacctatttgaagtattcttgatttctaattttcgtagaataattaatgatcatgttataataagtgttaggtaatcaggtccctgaatatataattatgtttatcaataagtgtgtttacgtagttaggtttatacagagcaaaactcccatagttcacaaacgaatttgatctattctataataattttagaactgagaactcacgttaatctctattttttcaatagcaactaataattagttttccatgtatgtcttatcatgtttcaaaaactgtatgaagccttattgttgacgttcatgcagttaaatatcgtgactaattccaatttttacaattattatatatcatgaaaactgtactcatgacctattaataacgaatttcaaaaatattaaatcagaaaaaagttataattcagtctgtcaaattggaaatattaattataccacgacgaatctacaaatgagactccaacatttttttttcttaacggaacatcacaatagttacttatcaattccaaatcaataaattaaattaaaaatactaaattgagattccaacatgagaagaaaatgagtagtgaatgattccgatttttataattatcaaaatagtggaaaggctattagtaatatcccgaatgtgtacatcttgatcaacatctattagttataaatctcagaattattaaatcttaaaaaaggctatactgagactcagaccagataaaactcaatattttaaatacaaaatttacaaatattaaattaagaaataatataatttggaattaacagctgagtttcctaaataagtataaaatgctacttgggatggatcttatgtttatactttttaattttggttttttgaacagtcaatacaaaatatattgttttttctttatagctataaaaatctacaaataattttcaaaacaatatatttaaaattttaatatttaataattctaccaatgatagccgtgcatcgcacgggttggcgactagtgttcctaatgcttataatgatgttgctagggagtatcctcctgatactaggcaaggccaatataaccatattgcgtcgcaaacacaacctattaggccaccaaatacaccaccaaatcaacataggcctgataatatggaggaaataattagtgggattattatggataaattcaggattgaaactaggaatcgtgctaaggtttaccaaaagtcgtatcctgactattatgataatgtgctgtttgcttgtaattatagagttcccgaatttaccaagtttagtggtgaagattgtagaaccacatgtgagcatgtaggtcaatttttagcacaatgtggtgaggctaatagtgatacttttaaattgcgcttgttttctttatctttgtccggtaccgcttttacatggtttacttctttaccggcaaatttctattcatacttgggctcaattagaacaaagatttcatgattatttctatactggagaaactgagcttaggttatgtgaagaaaaaaatataatgagcctgtcattgattatattaagagatttagggatgttataaaccgatgttatagcttgaatataactgatagagatttggctagtctttaattgctcctcttagagaaagactagatggccaacaatttcttgatgttagtcaacttttgcaaagggctctggctcaggaaagctgggttaaggataataaaaaaattgttagaccatatgagaaaaggcctaatgttaatatgattgattaccttgaggcgagtgatagtgaagataagggtgatcatgatatgtatgttgctgaatggtcatggactaacaaaaacaagccttttgtttgttctaacctaatgccgactcctcgcaaagatcggcaaagtgaggttaaatatagttttgatgtggccaagtgtgataagatctttgattatcttttacaagaaaaacaaattagattatctaaaggccatatcataccatctcaagaagaattgaaacgtcgagcttattgtaaatggcatgattctcattctcattccactaatgattgcaatgtgttttgacgacaggttcaatcggccatagatgaaggacgattgaagttcaccgatggctccaagatgaagcttgatcatgatccttttccggtgaatataattaatttcaatgacaagaaggtgttgattcggccggagcaagccgaatctactaaggaaaaaggaataatcattggtgaatcaaggccaaagatgatagtgccaaagaagccggaggttggtgttttgaaagagaataaaagcgaagcttcgacttctaaagctcctaggaagaccaaagtgacccttgatatgcttttggagaaatatgaaaagcaaggtggtgagagagcttgcaacaatgggaaaagaccaagatcacctcctagggagcgatttggtcactcgccaagatggttgcattcacctccatatcatcattcacaagacataccatggggtccctatccaatgccgccgctgggttatccttatccttattacatgccatggggggcaacgccgccaatgttcaatcatatgcctccaatacaattcaaccaaaggtggggaggaccaaggaggccaattcatgaacatttgtcttcaccaaacaacggctggttttatggtaagagccgggccagtgaggaaaggagagaaggaaagcgcattaaagtggaggcaaggacttcagaggtaattaccatcaaagtagggtctcatgatgtaccaataccttctggagatgaagttagagagtcctcgagaaaaaaatccgaagccggtaccagctcatcgtagtcggctggtctgaccgggccttctagccggtctgaccgcagccatacggccggtctgaccgggccatcaggccggtctgactgccgacccgacaatggttcgaccgacgcctcaagccggtctgaccgnccaccgaatgtggtctggaccgngcatnttggccgtcttgaccgtggttaactncggtttgacggcttccaccccgtttgttagaagtttgaaaatgcatatnaggcttcattcattcattaaacccaatggggtttattactcccttgaaaaatccaactatgttaccgccaaaattagaccaanntcaaacttgggggttaaactttccggaccgccggtcccaaaagaaaaggtattaattcaa

SEQ ID NO: 21977 - DNA, 5818 bp, Oryza sativa
  unsure (1)..(5818): unsure at all n locations
acgttatgacaacgcctagaactgcccaggtgagactgagtggtttcgtgaactcctgatggatttgccggtggttggaaaaccagtgccagctatcctaatgaattgtgataatcaaacagtgattattaaggtgaacagttcgaaggacaacatgaagtcatctaggtatgtaaagagaagactgaaatctgtcagaaagcagaaaaactccggagtgatagcattggactatgtccagacagctaaaaatctggcaaatcagtttaccaaggggctaccacgtaatgtgatagaaagtgcatcgagggaaatggacttgagacccacttagagttgcacaatagtggaaacctgtcaattgtgatcggagatcccgtgaatttggatggcgaaacaaactattgtgtaaccgaaagaagagacccttaaatgggctcatttttatgatgtacttctcttctattctgtatggtaggatggcttatgcctcaatgtattccgggtggctttcattaagcagagatgttgacctgcagaacatcttagaaggaacacacttatatgagttcgactgctagtcacagtctatgagatttgggtgatctctagatactcatgaaaggcctggagtatgacttataagctccaacctgagagaatactaacggaataaatatttgaatattattgtttcccaaattgggcttaattgagttcaaaatatttcttagtgatggtgttgcacaaaaatattacatttgtttagaatagttgtcgtcatgaaaaaaaaactttggtcctaggagtttaagttcttgtgatggaattttgttactcctcacatgcaacatcgccaaaaaagtgaatatttgtgataaaaaattttaacactaactatcatttatggctataaagacatcaccattattttaacaatggagtatttcaatcagccaaaggttcaaaggtgacatccaagtagttgtgtgaaacttttgtctatccagccattacttccttaagcttcatcagatacaaggtcgcagataacttcgtgtgctttactgtacatctggcttgcagaggtgtctcaaaatcgttcatcagctgagtaaacttctcatggtccctctcgttgtaagttaggtcctcaacatcacgcaacattactggaatagtctcattattgacatcctcccgatcaccagccaacgaggattgaacaaacatatcatgtttgtgttcttccttgttcagaccaccgccagctttatccccaatattctctagctattgctctctatgcttagtccaacatgagtaaccatccatgaagcctcggtagatcagatgcatgcgtgttttggcactattctaaagcatcttctcattcttacgatcaaagtatggacaagtcatccattcattgtttgttctgctcttgtcttgctctacaacatttatgaaatcagcaacgccccttcaatactctatgctagatcggtcacttttatacatccatcttctatccatctgcaatgtatgaaatgaaattaatgatatgtatatgtagctagtaattattacatcgaagttatattggtaatttattattaacttggaatacttttttttcaagtgaagagcaaaaattcgcccctctagccctccctcccaaactatgaatagtctgctatataggaatactattctttcgaaagtttgggagtatttatactatgggttatccgtaacgggccgcaaacaagccccaacaaagattaaggataatccgtgataggcttcacagtcatctttatccggccttaacactaggctcgtcacggatgaccctcataggtaacgggggccgtcactaatgaccttaacgggcaaatcacaccccatatgaatgttggttatccgtgaggggcctatcctgaggactaaaattctacctctcttgggccatctttgatgaggctttttgcagcttgataaagatgactatctttgtaacgggtcgctcatttccatcacagatagcctgattgtgattcccggttctgtactagtgtggatatatgctatgtccgtattcattttttagaaattcgttttttagacgggttgcaagaacaagtttgagaggagtacaagaagaccatgcagtggtcctgacagctgattcatctttttcatcccaggattgatgatttacacacatataatacatatatatgatatcaattttagagaaaggatacggtcggggcacagcagcatcgctactaaccattattaattttaatttaaagctatatatattctgctagctagcccacacgaggcgtctcggcgacggtgtcgacgaagattcggacacggttgaagcgaaaatcctctggcaccgccgtgccgaatggcagcacgacgatgtcggcgtcgggcttgtccttgagaatcaccttcttggcctcctctatgctcagcccaaccacctccggccacgacgtcttcgccgacgagctcatcttccctcgtctctgcctgcatgtggatcgataagttaaatgccttaaaggtagttaaataacttctagctatatatatatatacacacatgagaacaaaatatacttcctctattctttaatgaacggtgttgcattggttaattagtttatttaaaaggaaaatagaggcagtataaactaaggaaaactaaggaattaaaaggtactccactcacggtctgatcgagttggtgatgaaagaagctgatggcgacaaaatgacttgtagagttcatcgagagcaccgatacaaggcacgtatttataatagagttccagaggcaggtttggatcaggattatagcttgccaaggtggatctgactgtgtacgtgcctgcatgcatatgccacacgacgttgctggtcaagctgtttgatcaaagcgtcgagtaattaagacacaacaggatcacgtggcgatcgagcggattaatgttgaccaagagaaaacgaaacctccaaaaagaaaaagatagaaacgtgtttgatgatggcgtggcacgctcgtggccccagcggccggccactacgtacaaaacattcaactaccgtgtcacctacttttgccaagtttgaaatggcaccaccgcaccaccatcgatcagtcaacagctctgtccagtgtccacacgaacaacaaaccagtttggtttctcacacaacaattccgctccttttgttaagaaactacgggtgatctcatccacccaaggaaataggaacaacggttcctatactaaccggtagagaagaggagatcgctcctctctctccctttagcgtccctctcgacaaccgacgcgatgttcctaaatatcgcgtcccctgcagttgacaccgcttcacattgtataaatgtactgttgatcaatgagaaatctatcgattcgctctgtttgtgttcaattctctctctcgctcaatcaattctatccacattcaacacgttatcagcactttcgctctcgcgaaggagatcgcgaagtgaaagaaggaagaaacatcgcttttgatctaacagaaaagcgaacaggagattcaacagagaaggtacgatgcctacctttcattggattatggatgccgttctcggcctccctcgcaatcagcgcgcccgtcgccttcaccatcttctccgtcgatcggagaggagtcgccgccaccaccacggtcgccactaacaccatgaacgtcgggctagggctggtggccgtcgccaccaccctcgccgacgcatcgtggtggccactactccggctgctcctcctccgccttcgtctccggttgccgccgtgcctcgccgtatctgtgtgcagggggtgcagtactgcgcctaccacggatggacggcagtggtgacactgcccggcgagccatgtgacctttccctggagatggagtcgctgccgccaccactgaccgccccttcaccacctccaccgacaccaagccgacgccgacgccgttcccccactcccgcgctactggggtccggcagaaccggtaccctggctgcgcgcacgggggagccgcccttcttcaatccgtcctcgtctcgtcgtcatgcaggtgaagccgccgtttgccgtcccggcctccgccacaccttcatcgccattccccatggctctcctagccgtacactccctaacggggtgccggggaatggcgtccgggctcggccggcctccgattccgatgaggatcgggagccgtcggcctaatccggccggcaaaccgccggcggacggaggggcggccgtggcggcagtggatggtggatggcgacaacggtgggtagcggattgtggatgcaagcggtggtggacggcggcggatatggaggcagcggcggcggcgcatcatgcatcggcgccgtaacggggagatgggggcggcagatggtgcggcggcggcagaggaagggcggcgcccccctcggtggcgtcgttggcgccccacggcggcggaggaagggcagcgccccctcggcgtcccctcggcggcgtcggtggcgcccaacggcggcatcggtagcagcgaaatggcggcggtgtgcggcgaaaagggtggcggtttgagcggcgaaaacggcggcagcagcgaaatcgtgggggcggttagggttaaccctaaccccccgacggcttcccctgcctttttgctgagggccggatgggccggcccaccgccccccttgcctgccagcctagtgccacacggtggtaggccgaatcctttagatttcggcccaccacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataagtgtttatttaaataccctggttcactaaatttatttggtggcttaataacatgccttttgcatattatttcaagacacgctctactttctcgctttattaatttacaaaattctataaattctgtattttgatttagcaaattctcttaattatgtacaacataattaatggaggatttaatacatgttccacttcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21978 - DNA, 1381 bp, Oryza sativa
  unsure (1)..(1381): unsure at all n locations
nnnnnnnnnnnnnnnnnnnnnnnnnnnnnnnnnnggtctttttgattaaaaggacacttttatattttttgacttttttttttaattctttcncccccccnccccctctacccnatgnttgtttttaaacaccccnnnnnntaaaaagcaagagaggagaaagggaaacgcaaaatttttttttttcgtttttttttccaaacggaacagaacacgggggggggatttgatatttatttttttgttttttttatttttttatatttttttttttttttgtatttttattttttttttttatttttttttttttgttttttttttttttttttttcttttttgatttttttttgttttttttttttttttttttttttttttttttttttttttttttttttttttattttttttttttatgtttttttttttttttttttttttatttttttatttttttttttttttttttttttatttttgtttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21979 - DNA, 1398 bp, Oryza sativa
  unsure (1)..(1398): unsure at all n locations
aaaaaagggaaagacctcaaaataaatccccgggagaaaacaacccccgcgttttaatgcaaaaagggctccatcccatgaggcgatttaatttccaaaccaggttagaggttttaattatttcccgggggagaaaaacccctttcccctaaagaaaagcggcccagggccaaagggtgtcataaggccaagttaatcccaaattgcccccgggaaaattccgggaaattttttttacacaaatgtgcctggcccaggggatcccatccttggcccggggggccaaaaaacatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatatcctaccaattgagccaaggtcaaccactttacttgacacttgaaaagttggatttctagaaatgtggaatttttgtcttcatattgtaccataatgcgtgccaattctgcctgtagctgataannnnnnnnnnnnnnnnnnnncaacaaaaatataatttgtgagtagaaaaattatatccgtgtccttagcaaaattcgaaaattaagttttgaattcaaattttggcgacggcttataaagtgaaaggcaaacaatgtgaggcctgagtcatctctttttaatattttcaggccgagcattccttaccccagcagttcattcatgctttcaaagatgggcaatttacaacattaccagcatgtcattcaggcggctgacctacttcaccatcaacgcctttcattattggagttcgttttcttttaattgtttaaattaactaaccagttacccttccatcctggtttgtacatagagcaagccagtcctgttcatttggctcaggtactgcacattttcctctaccacaacgtattaatcctacagttccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncg

SEQ ID NO: 21980 - DNA, 2097 bp, Oryza sativa
  unsure (1)..(2097): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaacttcaaaaatagattaatatgatttttaagcaactttcctatagatttttttaaaaaaagtaccgtttagtagtttgggaagtgtgcgcccggaaaacgaaacaaacaatatcacaatcacccagcgccgaacgcagcctaaagacggggacgtagaaacaacgagacagccggggacagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggtcacccgggaagggccccggggggggtccccgggccgggcccggcggttaacgggaaaccggggcggcggtccccccacggggaaggggggggggcttccaaaaagcaacgcgggggggaaccaaaacgggggaaggaagttcggccaagaaggggcggggggcccgaaaaccccggaaagccgaaccgggggcctaaacgcgaacaaagggccgggggccaaaccgggaagaaaagaaatataggcacgggggagagccacggggaagggaaaaccaaacgggggataggcgggggcacaaaaaaacggagggggggccaacacgcggcccc

SEQ ID NO: 21981 - DNA, 1955 bp, Oryza sativa
  unsure (1)..(1955): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagcaacgaacagtaatgaagcagaagctcgttctgatctttatgacccagaaggtatatttttctgtttgttagttaccccgaactgtcaaagttgattgttcatcaatagatgacaaaaatcccttctatttgcagaggagatgattagaggccttacacaagtaccgtgggaacgtgttgatgtgagcttccagaaaagtagtcaaagattggttgcgcataacaccatccaggtgtgaacttattacttttccaacctgcagtatatattttgagcaaagtcgtcttcttttctactggtgcctgaaattttgaatagataattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcggttgttgcggtttcataggtccggcccccggccaggcttacaaaattgccctctaataaaggtgcgaaaaccccacggcatttagataccagcggttccccgtgaagctcttgtggcccctttgtttccaaccctgcgttatcgggtaacgttcgccttttcccttttggaaagtggggcctttatataataacccgtggggttttacacggggaaggcggtgctccacaaaggggttggtggcaaaaccccgtttaacacaccgctgtgtcttt

SEQ ID NO: 21982 - DNA, 1950 bp, Oryza sativa
  unsure (1)..(1950): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacgaaactaatgattcttttgatgattggcaagattttacaacctctggtcaaggtcaaggtgcaccatctaatcaagttggaggcatgattgaagtctcacgtatcactcagaaagaaacaagtgatgactcatggttcacaacagatgttaaggaagaaataaataaagatttagtgaatacaactaatgccatgttggacgattttcaaagtttttctggttcagatctagcaccacaaagttcatcgtttgtaagtggagaaatgatgaatccttcatttgggcaacatgaaggaactgatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcctacaaaaaattagtccctagctaagggggcgaaactcccccgtctcttcaaaaaccagcgtttccccctggaaaatcctcctggggccttcctggtccaccctcgtcaattacgcgaacaatgtgcgccttttctctcttgagaagtggggctctctccttatcttacccgggggcttctaaattgggctggggtagcgccacaatgtttgtttgacaaaaccccgtcatgccgagcgttgcgcttaggcgcacatctctctccc

SEQ ID NO: 21983 - DNA, 2098 bp, Oryza sativa
  unsure (1)..(2098): unsure at all n locations
cgccggcgggggcgccgggtcattcnggcgggncgttnacanaggntgnnntcagggagcgcaagctagcgtnggggcgcggcgnncancgggcgtcggggcgggggcggggccggggggacgggaaggnggntttggaggacccctgttccagagggagaaggtggcaggtgacggtaggccgaggcgacgatgagagccgaaaggacttccagtacaggcggctgcttcttaagtcacggcgggtcggcccgtgggactggggagcgttttggagatgccagagaggggcgggccctagggaagggcgcagcacggagcctgtgtacgggtcgggccggttgctgccatttggcggagtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaatgtactagatgaaacatttttggtgggaaagagagaagccaaattatcttaatagatggtttcaaaaatatgtaggttttttattgcaatagagttatttgtgtgtgaatacgtggtgggccagctggagggcaggcatgcgcgcgggggggaggggggggggggaccgcaatcatgatcgtgctccgaaaacggtatttcaagactatgacgcgataaattccctacgacctatggtgacactcgcgtagagatggttgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggttccggattgaccaccctatggtgctacgggtaccgggcttccggtgttggtgaaaaagtcgcattccttaaaccccccgtcgacatgatcttcaaatacgcgcttttgcgctaagttgtccgggggaagatatagggcctgcccggaaatgtcaagtggacgcccctctgcgggggtcgcttaatccggggtgtttggtaagttaggttcaaggcggaacgtgcaattttccggaaactctggagaacggcgcgtatcgtgcgtatccggggaacataggcaatatactgggtgtttcccgagattcatctgatatatggcgcatctcttggggatacgggtgtatcactcgggctttcgggggtcttaagcagtaatctcgcgacaccgcgccggaagtgcgcggagcattctctggagatgactctgccactcttgcgagcgatgctcgctactcttttcttggaaatatattctggtcaaagctggagaaaaaatcacgtgggtcgataactcgcgataatatctttcgcgctatccgtgagtgatctctctgggcgcaacgagcgcgggattaacacgcgccccgt

SEQ ID NO: 21984 - DNA, 1156 bp, Oryza sativa
  unsure (1)..(1156): unsure at all n locations
cagtcttgatgacaacgcgtggacagccccccttggggtttagagaagaatgaagacaaaaaaggaagaagatgtggatggaaaacgtgacggtagtattttgtttctaatcttggaaaagatcaggggcagggttgcgaatcgactaattataataatatttatctaattgtgcacccttgcaattgcacggatctaatttacctttttattaaaaagtaaaaactaggaaacggtacgaattaccccccgaactatcgcggtcgtccaaattacccccattaaccacaaaaccggacatttcttcacccccaactatgcaaaccgaacgaattacccccatcgacacaatccacggtggttttggtctatgtggaatacacgtggcatcccagtcaacgtttttttaataaaaaaaatggtcggacccgactatgatactctcaaactctctcgtttcccaagttttctaacagattctctatctgtagctgagaaattgtcgaccaggtttgagagacaccatagggagcagcccgccggtgatttggacccccatgagcagcccgttgcccgccggggccacatcccaagcacaaatttgccttctctacggaaccaccggttattttctccagtcttaacgccccatcattgtcccccaagcaaacgtgtattacgtttccggcgccttggctccacccaatggattttttgctaaaaccgtaagttccctttccctagtctctgccaaaaggtccttctacatgggtgttctttccagtagcgaccgcttaccttcatcgattaaatcataaatccacgctccttcctctgtccatccgtaatactgccctcccatccttatcatctactggtcccttacctctgtgtaaagtccactttattgctcttattcattcatctcaatcgtcgcctatagcgctacggcgcgggggtcctctcctcttcgccgaccccggctcactatcccatggccttttacagaaaatgacaccgggtccgtcttaaaatcacaactctggaatctcctctctttggnaactgcctcccccttattaccgcagcccctcttctccattcccacacacactctttctcttgctcgcaaacaccggtttcgactccgcgctct

SEQ ID NO: 21985 - DNA, 1717 bp, Oryza sativa
  unsure (1)..(1717): unsure at all n locations
cctgaggccccatttttgaaacctgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgaatttctctcttctcaaatgccttagcgatccgcagcgcacgcacgcacggacggacgccatggacgaagccctggtgggcaggctggaggccgcggtgtcccggctcgaagctctcaatggcgccgccggtgccacggcgagaggcggctacggcggccaggtcgaccacgcgtcggcgcatgacccagcgatcctggcgttcgacgagctcgtcgccggcgccgtcgggagggtgtcggcggcggccggcaagatcggggcggagatcgcggaggtgaccagggtgctggagaaggcgttcttggttgggaaggaccttcttgtcaggaccaagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21986 - DNA, 1935 bp, Oryza sativa
  unsure (1)..(1935): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaactcccaggaggttgccacacagggcccaaagggtagaatgtcttcacatagtcacgcaaactaggcacgaagagctcttttagagcttttgcccactctacatgatcagggtccttgcttttgtactccacaagcacctgaaggtaatttcatttgatattagtaagattaagcctattcaagatttttcgccgggctgaaacacactggacaaccaaggaggaactaactaagaagaaagtgtgagcgtgtcaagagtcgaacatgggaccacgaggttgaagccgcacacccctaccactacactagatattggatcttggctattcaagactttaaaaatgtaattttaatttcccacaataagtaatccgtataaatacgcccgtcatcgattaagtatgaagcaggaatcaatgcacacttgcatagtatcctcatcttttcatcaaaaggttttgtcaatgttttatttctcaagtcttgaacaaaggaagtgcctatgccgtgttactgaaattctgcttttcactctaagaaaaaaataaaaaggactgctcaggttcttggttcttttaaatctctgaacaaaggaaaaatcatgggcattaaccgaatgtctgttcttgatctataatgttgtttcaaactgacatcaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccccccgcggagaagcgggttgggctttgtgagggccctttcccttttcttgcttaacgaactccgttgggcctcggggccg

SEQ ID NO: 21987 - DNA, 1505 bp, Oryza sativa
  unsure (1)..(1505): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaagaaaaaaaaaaaaaaaaaaaaaaaaaaaaaaaaaaaaaaaaaaaggaggagaaagaaaaaaagaacaaggggaaaagagagaaagaaaaagaaaagagggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 21988 - DNA, 1788 bp, Oryza sativa
  unsure (1)..(1788): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcccgaggcagaccttaggctatattcttaaggcatatttggggtatgcttgggacccaagccaggtcccaagctacttttatgcttagagttttgagtcatatacgcaatattcccccttaggtagggagaatcccatatatgaaatcttaggtgggcccaggacactccagagtgggcccctagctacgtcaccctagggttactttttaatttttaaagacattctcagcatgctatttattttataatgatgcttttgccggataaatgggtacctcggttcctatttcaccgacacatagtataagatgttttggcttcttcatttctaatctagattcattaattttctatgaatttaaactatatatatatatatatatatatatatatatatatatatatatatatatatatatatatatatatatatatatatatatatatatatatatatatatggatatatatacattttaaatgactctggaaactttctcacattcctcagctttactcacttaatacctatcctgaccgggttcaggcccggtcgtaggtagattgtgactgtttgttgttaaacttcgatacctagcaattaactatgtatgcaattaacgtaatgcgggcaagaaaatcaacgccctgcgtcgatcccgtgtggacttgcacgctgttctagtcccctccatctttacccttgcgattatatccctcctcactgtgggcattttttcatataactctttgtaactctccaaaaaaacgcccctatcggcccgcgtcaagagagcccagtgtctcactcccaagaatctttctccttcgttcggaaatagtaactcccgattcgttgcctcctaaaaaattgcgtgtaaatttcctcaccagcgcgtctccatagggcngatacacgcgcgctcaacaaggcacgcccacaagttcctttctcctgcgtcttttaaagaacgcggggcgggggcgctctctcttnctcccca

SEQ ID NO: 21989 - DNA, 14823 bp, Oryza sativa
  unsure (1)..(14823): unsure at all n locations
atgtgcnattgaagaccnnctcggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacagcccaggaagattttgggctccaccacccatgaaaaaaaaaagataaattgtgcccgcaatctcacatcacgggaaactagaggatggtatatgaaaacactccctcgagaggacttcggttttcttccgagacgtctacggatcgggcatccgattttttcacgggcgcgcacccagtctccatcggcgtatgcatactagtaatcaatagttaggttgcttaatgtttttaagcagactttaaacaaatcttttcttaaattacttgtccaattcacgattcgattgcaccactaaattcgttgcaattaaacctttaaaacaagaccacacatgattataatttaatgaaaaaattatttagctttattaatgaattatttttaaatgtttcatgtagtattcatataatgtttcactatttatttcactatttaatttgcaaatgttacacatggtgttccttgaatgttttagcaagtattttataatgtttcaataattatattttagtgtttatatgtgatataaaaatatttcaacaatatcaagtttttataaatatattgtatctctgatatgattttttttgggagaatagctactttagtccctaaagtttctctgtaggatcagtttagtccctaaccttttaaatggtccaaagaaatccttaaactttgtcataaggcctagaatagtccttgggtccaccaaaaacatcatatggatatgtcatgtcatcattcgtgcaaaatctacgatgaattgtccaaattacccttacttatatcataaaaaaaataaatataaggatgaattagacataaccataggaaaaaaatacttctccttttttttcacccttttgaggtatatttttgctcttacatttttccttttgttttttattttcttatgatatatgtaagggtaaattggacaaatcatataaattttgcatctttttttttcacccttttgaggtatatttttgctcttacatttttccttttgttttttattttcttatgaaggtgacatggcatgtccatgtggcgattttggtgggaccaaggactatatcagcccacatgacaaatttaaaggacttgtttggacaaaatgaaagattaaggactaaaatgacccatgagtgaaactttaaggaccatattagctattctcccatttttttcactcattgggactcagttttacatgtcctattgtgtactgtccccatccatcctaaatcgtggcttaaccactgtccacggcgccgcctccgtctattggggggactaataggcgatcgatcaccaagcgatcgcccaagcgatcggatcggcccccctcccctatactccatacactcctccctcctcttcccccttcctcctccctttcttctcttcctactacagtacaccacacaattttttttaaaagaaacaaaaagttagaaaaatttatgtatataaatactatatataaaaaaatttgaattcaaattcaaatttgaatcgggtatgtaaacttttgacttataaactttaggtgtataaactttagaggtatagaaatactatatatagaaaatatttgaattcaaattcaaatttgaatcggatataattcaaattcaatttaaattgggtatgtaaaattttgacttataaactttaggtctataaactttaggtgtataaactttagatgtataaaaatactatatatagaaaatatttgaattcaaattcaaatttgaatcagatataattcaaatttaaatttgaattgggtatgtaaacttttgacttataaactttgggtctataaactttaggtgtataaactttagatgtataaaaatactatgtattaaaaaattgaattcaaattcaaatttgaatcggatatataaacttttgacttataaacttttggtctctaaatttagatgtgtaaactttgggtctctaaactttagatgtgtaaacttaaggtatatgaactttaggtgcataaatttattaaatagaaaagtaatgcggtgccaaaaaatgaaatcaggtggagggagggagggggagggggattgatcgctacccccgtccccaggcgatcgatcaccgatttggatttccggcgatcctgttcatttctttgaaagcgatcggaactgagacggacacggatagggggagccacacggacgagccaaaaaacgaaattttgtttattttgactcaatccgactcatcctcccttattactccgactcggctccggcgcgttactcctgtataagagaggaggcaaatcaactcgacagtgcggaacaaaccaattaggccataccacacgatggagatcaataacaatttcggcggcgcagtaggattcgctgccgtcgggccttggcaagaagccatggttggttcaagcgcagggaactgagacgttgtccttcgtcgacatattggacagaagcttgcacgtgagagttgttcctgatctgcaaggcaagctgtgcttgggatgtgtccacggcggcgactggctgctcatggtggacgagatcaccggcggctgcttccttttctgtctctcaaactcgtccacgatctcgctgccaccgttgcgggagccgttaggagacatgggagcatgcgtagtgttggggtcatcgccgttgaaccgtgactgcaccgtggtgattaccagtctacctgaaccggaagagagcttcctgctccattgccaccccggcgacgaggagtggaccaagctgatggtaccactcggctctgacaggttgttcggcaaactcgtcaactgcgcaggacagttatactctctctcttcctttaggaaattgctcaccatagatgtgatcgatgatgctctccatgctaagatattgaatattgagtgggagagttcatgcggtcacaattttgaaccgtacatcgtcgagtcgtgcggcaaactgttcgttgtcctagcatcgttatacgggtatccctacaactgcccgcttaatggggtttccgtgtatcgtctagatcgagccgagtcaatgcttaagaaggtggacgacattggcaccgatcgtgccttcctcatctcaggtcactatggcttctcgtgcaccgccatggaagggctggtgcaaggcaactgcgtctacatcgtgtggtcaggctacgactgcgagaggatttacaagttctgcttggatgatatgacgatcagcttacagccgatccttgctcaccccactgaagatttgcgaaggggattttggtcggttcctgcagggtgagttacactaaatacctttcatacccatgctatgctttgattaccttcgttatgaacaatgtgtatatgttggcttatggtctctaaacaagttatatgttttaattacaggatcgaagctacggaattagtacaatcagccccatcaattcattgtgatacagaggttcgtatactttatctccaatatttttatatggtgatgtctactataagtgatataaccaatataggccttctatcttttctcatcctaataaaccatataggtttatacttaccaccataattcctaatagtagaacataaagtgtataattgcttctactagtattagaactcataaatcaatggtttaaatcgcatccaccatatttatttatttatccttatttcgagaagaatcctggagtagactaaatacacctcttgagaaaatttaagtactatatatagtacttatacttgcttacaaaattgtaagctaactatgggccgcatctcctcacaggttaatgtattgaacaatttcaacaaggatgaggatgcacaagctaccatcaaggcatcatggcaagaccttccaatagagatgctagagttaatagtttcaaatctatcattggtcgatcgactacgatttccatcagtttgcaagcagtggagctcggtttccaacccagttgcacaagcaaaggtttggccatggctcatgcactgtgttaggcaagatggtgcttgcaagatgtttgatcctctatgtggcgtcgagtattctatgaaggttggtccatttgatgccaacgagcgacaggccttccgcttctccaaagacgggtgggtgatcgtcacccagagtgacgacaacatcttcgtcataaacccattcacaaaagagattgtgaagctctctatggccagcggctggtacagattcactggcatctcattctcgtcggtgcctacttcaccagattgtgtattcctgggtgtgtgtagctctcccaaaggcgatgggatcaaagtgtggacatgtcggcccaatgaggaagagaccgaggataatgagatatactacgaggaagagactgaggatgaggagagagactccgaggagaatgagataaactacgaggaagaggctgatcaggatgaggagagagaggctgaggagaatgagataaactacaatgaagaggctgaggatgaggagagtgagaccgaggaggattattggagtgagtttgattttgagaacgacgaagtcatgttcccagtggcacgcaataatccagtctatttccgaggggagttctacttccttgggcagaggggcaacctttcagtcttcaacccaggcaacaacgagtggagaatactcgataaaccggagcccatccgcgctgatctaactccctacgatgagggcaaggaagcttgctacatggttgagctaagaggagaactgatagccgtgttccatcgtaacgccaatgagcccccacgagtgctcaaactcgatgagtccaagatggaatgggttgaaattgaggacattggtggaggagctttgtttttggattacagggcatctattgccttgccatcatctgaagctggacatggtaataggatttatttcccaaagtttagtgaagatggaaagaaagcaattttctatgatctggaggccaagaagtatagcccgatgttctccggagctaaggaaccaatgaactgtgtttggtttgtgcctaagtaacagtctgatgaatactcctagccaagtacttgtgcgttacaatgcacactaaagtactcctagccaagtactgtatatgttacgcaacctcctaaacctatgatatagacaacactaagggtgtgtttggttgagctgtggcttttggaaaagctgctgtgagctgtgggccgtggaaaatctgctgtgggaaaagcagaagcccgtttggttagagcagctgtcaaactataggttgtagaaaaaatatcagtaatgcccctaaaggcctgtgggactgtttatatgcaaattactcgtaaaaacttaatttgttcaatatttcatatttaaaaggctaatttggagaatggcctaaccaaaacttgtcacttgtttggtttgaggatccatttatctgtgtgttcagaagtacatgttcattagtacgatgaagaaggaagttatcccaccaaaaccatgggaagacctcatgatggaccaactcatcctaagatggttttattcctcaaattaaagagaacatttactagaattgagctaaagaatatctcaattatcttaaaatgttgctcagttactttctgttcaagaacagaagttaggttgagggctaacattccccgattcctttcataattttctctggatcttgaagcttgtttccccataggttgagggctatcatattctaatggcatacaaagaaaataaaaggagaacttcagaacttacacaaaattcaaagaagcatgaaggtatggtaaaaatatacatctctaagtcatataatgtttttcggagagctagaccagcactaaacattccaaatttttttttattgaaacgatctttagcactggaaggtttcttttcctgaagaataattcaaaccataactattggatcggatcatctacaaagatattgcacagcaggatatattttttatcagatcaggcagataaacaactttttggtttatgctcctcaagttccagccatgcagcaaagtcacttcccttctcctggattctaatccttcctttctcaactatctccaaggcattctcaaaactccctccattcccattgtcctgttcatctgtttcttcaagctcagttctcctgtccagatccacacacatcaatgctgccattctttcagccagtcctggtacttccctcaactacatatcatcaaaatacaagcataagaccactcatgggagtaaaaggctctgtaaatgaacacacgcaaaatttgtatttgttggtcagtagacaaagctatcagatgatagcatgaaaccaatacagcaggccctaattatgcagtgttgaccatttattaaccaacataagaaagctaagaatacaagagtacaagacattaacagcaaaaaaaactagaacactcttaagttagctcaaactgtagctgtcgctcacttaactaatcaatacagtataatacattgacaatcagcagtctaagcaggccggagccagaagggcgacgggagacgcggcgccggacgggcggcggccggccggcttgagcacgggcggcgtcgcgccgccgtcggagcagggatgcgtcgggcgccgccgttggaggtgaggtcggcgtcgcagggcggcgccggacgggcggcggcggcgcaaaaacctaacccgcgtcgggccgcccctgttcgtcgccccagcagcgcgttgggtctattcgcgagaagggaaggggaaagaagcgaatcgttttttttcactactaataatctcatgatttgttgacgcatgacgatacagacttctactaacacgggctgattaattatgattagatagatctagctataaaaagataaacataataacatcaattttgcttaataattataaaacattcgattgtggcctatttttctaactgcatgatatatgatgactatctcctatgagtatgtacataactatattagtattttccctatttcttcaatattgttttctatttcttacatatattttaatttggactaatttttttctcataattaaatagataagaaattatttgtccatatttctcctgtagcatgagtatagtgcattatataatttaaaaattatattataagtgtatgtaatttcatgcgtaaaatatggaattataggataagatttgactttttctaaaattgccgcaccatagtagatagttagataagtaaataaccataaaaataatatagtcaaattgtttctttatttcattcgaaacaagacatttcttatgtaagcatctcaggagaacttcgagagaaggtaagaaaaaggagaggttagtcattagctcacgcacatgaggggaaaagttgctcatatccatgatatgatatactcccattaatcgataatatactaatattatttaaaaaaatacgccgtaatgtggtgtgaaactaaaacttaaccctatattcttctgttgttcaagatcttcttgttgttttctcggtcttctttattttcgataataatatggccacatctaccactattacttgcacatgaatactagcggctagctcatgtcttctgttgttcaatcttcttgttgttttcccgttcttctttattttcgataataatatggccacagctaccactattacttgcacataaatactagcggctagctcatgtgtgtgctccgtaatacatattatgtatgttttgacttgtataaataataataattttctttgttaatgatattatatttatggtaaggcactttattgttttttaagaactggaaagatatttttgctaaacataatctagaatgctataaagattaataatattgaataatacatagtcatataaatatatataatttttatggataaattagagaacgacactttttatgaatccaatgatcacaatgcactatatatattgttgaagtcagttgttactttgactatttgatagttatatggcaatgcattacaataggattttttgagacaaaaatacggattagtttttttagtcctttttttcatgacgagttgggttttttacatttctttagagaggtttttagggtatagtttttctaagggggacgaatcgattttttaagggaaaaaggagaattaaagtgcagttgaattgtttcagtgttttttaaagttttaatggaaaggaggcattttttaaagaaacatttagtgatcgtgcttttaaaataattaatataaatacatataccttatattatcgagatcatgcttttaaaataattaaaataaatacatagactgtatattatcttatagagattagatttaacgataataatgtgaatttaatttattagttacttatatatatatatatatatatatatatatatatatatatatatatatatatatgtgtgtgtgtgtgtgtgtgtcacatatccctatcttttatctccaaaatcgattccttagtcctaacgtaagccattcttaaccacggcaccgctgctagttgccgccgtggacgcagtccaagcaagaagctcaacggtaatgacgataagcaatatcttcctgtaccgtcagaattctccattgtatattatggtttgattggtttattccacggtagtgtaatatgtacttgactatatatatatgtgcatgctaatttaatgtcatgaatactgttgtaaaaataacttgtctccctcgccggaattctccattgtgtattatggtttgatcggtttattccacgggagtgtaatataggaataggcgtacttatatatatatatatatatatatatatatatatatatatatatatatatatagctacatgctaatttgatgtcacgaatactgttgtaaaaataactcgtctccctcgcgttttggaatcgtatttgaagttgaattgcgtggtttaagctaatattaattttgttttacagttgaagttctatcaactaaagatttatacacaaagtaaaacatttgaaatttttcaaaacaatgaccaatattattctgtactgagttgttcgtgtgttgcaacggaataacctaaaattaaacataagatgattatagtttatatttatgatatgagattttaagaaaaacatatattcttcatttgttcattaactcatctaaaatgtctttttatttcttttcttctgctccaacattagcttacattttgtagaaaaaagctttctcacatatatataacatatatttcctatttgttttcactcgcttatattccgacgttttaatctcttcgtagtgacctcaccacattggtccactcgaaaaaaaaacctcaccatatcgaatgagattgtaggagggaggaaatgcaaacacgttaaggggggagtgttgtgatagatgactaagtgagatgtcgtgtggaaaaagagagtgggtggttgtttgtttgtaaacggagttggcgcgagaataaaggagattattatgataaggaaagtgtattaggatacacaaatagtatatggccagtaatttgtgttatattttggaaaagttataattagattatatatgtgtttcatatatatatatatatatatatatatatatatatatatatatatatatatatatatatatatatatatatatatatatatatatataggacactcatatggggcaccatggtgcccgggcaccatggtatctaatgcacaaaatcacttaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatagtttaaattcatagaaaattaatgaatctagattagaaatgaagaagccaaaacatcttatactatgtgtcggtgaaataggaaccgaggtacccatttatccggcaaaagcatcattataaaataaatagcatgctgagaatgtctttaaaaattaaaaagtaaccctagggtgacgtagctaggggcccactctggagtgtcctgggcccacctaagatttcatatatgggattctccctacctaagggggaatattgcgtatatgactcaaaactctaagcataaaagtagcttgggacctggcttgggtcccaagcataccccaaatatgccttaagaatatagcctaaggtctgcctcgggcccagtcctgtcctgggccccgggctcatcttagtccttgtatattctatggtcctcggcaggaggagcgtagaaccctgtaagatctatatcttaagagaacgagctacagtttgcttcgggcccagtctggtcctacgccccgggctcaccatagcccgcacaagtcccgcactactcgagatagaggagtgtcgagacatacaaaacataaaggtgtaaattgaggttttcctcgggcccggccttgctctaggccatgggctcaccttggtcctggtatgcctcacgtccgtctgctcagaggggcgtcgaaacatacaagacacataatcatggaatattccttcatcaacgacacctttaaacgcaggagggcgcgacctcagaactcgctgggaagttgcgcgtgctccatagctagctgtgaggccgcatgcccagccataaatgaaacaggtttatgggggagatcctcggctagtctggagttgaaaggacgtggacaagacaccatcactaagtcacttaggacggtggagcctgggacacgcgtcgcacatgccccgtgccacttgatttagccaaacaggcagagaagctaccgtggcactatttcgagcagataaggcctcgtcaagcccaccacacaccatgtggtgagcacactggcagaaacccaactgtctcggacggagcccgagagcccggggtaatatgaattgcaagactcgaagggtttcttaaaggctgtgttagagaaccagttggcaacgataagacggctgatgagacaagactaagagtagatttggactataaaaggaaggggaccgatacggatgattagatgaaggcttggactctctcgctttgtagcctaaaaaggcattcattgtacttagctgatctagagaagacaacgaacaccaacacatgagtagggtattacaccttcgggtggcctgaacctgtataaactcctgcctgcctctcttcgttgggtggtcaagttccgcgaacccatcacgattgcatatacgtcgctcctctcaccgtcaaaccccctggtccgatcttcactctcggggagggatctctactccctgctattcgagggaccgccccgtcgacactatggaacgaacggagtacctactatttaaatgttagtttcatgttaaatatacttagtgaataggtgatattttttttctattattaattttatgtttgaaaacgactcaacgatcctatgcatgcttgattaataccttgtatagggcaaacttgaaatggactcatgtatgcattatctattggactcctacatggacagtactaggggtgaaaacggtacgaaaacagatggaaaccacctttatcgttttcgttttcatatttttttggggaatcagaatcggagaccctggatacgaaaacggaatcgaatattatcaaaaccgaaaacggagcgaaaacgaaccgacgcgaatacggtaacgaaaatttatcgaaatataaaaacccctcaaactgataaatccaattctcaagtctcaacggtcaacaattcatcataaaacacaatcatataagtccaattgttaagtctcaatagtacaacacaaaatacaatttacggaataaattatctatgtttaagagagtaatgctattgataaattccaatgcaggaaaaaaaaattcttatgcaacttcaggtgtgcataacaaatatttttttaaaaataacagccaaacaccatggtattcactattctgtgcttgaaaaaagaatccagggtatttcagtcaccaaatttccggaaattccgagaaaatttccggaaagtttccaaccgatccaagttccgatggaactgccattatcattttcgattctgtttccgagaaaatatttccgaattcgtttccgtttccgaaaaattccgaccgacagattctgttttcgaaaataggtccggaatccagaaagtttctgtaccgttttcacccctagacagtactatacgtttcaggttacaatgcgcaccgcgcgatgggatcatattggccggaactctcacgtgggctgacgtggacatacatagacggtacacactttgagaaagtttaatagtataattaactattgactattagttaatataaaagctaatgtgtataataagttaactataaggttggttgatggtttctctcctctctcttcttctcatcacaaatttaatgtacatgttttgaagcaagtgtatgggggttcctgtttcgcgcgtatgcgctaggagcgaaggcgggcgcgcactttcaccgctaatagcgcttagtgtcgttttcttcgggtttcttttttttggataaaaattcgccatgcgtaagtttcttccctttgttttgctgactgaaacaacctttcaactcagatttattcaggattggaaacttttcaactaagatttgaaaactttcaagcctagatttgaactcggatttaaaatttttcaagtcaagatttgaataatttcaacttcaatttaaaaattttcaactcagattttggaactttcaaatcttgatttgaaaattttcaagtcagatttgaaaacttttaactcgaatataaaaactttcaactaaagatttgaaaactttcaacttagatttaaaaactttcatctcagattcaaaaacattcaactcaaacttaaaaactttcacctcaaatcataaaaactttcaactatttaagtcaagattccaaaactttgaactaaagatttgaaaactttcaactcagatttaaaaaatttcaacttaaaccttgaaaacttttaaatcaaattcaaaactttcagcaaaaattaaagatgaaagattcaatttctaaaataaaaaaatcagcaaaaaaacgtttcacggtctccccgcggcggaaaaagagaagcaagaaaaacaaaaaaagggaagagatagactgcacgagggtgagggctgcgtaggccagaaacgcgcgcgacttgtgctaattagcaatttcgcaagtgtatagcctaactcttgcacgagagtcaacactcctcatttttctctctttctttcacataagtttatagttggtttataactcactattatccttactcttatgtagacgtgggcatatatgtgaacacgtggagatacgaatcggacacaagctagcacgtgggaaataagaaacaagaaaaatactaaataaaaagatgtaccagctttttttaaataaaaatacaaatattacatattcaactggtgaatcaatgaaagaaaaataacaaatagttaaaagtgtctcggtgaaaaagatgcacaacacaaacgttagatgaaaaactcatgggttgataaaattatccaatttatcataaataatgtaagtatcttatcctgtttatttataccaacatgaataagtgaaagcaaggaatacaacagaaaaaaattattaactatttggctgagcaggaccggccaggaaagagcccaagaggcctaggagccatcccagttttgggcgatgggcagatggcccagccggtcaaaaaagatcagaactcacgactcacgagtgaggtttcctctatgaattttttttatttataattttttttattaaaagttttacaaaaataattttccattttgaaaattgacggaattagtcgcctaccgccctctgggagggcgattttttaaaattgccctcccaagagggcggcgaaaaatgacgtgggaagacggccgttcgttctcgggcgacggccgttaacgaaaattgcaggcggcccccctttgcgccctcccggagggcgaatttggtactggtgcggggggccgccttgt

SEQ ID NO: 21990 - DNA, 2342 bp, Oryza sativa
ggggtgagggtccattgaagcgggataggagtgaataaagatgtgtagatatcaaagttttggtgaggtgggagcagagagaggggggggggctcgcgagagatcgtaagcgaggaggaggggtggttaagatagtttgtaggatgatatagacggttgcgaaaagcgagatgacagcgagggagaaggggagttaagagagagcggtggagattaagaaggtagtattgtaaggggatgggagagtaggatgggagggagggggaagtgaaaaataaagggatggagagtggggtgtagaagaggaaagagagaagtgcggggcgaggaatggcgggaggataaaatagtagttaatgatgaggggaaagggagatagaagtcggagtgtaaaagtgtaaggtagtgtgttggacataagaaaggagcaaagaggaggtgggaagaaggggtaggttgttgtgattaaaggaaggggaagagaaggaggatgatagaataaggttaagaggggagagaaaagggacgggtcgtggatgggtggtaggaggagtgtgtaatgtgtagattagtatagtagaaagcgggagagggtgaggaagggagaggtttttatgtgggatgggaatagtgtgggagtgaggggggaggtagaatgaaataaagagcggcgttgcagggagaagggggggggtagagagatgtggaagaatactcctttcggccatggaggagggcaatttttgccccccccccctataaagcccagtccctcctctgtgaaatttcattatattcactaaaaatccaaaaaaaacgaaagagagagaggggagggcagcaaaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagatatttagaggacaatattgtagagaatgtaacttagggcgtagtacagaaatgcgaggttaacgcagttaatgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcgaaccgaagatgtggagggtcctagcaatacaggggatgttgttggaccatcgatggaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtttatgaagtgaggtgcattaaggaagattgtccgtggcgtgttcatgcatttagggtaaaagggaatgatttttggaaagttagcattggtgaccgagcacaagtgctacttacaagggtgggagaagtattaacggaacattactttcaatttttgtggcagttgaaaatttcagcaatggtgttggttaacattggcttttaaccaaaattaattttttcgccccatgggaaccaaattcaagttcacctttagctttgcaaaagcctggtgaagcccaacaaaagaatttttgggaatgagttttggcccattttaaaggttttttaagaaaaattggccccgtttgtttaccccccattgtcccaagggaaaaaattaa

SEQ ID NO: 21991 - DNA, 1881 bp, Oryza sativa
  unsure (1)..(1881): unsure at all n locations
atgtggttttggaancccgtctggaccaactcggactttgctcgttctggtcgcagccgattcggaatttagccgatccttgctctatttccggaatgattttcatcttgaattccaccccgtttctatcttcatctccgatactcagattatcaaatttggttattaaacatggatatattccgacgaaaaaaaaattagcttattattgaatttttttaaatgttgcacgatgttccaccaggtatatcggaattgtttcactaagtagatcgaaaatgtttcactcgtttaaatcgggcgttgtttcaccttatatgaaaacaatgtttcagcaaatagcgaaagaatgtttcagttcgctgcaacattatatctatacatagtaaaacactgtgagtactctaggtgaaacatttttcggtggaacaaaaaataaaaaaaattccttaaaatagcttagcttagctagcttgctcgtgcagccgagcggcgccggcaatttctcaccggaccatcgcttggcctcgaagcatctttgtacccaagtgataagctagacgcgctggagtgctggaccgtgtgggcgccctgccgtgccgtgatcgcgttgccgatcgcgagcggcaatctttgacccccgcgaccgcgtacctgtcgtcccccggcgtacgcgcagtatccactatccagcagcacgagcgcgcgcaacacacaagtcacaatcgtttgctggatggagcagcggtccaacgactggccgctggtttgttggtcccgtcagttgcgattcgtttggacgccgtcagcaatgattgccttgctagcagctgcttgattgccaggtaatagcggagacagcaatactctactagtagagtagcactactagttaatgacgtaatgaccaagtactcgtgcacgcacgacgtgtatgcatgtaccgacgtacgctacattccgtgcagtttctttacaccgagtaacttatttactgcacacgccaacatacatcagggctgacatttccaagcgtctctccgctatatgaacgcggatgcacacacaagggaacgcctcttgctctccacaaactttccatcaccacctttcgggcgttaaccaaacgcatcgttcgttcgtctctctctcgctcggcccgcgttcggttgcttgtcacgactcgaaagcctcaacgacaaagaggaggacaaagtaagcgcggctaagcttcgtgcaggcgcgcacgccaagtcgtcttcgccggtggtcaacgtctccaccgatcgatcgagatggcgtcgccggagaggcgatcgtccacgacgacgacgtcgtcgctcctcggcagctttcggacggcggtcaagaaaggtccggttcctgctctccttcagcgcgacgcgggggatcctttccttcatcgtcggctcgcgcgccgggccgcggcgcccggttagcttcggcccgccggcgcggccggctagcctgctcgactacgagggcagcgccattgtgtcgccgccggccaggtcgggggcgccgtcaagaacgcaaccctggggcccgtccccggcgaagaccgttgagccgnacgagcaagggcggcgttcttgaagctgctgaagaacgttaagcgccccggtttttttnttctcggccccccgttggngggggcgaaacacaaattttacggggaaaccaacttgttattggcaacttttaaaaacacatacatataggagcggagggttgttggaacttcggacctgtgcaggaagccatccatggatggattttccgccgtggaggatcgtttttaaaaaattcttgtttttaaagacaaaaaaaaaaaaaggtttgtggtttaagggtgtttcg

SEQ ID NO: 21992 - DNA, 5072 bp, Oryza sativa
  unsure (1)..(5072): unsure at all n locations
tggtgtttttttttccccacacacacatagcacaaatttatttcgggccccaaccggttgcaagcgcacagaatatttttnatagtgtttattaatcataaaaatggaagatgtttttggccctgccctttgctaattcancaagggatgaagccgtgttttaaggtctgttcccttttaaagaaacaagtatccgtttttgagtagcaaaatcctaaataactccactaaggggggattcacttgaaaaggtattatagaatttgggtaataagtgattcgaataaggcccatgaataaccggaaccagtgggctgtgattatttatccgctgttatttatgcactgacacatatgtacaaatatattggcccctaccggttgcaacacacaaacatcttttcaagtctttaatattctaaaaattaaagatgtttttggcttgtactttggctaagtcatcagtgtatgagtcggtttttaagtctgttcccttttagaaatacagatatgtatctgagtcatttttggaaatacaaaagaagtcatataagaaatctttttaaaaaatttgtatgctaacttgaaatgatcgaactcctaattgtagctcatgattttctaaaaaatacatatccaagcgaattccaatagtgcatttcaccttaactaaaccatataaccttaactaaaccatataccaataataagattaaaataaccatcactcgttgcaacacacgggctttttttctagtctctacttacttgaaaaattcaaaatgtttccttcgtccaacaaaaataaaaaagcaaaaaaaaaagtccgattgctcttataaagcgaagaaaaaaaaatagcgtataaccgattctccttaaaaacgaaaaaaagcccgagaaaaaatagcggaaaaaataactaaaaaaagtcggtttcccaaagtggcgaaaaaacaataaaaatctggttttcgtcgtcagtaaaaaaagcaaaaaaaaaaagaacatgctaggaagaaaagtcagaaagaaatgtgccatttctgaaaaatggtttgggaaaaccacacaagaaaaaaacacagtttataaaaagcatgccgctctgaaaaaactattagaaaaaataccgtttataaaaaaccgggttgaaaaaacaatcggatttaacatgagaaaaaatcgttgtttctaaaaacggtttgagaaatactgtctgacttaacaagagaaaaaaaccatcatttctaaacaaaggttagagaaaactgtccgactcaacgcgagaaaaaaaaactgccgtttataataagaaccgctccgaaaaaccgtccgaatcaacgcgagataaaattgatggacgcttgggttggataggatccatcaattttttttccatttcctatacgacttttgtttcctcatctattctattctcatgtattggagaccctgcacgtctctgtatgcaattactagactatttgtttttgttaagtatagctactattcttgataacatttgatatggaaataatattaaaatataaacatattttaaattgttatttagataagagtgcacaatgactctattttgtgtagacttgaccatgcgaggcagtgtaggatttgattgatcctattattggttgcaagaatgagattaaaagagtattttagattatatgcatgttgtcatatgaataatccaattattttaggtaaattaagctttggtaaggttgccatcgtcgaggttggaccattacattgaagatgttccaagtttctgattatcttagctataaatgatccatacaaacattgtcattgaaatagttatgcatagaaaacgtatattatgattatatttttttttcaccgattgcaatgcacggacattttcgctagttattataaaagttcaaggtgtttttgtctcaaatcttcgtacgccgtccgaatttttttcgtcgtcgcgtcggcttagttcccgcatgtcactcagagatgcacacacgctattccacacatgtgatagaggaaagaattttttttatttataattttttttattaaaagttttacaaaaataattttccattttgaaaattgacggaattagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttctactgtggggggggccgcctgcaaatgggcggcgagggggcatggaattttgcaggcggcccccttgccgccctgggggagggcgattttgtactgtgctctatatttttttataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgccgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctacatatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgatatattcgtgcaaaagctgaaacaaaaatgaactaatatctgggctgaactgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccatggcgctgcgacaggagaagacgcgcatgaccgcacgcatcttctcctgcatccgggcgaaggtcaccctctgctcaacgtcagtcaagtgcaaacctctgttcaacctcacctggactgcggtgatatcggcactgatatcccgtgtggcatcagcctatgcaagatggaaataaaaaattcagtagttgtcctatattatgcaagataaatgaaataattgttggaagtaatacaaattggacgtaccgccacgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaccaaaaaacctactccttacagttcaaggggggggaaccccccccgggggttttataggtacccacgccttttccccccggggaagattccctatggggccctctctgtgtttccaccctcgccctttaccgcgaacaccgttcccgctcttttttctttttggaaaaggcgcggcgttttctcttaaagcctcacctccggggtttctcatcttggcgcggggacgcttctctccaaacacaggtttctttgcgcggaaacacacctctttatgacccacaccatggggctctttcttgtgatccctatatgctcgaagacc

SEQ ID NO: 21993 - DNA, 3647 bp, Oryza sativa
  unsure (1)..(3647): unsure at all n locations
aacgcaaaagattaccggttttcatcccaccgttttttgggttaggttgtgccgccnccgccttaacaagctacaaaaatggtaaaaggccttccgcacccaccctgttaaaacaaatttccaaccataggtccacccaaaacaaagttgagttaaaatttgaacatacgcgtaccaaggaacgtaacggggttcgacacgcaaacactcgcgcgacgtgcgtggacgaaagttccaagctgtgcaccctcgactgctgacaggaacgagcggtgtttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtctgaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcgtgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttccttaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctgattgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcgtaataattgattttggttcaaagccaatgttaccaacaacactgctgtacatctcacttgccacaaaaaatgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttccatcgatggtccaacaacatcccctgtattgctaggaccctccacatcttcggttcgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaccaactataaattgactgaaatgntcttttccgaggcctatcgatgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagtgaatccccccgtcactggaccctggttgtaaataagaactccgggaacttttcacggggggcatatatgggatgaaaaccgggccct

SEQ ID NO: 21994 - DNA, 1639 bp, Oryza sativa
  unsure (1)..(1639): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccacctggtgaaggaacaacaagcacgcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctcagactattgttgtactagtagtattgcgaactattcggtgttgtatcataatgttatcgtgatgagtgttcggactaaacacttttgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaaaaggcccggacccaaaaaaaggccgcnnnnnctggtttcatagctccgcccctggcaggttcaaaaaatgggctcaaattaag

SEQ ID NO: 21995 - DNA, 3002 bp, Oryza sativa
  unsure (1)..(3002): unsure at all n locations
atggccttgtgttggacacctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacctggtgaaggaacaacaagcacgcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctcagactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcagtccttctaccactttgtaggcttgttgaggcggcggcggacgaccgtgacccagcgaagcggtgggatgcagaccggtcactccttgccgctcttgtagaccgctggagacttgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcaccggatgagtgttttgtactaacatttcattcttaattgtaggcggaccgtctgcaccctgacgctgacgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccacagtggagctggggttctgccgtgctagcagccacgtaccgtgccctctgtgaggcgtgcacgaagactgacgcgggagcgatcatcgctggctgccctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgttgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatataatttacctctcttcacaggttgactcgacggggacagctagcaggcgcactttgggctccacgtgtacagcagtacgttgacgactgggtgttagctacagaggaggtgatcaacgagctcttcccatacacggagaagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataatataggacaactactgaattttttatttccatcttgcataggctgatgccacacgggatatcagtgccgatatcaccgcagtccaggtgaggttgaacagaggtttgcacttgactgacgttgagcagagggtgaccttcgcccggatgcaggagaagatgcgtgcggtcatgcgcgnttctnctgncnnanccctttggcgtcgtaccttcagtgggnncgnncacccacaggcttctcgcctaccggcgtgcaggaccatctttgcttagacattcgtagtttngagcagngcgacctacagaccgggtttggacggacaagtcagtccacatttaggtatttttggttaaggttttgtcgaaatattaacaggtttaactgcacggttcctattggaagaactcgtttgctttgagcgcggtcgcaagaacaaccgcgctttcggaggttcctagggacgttgccaactctttgggcgcggtggcaggttttttttttaggagacgtgattccttggccacacgggccttaactttttttctaccggtaaaacttggccaaaatgatagggcccccctttttgtttgttttcctaaacaaaccccccaaaaaggggtggggtataaaaatatttt

SEQ ID NO: 21996 - DNA, 2828 bp, Oryza sativa
  unsure (1)..(2828): unsure at all n locations
nttttataggtaattgcaaacaagacgggcaggttctccatacttgagaatagatgtgtaggaaaccaaagttggataggaaatgnaaaaanaataatggttctatcaacccaagggtccatcaatttattctcgcgttaatcgacggtttttcggancggtcttaataataacggcagtttttttttctcgcgttgattcggacagtttctcttacctttgtttagaaaagaatggtttttttctcttgttaagtcagacagtatttctcaaccgtttttagaaacaacgattttttctcatgttaaatccgattgttttttcaacccggtttttttataaccggtattttttctaatagtttttcagaagcggcatgctttttataaactgtgtttttttcttgtgtggttttcccaaaccatttttcagaaatggcacatttctttctgacttttcttcctagcatgttctttttttttttgctttttttactgacgacgaaaaccagatttttattgttttttcgccactttgggaaaccgactttttttagttattttttccgctattttttctcgggctttttttcgtttttaaggagaatcggttatacgctatttttttttcttcgctttataagagcaatcggacttttttttttgcttttttatttttgttggacgaaggaaacattttgaatttttcaagtaagtagagactagaaaaaaagcccgtgtgttgcaacgagtgatggttattttaatcttattattgttatatggtttagttaaggttatatggtttagttaaggtgaaatgcactattggaattcgcttggatatgtattttttagaaaatcatgagctacaattaggagttcgatcatttcaagttagcatacaaattttttaaaaagatttcttatatgacttcttttgtatttccaaaaatgactcagatacatatctgtatttctaaaagggaacagacttaaaaaccgactcatacactgatgacttagcaaagtacaagcaaaaacatctttaatttttagaataataaagactagaaaagatgtatgtgtgttgcaacgggtagggccaatataatttgtacatatgtgtcagtgcataaataacagtggataaataatcacagtccattgtttcgtttattcatgtgcttatccgattcacttattaccaaatcctataatactatacaagtgatccccacttagtgtagttattaggattttgctactcaaatacggatctgtatttctaaaagggaacagacttaaaaaccgactcatacactgatgaattagcaaagtacaggcaaaaacatcttcaatttttagaataataaagactagaaaagatgtctgtgcgttgcaacgggtagggccaatataatttgtacatttgtgttagtggataaataatcacaatccattgtttcggttattcatgtgcttatccgaatcacttattaccaaataaaagactatttgtgtgcaaatattttatatacatgttcttagcgactcaaaagcaaatgttgtaaaataaagtacaataaaaaaaaccaaaaagttgaattcagaattaagttcaaaattttaaaatttggcttataggaataagcataagccaaacaatgaggacttcaaacacaagctcgatttgttgtccagctttctctcaagtcgggcaggaattgatgacggacggaatcaacaacttcgatcgttctttatttcagttggcatgttctttttgaaagtaaaatttattcttatggattatttgtaactgtatccctggtagtacgtacgagcatgtgtaaagactaacttgaaatcatgctaacatgtctcaagaatcggatgatccgggcaatgacgtacgtgatatccacacggactatgcgagtttcattcgcttgatatccacattgcacggactctctttcgcagtttgctcgcgagtgtcacttcgccatgaatgttacgcgtgacgggaatcgaatatggatgacgtaccatagttttgacaaaacaatcttcaatttttaaatcgtgcgcgagggcgacgcgatcccagtaagacatgcggcaagggcagatcgcgcttgtgagggtgttgcgggcctagtggggcatgtaaaaaatcgcgagtgagaggacgttgcgggcccaatcacggcggcgcgcaaaggcacatgtggaaagcagactcaggcacgggcccgatcgctgtgtgcgtgtttaaatgtgctggcccgcccatctcggataagaggaacagtttggcggtgtaaggaaaaaaaaaggaaatgatttgacagaaacataaaattaaaacttattcaaacacggatgatgtaccaaaattcgagtggaaacatcttcaatttttataatagtagagactagaaaaaatacatgtgcattgcaacgggaaaatgctattttaattttattattgttatacttttttttagttaaggtgaaatttactatgagaacttgtttggatatatattttttttagaaaatcaggagctataattaggagtccgatcgtctcaagttagcatgtgtgttttttaaagagattccttatattattacttatgttttttataaaagcaatcgaacttaaaaacttacttatgctcggatgacgtaccatagtaccgataaaaacatattcaatttttataatagtagagatagagatagagatttacaaactctcaataaaaagaatcaataaagttgctntctcgtgagncgatctgcactcaatggcacgga

SEQ ID NO: 21997 - DNA, 23142 bp, Oryza sativa
  unsure (1)..(23142): unsure at all n locations
cgccacacctcgtttttatttcttccaaggtggcccccgaggaaaatagttcttccggggggtccaccaaaaattattcacataaaacccccggggtcctaaaaaggggttttctcacccccacctgtgtgtggagcgacccccccccccgattgaaactccccggcggcttactatagagaagccccccccttcacaaagaaaaaaagcgcgaatgttttccgttaacggcagggtgagaaaagagaggcgcaaaagggcctttccgggggaacccgcgtggtttttataaagccccgggggggtttccccccctcttatattaaagcttttttttttttatttctcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtgtgtgcacccgcgttcatataacggagagtcgcttgtaaatgtcagccctgatgtatgttggcgtgtgcagtaaataagttactcggtgtaaagaaactgcacggaatgtaccgtacgtcggtacatgcatacacgtcgtgcgtgcacgagtacttggtcattacgtcataaaacagtaatgctactttactagtagaggattggtggctccgctattacctggcaatcaaacagctgctagcaaggcaatcattgctgacggcgtccaaacgaatcgcaactgacgggaccaacaaaccagcggccagtcgttggaccgctgctccatccagcaaacgattgtgacttgtgtgttgcgcgcgctcgtgctgctggatagtggatactgcgcgtacgccgggggacgacaggtacgcggtcgcgggggtcaaagattgccgctcgcgatcggcaacgcgatcacggcacggcagggcgcccacacggtccagcactccagcgcgtctagcttatcacttgggtacaaagatgcttcgaggccaagcgatggtccggtgagaaattgccggcgccgctcggctgcacgagcaagctagctaagctaagctattttaaacgtttcacttttactcagtcgtcagctactgcagtgctaccattttattaaaccttaacaccagtaccttttttttaaaaaaaagataaaccttgcctagaattctaaagttttgaattaaagaatgtcgcatgatctatatgatattgttccattttcgttaaccactactctattataagtcgttttgatattcttttgattaatcttttttagtttaactaaatttatagaaaaatatagcattgtttttaacacaaaacaaacgtattattaaaatatatttaatgttgcatttaacaaaaactaatttggtgttgtgatgttgtcattttttctataaaattagtgaaatataaaaacgtttgactagaaaaatagtcaaagtgacttataatatgaaatggaagaagtaactcgcaatgaaaaaataataaacaataaaaaagttatttataggtaaaacttttaatatatgtgctggtttaaaagttaatattgaaaaataaaactatgattaaataactctaattattttaaaattaagttttttaaattacatttgggcagcagatcaaaatgataagctaatgagcaagtgatgagtgtgtatggtaataaatactccctccgtaagtcgtttaggacaatgtataagtcaaactttgggaatataaatcatgaataactctcaagttagttgttgagtttgaaaatgtaacttacaattctacatactgttgcttgtccatgagcacaacgtgtcttatgttaatcgggaaaaagacgtgtcttatgtatgttgccgtggaaccagtaaaaatcagcttgttctcctcggatcttaatcaaagaatgggtttacaattcataagttagcatcaattatctgctaaccttaataattaattctgaattatggaatattataacgaagtgtgtgagaattagtgtcgaacacgtcaacttaatcatgtactagagtagaattgtagatcaatcaaggtgcgtgcagctctgaattagttaggtcagactgacagattgacatatatatatagactcccgttttttcctccttgagaagttgagataatcggatatgcacagtaaccagttggccacgtgatagtaaaattgctcttttttggctccagagttgactgatgtttgttctttcgccacactctctttttcttttctttttttttttgcggggaaccggagaactttatcgatcaactaaaagtaggattacaatggcaagccaacagctcagaaacacactccggagcttgctcacgccaaaccatagactgtttcgttctcctagctagctgagcgagaccatgcgccaccgcatttgcctctctgcagattacctcaacgcggaaagaaggaacaatggggatagcagaccgaacctccctcaacacgagccagagacgggatctgtcgttttcattcagtgctatagaataagcaacatttgcgcagtccgtttcaagaatcaatggctgtgtttagttggatcgaaagtttaaattttggttgaaattggaaataatgtgactgaaaagttgtgtatgtgacaggttaatgtgatgaaaaaggagtgaagtttggatttaaacacagccattggttgtttcacggattgcggcggcccgccccgcgtcccgcactgtccgcatagaagtttgaggcatcttcccacaagtatacccgctgggcacctcgtgggtttccgccagaacccgcagtcagcccacatatccacgcgtgcgcagttaaggccgaaaaggcttaagggtgagtttaagaaaaaggagattgggaagatgcgcaaaacgaggtgagtcattagtgtatgattaattaagtattaactattttaaattttaaaaatggattaatatgattttttaaaacaacttttctatagaatttttttgcaaaatacacaccgtttagtagtttgggaagcgtgcgcgcggagacgagttgttttctcaccctatctcacaccaacgaagtgtgaatgcattgatgcaagctctgccgctggaagcaggtgctgcagctagcactgatgaactgctaaatatcacagcgtttgttgacatgcgtgttagcggagcagtcacacaatcaacgaaatcggccgacactgtgccacacacaggacgacaccactatcaacgaaatcggctgtatcgaattgcaacttgtttctctatatgatgtccttgaatgcaagagctcgaccgtcactccgtttccgctagcactggaactctggaaggttgccgtcttcctagtgctgtcaagtgttcgatgtagttcttgatcgcctcagtgagattccatccacggtatatactatttcacgttgcccattcattccatttttgtgcttggtatcgctgatgaaggttatgcaaacttagccggtctaccggtatcatcttcttgctttccggggtgacatgctccaggtagggattttatgtttccttcggcttggtgctcgtctagctgaacaatccgcgtcacatcgtgtcccatgatctacagaccaaaatccctcaatccccaagttgaatcgagcaaaaatacatacgtggatgatgatgtttcttctaagtagctacctgctatggctggccgccatggccatgggttgatgcagctgtcgtttcaaaaatgtttctagcaatgaatgttgcaaaagccaatgaggacggtttgcgcggtagctgcgatgaagcaggaaggacgatggcgctctcggcgagggcaagcgttccgcctagcgtcgcggggcgggtgacggcgccgctgggcaaagcgggtcgcccgcatcaaccaacctctttgaaagcgggttagcatatgtgggtcagtgggctagtggggcgggccaacccagcgggttagcggcacagcccgccccacttatacccttagtactttcacccattctgccaccagccggattccatctatacacgcaagagcttctgcctgactgcctcttctgcggactggcagttcctgattatattccaagaagaatccaagaagaaaggatcacaaaagcccgttcctgacgataatgcccgttcctgcttcccctgtcgcaggcaaaagcaccatcaatattcacttttgcaacactctgaatgacaatcggccgtaaaagccacgtgtcatacacatgtatctccactgtttggaaaagatcactttacatccctcatctaatggttcagtttcaattacgtctcttaacggcaaaaccagtgtaaatataattctaagaatatattgagactgattttaactaacgtgacggtgagacttcttcttctaccctccttccctcttctcttcttcctcatgtttcttccctaatcaccatctctctcaaccagttatctcatggtggcgcccggcggaagaggcccttgccgctcatcttgccggcggaataggacccacatgttagtgagtacaataataaaaataaatatcggccccatgtgtcagctaccctttctcctccctctttaccctttctctctcaggtggatagcgccgacaggccgtggatggacaccgcggcagcgggacaaagcacgatggtcacgccacccctcccccccccccggtctccccgacagccgtcgccgcagctgacatagatgggtttgcctgtgtggcctccgcctcgtcccttaagatcccctcctcccccttcttggatgacgccccgccgtcctcccaactactctacgtgctcgagtcaggatgtcataggagatagacgagggtgtcggccgtcaccatgccgacgagctcctcctcacgtgcggtgcagccggctggctgccaagctcctccctcgtgatgatggaaggtgagagaagaggaagagataaaagagagagtggggagaggtgagggagagagaatatggcatgaggtggaggccattgataaagtgggtcccatttgatgactcagcaagtcagctgccacgtcggacgaaactgcttggggatttgcaatggttttgggagttaggggacaggttatacccggttctacggttgagggatgcgattcaaaaggggcatgaattgagggaggtaaaatagacatataaaaaacaagtgagaagattcgagctcattgtttcatgcgcaggcctaaactcgacccatagtaaaccaagtgagacccaaacacatttaactctaggccacattgctgccagcattgcagcccaaaccaaaatgtgtgtggatcaatgaacctgtcagttcaaaaataaagagaagcaacgagcatgcttctccttccgacaggatctccgtaattgattcatataatgaccctaaattttaaaaccagatatccaatccataaaatttataatactgtttatattgcctctaaagtggttttggaccttagttgtacgaattttaaagtttaatcgggcgattttgaaaatactaacatagtatacttacatatcataatcattggcccttacatatcataaagtttagtactctgtagtgatgttatatgctagtattctttatataagtgtgagataaggggataaaacggacatttaagtgaagatttaacatgtactatgttcaatgtgcatatcacatagtaaaactcatccaacatatatgcaaccaacattgtatgcaaaatatatagacattttgtaaaatcaccataaaggattacagaaacgatattataaagtttaggtgttatatgtccggttttaaaattcaaggtgtttgttgaacttttatctaaagtttagggttatatcatggactttttccatcgaacaacgaaaatgtgtgtcaaggcaatattactgtgcgcgtggaactatagcacggtcaatctcaaaactacctctgattggacggctgagattcaagcaatatccctcgtgttcccactcccttcctcctgtcctgcctgccgaattcggaaaagaaaaattaaccacactatagggtatatgacagtgctcagttccctttaaacttctaaaaattccaccacatcaaatatttaaagttttggacacatacataaagcattaaatgtggacgaaaaaaaaccaactacacagtttacatgtaaattgcgagacgaatattttgagtccatgatttgacaatgtgatgctatagtaaacatttgctaatgataaattaattaggcttaataaattcgtctcgcagttcagaggcggaatctgtaatttgttttgttattagtttacgtttaatatttcaaatatgtgtttgtatacttaaaaaaaattggtaaacgaaataaacccggccatagaaaggaaaaaccaaagtgggttggtagccatgtgaaagtctgagcgacgccacaccccagttcggacggacacgatttgccaataccacccccccaaatatccgacggctacgaccagcttcccaccagcaccgtaccaaccaactaccacagcaacgcccgcgagcaagtccaaactgcagaaagttgtcgtcaaactcgtcacccacatcgaccggagccggccgcctcaacgcactcacaagtcacaaaccggcacgcacaccacaccaacccgagaccggctagaccgcgctactggacgcatagccccaaggaggccacaggaccgtggatgcttcgacttcccacgcacgcacgcacgcacggttggtgaggaccaggctgaccgagggcggtgtcgcgcgtcggcgcgtgtgtgtggtccggtgtggggggattggtggtgccgtggtggtagtagctcggctccagatgctcggtcaaacggccaccaaccataactccattttggactggtcccgtttaatggaagtatggaaccgggcaaacgacgcagagcaggggcgtttcgcttcgcacatgatactactacactatgcacgcatggaacgcgtggttggcatttggcaatgcgtacagcgtagtgaggagtgacccggtgagcactcagccactgtgcactgaaccgttcaggtggtttttttttttttgcttgtaagaacacgttcgtgtggatttagttagcaaagggtgtgttgagttccacgccaaaattagaagtttgaagaaattgtgatgatgtgacggaaaagttgaaagtttttgtgtttagaaaagttcggtgtgatagaaaagttgaaagtttgaagaaaaaagttggaatctaaacagggccaaagtgtactgcacagatggtttcttgactgtagtagttttttgtttttttgggtatatttagttcacaccaaaattgaaagtttggttgaaattagaacgatgtgacagaaaagttagaaatttatgtgtgtaggaaagttttgatgtgatggaaaagttgaaagtttgaaggaaaagttttgaactaaactcagcctttgttgagcttatcaagccccatcgtctcatcggttggtgaagagctctgattacaagccaaaacgatttattagcgcacaagaaataatttgtaggtaattgtattatatatgtcgttagcgatttaaaaacaaattaaattattttaaaaattaaaatttttgcaataaataattctttttatggcaaatgatgaggttctatatgagaatatctgatttacgtggaaccatactattttcatgaaaatccacacataggtccaatgatttttcttccaaaaataagtctttaggcgatgcttcacttggcctagttttttagtgatgtgatcaggttttgtattatactacctccatcccatattgcttgtcgctttaagttttattttaatgtttaatcattcgtcttattcaaaatattttgaaattattatttattttgtttgtgacttgttttatgatcaaaagtattacttatcatgttttatatttgcactagtttttaaaataaaacgaatggtcaaacgttgcaagaaaaagtcaaagcgacatctattatagaacggagttagtaacctctttccatctggactcaagcttgctaatggataaagtgcatgacataaatgggtactcaagcttgctaacggagtgcttctttgtttctaaatatgtattgtgtggatgtgctaaatctaaagaagattttattgagaaaaaacaatagttaccagcctattgaatgacacacaatgtggtacagggacgcgtagagtggatgagcattggagtggagtagatgtggacctgtttagcaggactactccatctaaaaaagaacagagaggattaaaatgatgtaaaacaaataaattaaagaggtgaagcggtgttgggttacttcataatttcacttcagacttcgctcttagagttatttataggagtgaaaatcctaccatgttgaatccaaattgattttacatcttccttttaagaattaagtttagataaatattttacttgtgttattagcaatcataaaaacagacccaacagccaagcactgaaacctacgaaggtaatccctaaacttaaccataaaattgaataccaaaatctaaaatcagatccttttttttctttggcgagtacaagtagattctgattcacaagctgagcaaaagatgcgttcacgctcaggtgcacgttttgtacagtgtgaaatgtattgttcatgttgcccaattgctggattagtttagagtaaataaaattcttaatttaacttagccactgtcctagcacagcagcgaccactctctttggacatggaccggcgatctggggtgtgttgggaatcctgttcctaatactaagtgctcgcacggaaaacgtagtagcgattagcgagtaattaattaagtatttactatttttttaaaaaaaatagattaatttaatttttaaataactttcgtatacaaactttttataaaaatacaccatttaattaattgaaaagtgtgtgtgtaaaataaggaagatgggttgggaagaaggaccggtgatctggtcttcgtcctcctcaagaagtcaaaaacacaaccattccgagctcccccaccaaacaccatttgcctccactataaatccgagctctccagctgcttccactcctcaggaatcggtagttgtcatcacgcgcacttccattccgctcacctacccaccggagaagaggtagtcgccgccgccgccgctgtcgccgtcgccggagaagaagaatgggttcgttgccggagcagttcgtcttccgctcgaggctccccgacatcgccatcccggaccaccttccgctgcacgactacgtgttcgagcgcctcgccgaccgccgcgaccgggcatgccttatcgatggcgccacgggggagacgctctcgttcggcgacgtcgacgcgctgtcgcgccgcgtggcggctgggttgagctcgattggtgtttgccatggtagtaccgtgatgctgctgctgccgaactccgtcgagttcgcggtggcgttcctcgcgtcgtcacggctcggggcggtcaccaccacggccaacccgctgcacaccccgccggagatcgccaagcaggtggcggcgtccggcgcgacggtggtggtcaccgagccggcgttcgtcgccaaggtgagcggcctcgcgggcgtgaccgtcgtcgccaccgggggcggcgccgagaggtgcgcgtcgttcgcgggcctcgccgccgccgacggctcggcgctgccggaggtcgccatcgacgtcgccaacgacgccgtggcgctgccctactcgtcgggcacgacggggctccccaagggggtgatgctgtcgcaccgcgggctggtgaccagcgtggcgcagctcgtcgacggcgagaacccgaacctccacctccgggaggacgacgtggtgctctgcgtgctccccatgttccacgtctactccctccactccatcctcctctgcgggatgcgcgccggcgccgccatcgtggtcatgaagcggttcgacaccgtcaagatgctgcagctggtggagcgccacggcgtcaccatcgcgccgctcgtccctcccatcgtcgtcgagatggccaagagcgacgccctcgaccgccacgacctctcctccatccgcatggtcatctccggcgccgcccccatgggcaaggagcttcaggacatcgtccacgccaagctccccaacgccgtcctcggacaggtataacccaaactagacgaacacaaggaccaaatcaaacaataaaaacaacaacaacatccaagtggaaatttgatgtgaatttgatcgagcaggggtacgggatgacggaggcagggccggtgctatcaatgtgcatggcgttcgcgaaggagccgacgccggtgaagtccggcgcgtgcggcacggtggtgcggaacgccgagctgaagatcgtcgacccggacaccggcttgtcactcccgcgcaaccagccgggggagatttgcatcaggggaaaacaaatcatgaaaggtacacacactgcccaaattcattcacaattttttgagtttactttcattcgaaaaaaaacggagcaaattttgactgggtcgaagctgactcgtcgccggttcttggcgcgttgcgtgtgcgtacgtgcaggatacctgaacaacccggaggcgaccgagaagacgatcgacaaggacgggtggctgcacactggcgacatcggcttcgtcgacgacgacgacgagatcttcatcgtggaccggctcaaggagctcatcaagtacaagggcttccaggtcgcccccgccgagctcgaggccatgctcatcgcccacgccgccgtcgccgacgccgccgtcgtcccgtaagtatccggactccggcatgatcaacctcgccacgcgcgcatttggcattcgcaatttcaggctctgaacatcggcttgacgactgaatggctgaatttttctcaacgatgcagaatgaaggacgattcctgcggcgagatcccagtggcgttcgtcgtcgcacgcgacggctcggggatcaccgacgacgagatcaagcagtacgtcgcaaagcaggtgagagatcatgatcgatcaagaatattggttctgcaaactaattattaaccttagcatcgaggtgaactgaacgctgggtttatctctgaataatcaggtggtgttctacaagaggctgcacaagatcttcttcgtggacgcaatcccgaaggcgccgtcgggaaagattttgaggaaggatctgagagcaaagttggctgctggaattccggcgtgctgatgaaactggcatgagctagcttgcctgagatatccagctattgtttggtttttgttttgatcatacttaaaaagatatagtgaaatgtaaacatgatgtagtcagcaatgtaaaaggaacacgccctctggatatacatgaaagtttgagaggtgatctcatcggtcatcagtaacacaaatttgtcgcaaagatttttattttttgttgttgcacccgtgtaaaagtgaattgatgccattttatttgttggagaattgagacttgagagtactattacattcagtagaacagttacaaaattactgaattgcatacagcctgacagaagattattcttcctagttggaactgtaggattaatacgttgtggtagaggaaaatgtgcagtacctgagccaaatgaacaggactggcttgctctatgtacaaaccaggatggaagggtaactggttagttaatttaaacaattaaaagaaaacgaactccaataatgaaaggcgttgatggtgaagtaggtcagccgcctgaatgacatgctggtaatgttgtaaattgcccatctttgaaagcatgaatgaactgctggggtaaggaatgctcggcctgaaaatattaaaaagagatgactcagcctcacattgtttgcctttcactttataagccgtcgccaaaatttgaattcaaaacttaattttcgaattttgctaaggacacggatataatttttctactcacaaattatatttttgttgnnnnnnnnnnnnnnnnnnnnttatcagctacaggcagaattggcacgcattatggtacaatatgaagacaaaaattccacatttctagaaatccaacttttcaagtgtcaagtaaagtggttgaccttggctcaattggtaggatattgtgggtgtacctccccataggttaagactgagtggctctgatttgggtacctttctacgattcttttcttaaggagaaaaagttcctgctttctttctctaagactaagtacagtataattattattatgcagaaagagagaaaataaggtttagaaaccttgaatcttgagagtcatgaaacgaataataaaaccaaaaatatataaatagctacttatacttgcttcacacgatctaactatagtccaaatttaaatagaagagaatcaaatggtgaatgaaaagaatttagagaagtactcacccaatcgccgtcgctgtttgcatctggaacaagagcattgatttcactagatttagcagttgttatagatgtctctaaagattccttgcttaaataaagttggcagccagaagtgttatcaatcgatatagttggtacagagccctgcataattaagtaaattacatatgaggctattttcatcgatgagaccaaatccaaactactccattcaacaaaatattggatatcaagaaagcagatctcatctacctcacattggacctctatactgttgcagttcacaatttcacaagcagcgacaacaccctgaattatatgaagagaattagtaaagaaatcaatatgcattagagatgctttactttttttgaaatataccttgaacaataatcccattttgctacacttatcaatagttatgttgttcacttttcctgcaaaacaatacagagaagcatgcttaatcagttcgtgtcaacaataatgcatctcatgtaagttctttaagtagattgacgccgaaatacctttgacctgtagcacagaatccttgcatccaaatacatatatggattgcttggtatcacaatcttcaattactaagttcttgttgccaacatgatgttcaacaatccatctgatagacaatggcgtaaatgatgtgagattactttcattcattttgatatttctggacacaataattcaaaaagggaaactgcagttacttgcgacccatttggagctccaatttagaaggtaatttggttgaactagaggagggtttcttatgagcttcttttccttcagcagctacaacaccagttctatccgttctattcttgctcttcatgtcagctgtcaccgtcctaagacctgtagaagatgaagcactactcatcacatagagtacataaattgagaatgaaaaatgtggtcactgaaatccaacacgaaaatgtattgaccttgtgtcattgatttcccagagctgatttcagcgaagactgcggacattccggtttttggttgtgatgattgagctgaagaactgaaaagagatgcagaaggagggcagggagcagaaggtgctttgcttgttgaactcccaggaggttgccacacagggcccaaagggtagaatgtcttcacatagtcacgcaaactaggcacgaagagctcttttagagcttttgcccactctacatgatcagggtccttgcttttgtactccacaagcacctgaaggtaatttcatttgatattagtaagattaagcctattcaagatttttcgccgggctgaaacacactggacaaccaaggaggaactaactaagaagaaagtgtgagcgtgtcaagagtcgaacatgggaccacgaggttgaagccgcacacccctaccactacactagatattggatcttggctattcaagactttaaaaatgtaattttaatttcccacaataagtaatccgtataaatacgcccgtcatcgattaagtatgaagcaggaatcaatgcacacttgcatagtatcctcatcttttcatcaaaaggttttgtcaatgttttatttctcaagtcttgaacaaaggaagtgcctatgccgtgttactgtaattctgcttttcactctaggaaaaaaataaaaaggactgctcagtttcttggttcttttaaatctctgaacaaaggaaaaatcatgggcattaaccgaatgtctgttcttgatctataatgttgtttcaaactgacatcaatcctcttctttatgttaaaaacagtaatactacaccattgtaatttgcctccaatttgaagcaccttaccgccttaccagaaccagaccacgacgagctgtgtaccgctattttacttcagaacttgtagttgaagttactgaccttattgctgtagaactctgccatttgccaactctcttctacatgagcaataggaaggggcatacctgaaaaaataaatccacaaaccaattagcccccacactatcaaaccacttactgaggaaaaacatcagtttgcaggattgaacttgaacatgtattgtcgcaatggcgcatgcatgtttgaagttttctgactaccaagtacttagcctaccgaaaggttgggactagacactaaccgcaacctttgccggtgtacccaatccacgccagagcggccaggctaccggcggctgctttcagatggttgccatggctcgatcttgtcccctctgccaatgaatttgcctccaatattgtttcattcagaggccccatgaatactgcgatggaatccacggttggcttctgcgtgtcaaagcgatcgaacacattaaacgcaatcaatcacaacaatgccaatgtatcctcaaatgcgtgaacaaataggtgcgaattgcgacgaattcgatgtgaatctgcaatctattaaaagaacgaaagaaagaaatatggcaattttttacacctgagtttgcttggtcctgacaagaaggtccttcccaaccaagaacgccttctccagcaccctggtcacctccgcgacctccgccccgatcttgccggccgccgccgacaccctcccgacggcgccggcgacgagctcgtcgaacgccaggatcgctgggtcatgcgccgacgcgtggtcgacctggccgccgtagccgcctctcgccgtggcaccggcggcgccattgagagcttcgagccgggacaccgcggcctccagcctgcccaccagggcttcgtccatggcgtccgtccgtgcgtgcgtgcgctgcggatcgctaaggcatttgagaagagagaaatggcgaggcgagcgagagaaaatggcggaagttgatccggtgccgggagagccgggcacgtggacatgtgtgcgtacctgagccaacagaagttgcaagcatttctccctgaaaatgcttatcatcgaagaaggaaaaatgggacaccccaacccaaaggagtagtagtggcgtgacaagtgcatgtagcaaatggagtgtttatgcaagtcacatagattcaaaatttaaatggtattttctcttaaactatttatctgaattatgaactaattataccattggatttgttataattaactctttataacaaaatctcatatgacaatattccgatagtttttatgacataatgttattccaatgtttcaataagtgtttactcatgttttattgattcaggtataatgttgcatgtggtctttttatatgcttcagtaaatatattttgtgtttcaaaaaatacaacttgacgtttcaagagtgatataaaattttaacaaaataaagtatttgcaaatatgttgcatcatatatatttttatgttttcctaggtaggacctaatgtttcatgtaatgatggttattgttgcagccaataatttttatatagttattgttgcacgtgatctatttatatgtttcaacaaataattttttttatatttcaaaaattgcatgttaatgttttaagaatgatataaaattttaacaaatcaatatttgcaaatacgttgcatcatattttttttatgtttcagtagttgggacctagtgtttcatgtgacggtggttattgttgcatttagtaatttttataagttacatatatctgaaacattttctaaagtaggttgagttatccgtacaagtgataaaacaaaggttgatttttctaaaacacatatagttgcatggcgttattccgatgtttcaataaatatttttctgacatttcacaagtttatttgtgaatgttgcacgtggtattattggatgttctagtaagtattttctaatatttcactaactcatttataaatgttgcacgtgttgcttgggatgttgcaatgaatattttctgatctttgaataattataactcgttgtttctcgtataatatataaatgtttcaattagtaatataatcatatttataaattttatcagaaatatagctaagtgagaccttattgtaaagatttaattgtaatgaacacaatggtgaaatcggatggtacatcggataagtaatttagaaggaaaaatagtttaaaggtttattggtagagaagatgaatagagagacatgcacgagagtagggtataggcttggagcatagcagcttaactatgatggtttttctttctttcttttttttttttgcatgcagtcaaatagtagtatgtgggtgaacaacgtccgatcctttgctaaatatcggacgtccaatgtgtagcaacctctatttctccccctaagtttttattttgtttccatgtcagcatttcttatgccctgtccccaattgccccttccggaatatcgatttgaattcctgaatttgtcatagttttaaataacaagctataagtagcttttgttatcatatattcggtgttatgagtgtaactagagagtagagattgaagtgacccatatgatatgatagatgggctgatcaaccttgccattgataataaacacccttaccctctcttttttccatggcatgagagaagccaagataacctccgcgttgcaagcctgacatgagagaagtcaagataagctccgcattgcaagccgagttaggataagggctcctttgattcaaaggatcggtataggattttttccataggattcacaatcctatggattatttcctatggaggcctttaattcataggaaatgaaagaaaacattcctaaggattgcatccctttagttcattttcacaggaaaaaaagaaagaggtctgacctctttggaagagaaatcatgtgttttttcctatagcactattaaagggcacatttcatcttttcctgtgttttttattctcacggggttgaagaatcatactactttaattcctacgttttttctattcctatgtttttcctatcctgcgaatcaaagggaccctaaattccagcatatatatttggtggatgatgtagtcgttgtattttttcaacacatgattaattcaaccatcgtgagaacgagctcctattcgatgcttgaattgaagctcctagtagtgcacaagctgtgccacggccttcgagccggccgagtgtatcttagatttgcaatcggcagatcgcctttgagctctcccacggtgtcaagtgtgaactcctcaccgtcgaccgcaagcaccatcacgcgagctttgcttaaaaaaaagtgaggacaaagtatgtagaaaagatttatgttgatttgtgagggcagtttataatctataaaagctgccagatataagtgggcccagcctcggagaggcgggaagttacaaagtggtatcagagccgactctcgcggtttcacgggcacgtgtgtcgcagttgcacaggcatggtgcgcatggctggtgtgaacccggagtggtcacacagcatggcacatgtgctggcactgggtctggggttgatcgacgtccgtcgatctctcttaagggggtgaggatgtgacatcccgactcagggcttaataggattaatagaatactcatatcaacaagttgcaacttctttttcggaagtcgatctctaaagaactctgaggttaagcatgcttagtcaatttagggatgggtgactaattgggaaattctcccgagtgagcatgagtgaggacaagacttatgttggtttgtgagggcagtctatgacctatgaaagctgcaagatgtaaacaagcatgcgcatgagtgagaacaaacaggcccggcctcggagaggtgggacgttatataaaatatcaaaaatccattatattaggggacggagggagtacttaataactaaaactatagttagtcttttaatatcttgcttaataagttaatatgtctttaactaattaaaactatacttatttaattaagaacagagggagtatatgccattcttttatggtaattcttgtaactttaatataaatgtttcatgtgtttgacccatgctcagccattgagtgttatattcttaattgtttgcgtgtaacactaataatattgtgtacatttcgttgtttgctattctgaactatagtctagtaaagtaaaccgattctttgatgtttgttaggcttatgtgtctaactaattgaggatcacacaagaaagggtcgtcattgaacacaagccgaatcggctctccctcgtaagctacctttttcttgtcttttcgtgttatcttatccttaatagcaagattttcttaatggtaccaaacaactaaccttgccaaattaggctaggcttgctctagccttatatccaacaaaaaaaaaactactcaacagcatcccgtacacacgggataactactacaaataaaaatctagcaccttatcctcttatttgtcgcttccccttccctctccctctctctctctgactaccaccctcatgagcacggaggcgacgatggcggctagctgtgcagggtggcgcgttgggtgtggaggacgctcggcccgctctcctttgccagctcaggaactgtcacgccccgagctagtcccgactggaattagcctgtgacgctccaaattaacctgttaatcgataccagtcccaggaaacagtgctggtatcacaggaagatagaatatcacagcaacagaggtctctttattatagagtaggagtacagtcatgttgggctgcggacagatcccgagctcacaactgcattacaaaagggaaacggaagccagggcttggaccaaacaacacaggcgcgacttgggaactaggccgaaaccctaaaactcatcgtaaccggcttgctcctggaagaactcgtcatcagcaggatccgcttcatcttcttcagcaactgggggggttatttatatagagcaagggtgagtacaggagtactcagcaagccaggggaaataagtgtttaatgcaggcttcaaagaaaggctggtatttttgcaattgattttatttgaactcttttctgaaacaactaagtgagtgcttctcaaacgacacggttgagacagtgcgtcccgtccggtcggagtatgtgcaatgtatcagtctttagatcttaaaacaaggttggcactcggccaacagcttttcaacggccacccgggccaacaacttttcaaacggccacccgggcctagctgatcccgtcagctacagatttttcaaacatcaaaccccttttcacaacagcaatttcacaagcagtagtcaaacaaaactacgttaggaatcacctcacatccgcccatgaccgtgggcacggctgttcgaacagttagttaacctctgcagagggggtacactttacccacacgacattactaacccggatcgcccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcccaagggggtcctctccgacaccaccccggcaaatccacatgtctctcggcatcatggctcccctgataagctagttactcagccaggggtgtcccattccacccatgtggtcgtacttgtcttatgttcggatgaaatttcaaggaatcggtccttaagtgcgggagcgggaaaaccgtacacccggtacgttccccggtccgcggttttggaaattcatttagttcgcaagcaccgacccaggcgtcgggttttccaagtcttttgtaaaacccaagttttacccaagttgtttttcagattttaagtttgaaagcgtccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaatcggatttacggttgggaagatattgaatttctaagattattggatttttggtctgaaggaaaaaggatttatttaaacccttttggaaaaagaaaaggatgagggagggaagatagacttttcctcgggcggctagggcgcggcccaagggaaatggagcggtccggccgagttaactgggcccgacggcccaaaaggcggcccagaacgcgcgcgggcgggaaagagagagggagccggtggaccgggctcaccacgcgtggtcccgggtgggacccgcttgtcagcggctcggctcaccgtgcggagggagcacgcggcgcacgcgcgcgggcggggagggacgcggtgcacaggcgcggttcgcggtgaacgcggatgcggcgggcccacgcgcagcctcacggctcgcggtggaacgcgcgcacgggaggggctgaccggggtcggcccgtcccgtcctcggctgagctggcgccgacgtggcgcctacgtggctgccacgtgggctagcgggaggtagacgacgacgccggccggaacggacggcggacgacagcggcgaacggtggagcgaaccacggcgatacaggcgaaagcgagcacaccgggtggttgcacaggacgaggggagacgagccaacggctcggattcgccggagggagcttgacggcggcgaatcgcggcggcaacaaccggcggggagggaagagggaaacggcgacgaggccacgaggggtcgattcccggctgtgagagcatctatgcggctacgggaactcgatgctagcgtcggattggacggagctacgccgagcgaggctggcgacgtgcgggtgctacggagctcgagcggcgacggcggcgagcacacggcgagcgacggcaacggttggggcggcgccggctagctacggggagtctactcgtgctaccaccgaaaactaagggggggggagatggagcgaggaggaagaacggagtccccttccgcgtcctcgaacgcaccggttctcccggcgctcagcgaaggacggcggtggcgagacagagcacgggggcgacggcaatggcacggaggcgaatggaagaggaagggaaaggggaggctggggtttaaatgggcggcaatgtcggtttgggaaccgacttgcgcggtcaagggcgcgagctggcgctcggcggtcgcggccaaagcggcgacagggaggatgacgccggcgaggaggaaaaaggggaaaaggagggggagaaaggggggcttgcccctttgccgattcgggaaaaaggaggaggtgagcgggggcgcgcggctgagggaggagggaggccctgcctccgtcccttggaggctagcgcgggagtggcggggccgatgcaattaccacgggaattacggggggcggttgggaacggaccggaaaactggcaaaggcgcgtgccaaaggttacgggggaggaaaacggcggtcgggcaccaaggaaccccccccggtttgaaacggaaggaccggggaatgtaattgtttggttaggacatccccctggtttgggggccaaacggttgcacggtttaagcggaaggtaaggggattgggcggcaaaaactaaccaaaaggggggatacacttgggcccccgcaaaaaaaccggggaggtattagggaacgaaaggaaaattgttgggggggggttaagccaaaccccgggggggagggtttgggggataagccttcccctcccaggggggatagggaaaaaaaagatcccggcccccct

SEQ ID NO: 21998 - DNA, 11862 bp, Oryza sativa
cccatgattacccggttagggcagccacaggcaagaacagatttcgcaattagggtttttaggagataatttttccattaggcgccacgacggaacgggcgctacaggaacgcgtggcgtgtcagctctcgcgctcccgcgcccccgccgacgagaaccccgagctcctcagtccccacgcggcagtgctgcaccgccgccgctcccctccgtccatccgcctccccaagcggcggtgctgcttgcatcccttccttcgatatttgcacgtacccctcgcacttcattccacttcggttgattccttcaccaccccccccatggcagtgcttcactgctgcttgcatcccttccccatgtgcgtttttcttttttttttccttgatgatttccttgttgattttttttcttcggcttatatggataatatcgattcccatgtcccattctcttaaatctctccaatttcacaggtaccaggtaccacactatgcagttggtaccatactgtaccaagtaccagcctgtgctgtgctgtgctgcttcggctaattcaaccaacacagttagaggtttacatcatatgattcatcctcacatccaaaagacaactacatctgatagtagtgttctacatcatatcaatttgataggacaacatggtccagaccattagaaccttcccaaaagacaaccgcatcaaatggatgccgcaacagaacctttcttctccttccccttccctcttgctcttggtggtcttgttgacacatcatttgcattgccactgcaacaacaattctataagtcagtacctaaatctgaatacaagatgcaaatagattgcaaatgaggatggaattaactagtaagaaatactaattacatggatgatccagtagtattttttttgtttgacctaggtgttgcaccaggagtattgcttccttgatctgaggatggtgttgatgaagatgaccttttcctgtataaaatctggagtgagcagccaatttacaaatgaaaggaaaaaaaaaaagatgacaagtaccttttgctagctataggtcctccctgacatgtctttgcaaagtggcctttgtcaccacattcagggcatgtcctcttctttctacagccagactcatctgaagctttaatcctgtgtgtcctaggccttccaggctttctcctcaactttggcctcatcaatttgaaaccaggatctacaaatgtccacatattctttgatgtcattgggttccatatcccagcatatgtttgcctcaatctttgcactgaatagcactcatccacatagccattcatgtcaggaaaccttagagagcctatgaatgccaatgcatggttacaaggtttcccacttacttgccaggctctacaagagcatgtatgagcctttaggttcactgcatgcctccataccactcccttgttggacaccacagaaacttcagctaaatcatcgcaattactccttaccacattgtaatcttttagattcttgctctgttcattcagtgtcttaataatagatggaattattcttccttccattttgcttgcaagttggctcctcaagtgaaatttgtcaattatcatttgcctaagtgtgtcaaataagtccactatgtgtaattccttgatcttcatcacccaattgttgaatgactcagaaagattgttgttgatgtagtccacctttgaaagctctgagaatttgctcctactccaaaaaaatgggtgattggtttttaaatatgcaatagcttcaggagatttctcagcaatcttgttcatgtgatagttgtactgctggctggtgtagcacttagcagcaggccacatgttttcaccaaaaagtggtccatggtactgcttcttgaagttcttccacaggtgtcgcatgcactctcggtgctcagcagttggatagacatcactaacagctctctctagtcctttcccagcatctgtgctgatggctagcccaggaggattaccaatagcattcttcaagttctgcacgaaccatgtccaactctccgttgtctcagcttctatcacaccaaatgcaacaggaaaaagccagttgtttccatctattgcaacagcagctgccagctgtcctctatgcttccctgtcaagtgtgttgagtccattgcaatatatggcctacaaccttgtaggaagccatcaatgcaaggtttcagagctatgaacagccgcctgaagcatacttggtcttcatgaatctcggtatcaatatcgacaatacttccaggttgtgccttcaaaagctcctctctaaaagtgggcagcaatgcaaagctgtcttcccacttcccaaatatcttctcaagggccttctctttgcctctaaaaactttgtcatatcctattgtaaatttgtacttcttctctagcttgaccttcaatgcactagctcctagagttggagtctccttcagccaatctataactctttcagcaacccagctatttgttgccatggcagccccagtcttatttatggaacaacaattgtgggcaggcctatttaccttgacctgcacatataacaatgtaattatcagctttttatgcatcaaatttaaccatgaaatgataaaataattaactgaacatttcagcacaaatttaccttgcagccatagtatttcttacttgtagaggcatgaaacctccatttacaaccctgctcttttttcttgcaaaaagctctgaatctatgcttgccctttttctcagtttcaaaagaatagtcatggattatagcatggtgtgtaacagcttccttgcaagtagtagtatctgcgaacacctctccttcatcaatacatgggttatcaaaatcatatgcaaacacatgctcaaggtcagagtcattgtcatcgtcatcatgtatttggtcatcaagatcatcacaatcatattcagagtcagaggaggctgctgcatcactatcatagctgctatcactatcaacctctagtgggtcacaatttgggcatagctggggctcctcctcttcgttctcttccttctcatcatcccgaacctcttcatcatcgtcatcggcttggctcctcctctttgcacacttttttacaaccttctttgcactctttttaataggggatgtggcttcatcatcaggatgtgaagtgctctccggatgggtggtgctctcattttgggtggatggtactggttggatggagttctcaagatggttgtaactctcaggcagtgttagtggcgtagcatcaaccaataggtcagtaaatagtggtggagtacatggaatagaatacctcacagatgggtggcaccttcttttagttggtgaaggttcaacttgcaatggaccaccaaaatcattgacaatggcatgaatattgacaaccccgtgctgattacccttatccaaccaatctagcaattgtgaatctgtggttatctctactttactctgagttgacacatcacccaatttccaaaagctgatgtattgatttggcccccagttaaaattttcccctacatcgtcaactagcgcaagcatcgaatacctatccctttcgatcgaaattttgacattgtttcccttaacatatgtcctttgactcaaaagcgatgtggtaaaataagactcaaccttaataatggctgtcaagaagccttggtcattcctacaggataagtaaaacaatggagaaatattctagcagctcaacgaggaatagatgaaaaacctacatctaaatatacagggactgaataactaatgcatggaagacctatctaacagaaatatcataccaatgtaaaaacatatccagcttaaactacttttaacaaagttgtaaacatatggctactttcttatattacttcatgctaccattgtttgatgattaatttattaaactcactatctattaattcaaataagcacctaaggtggagaggccgttgtttaattacaatgcacagcatattcacacaaagagatattgctaatgcttgattatatcctgaagatacgcaagcaagatatggttagctatgcacatgctaaggttgcatagcaaaccagcaaattcggactcttgaaccagttgaacaaggattaaaaacattcaaaaagaattcctcaaaacacacacatatattgttggtaacatccctacatgatagatagaacaagtaggtcacaagcataagtatagattatatacctttccatggtggtcctgctgctactgcccacagtagccaccatgctgcttgaagcagctgatgctgcagcctgccgtcgatgccgacactcgctgcagccgcgtgccgcggccgcgcgctgcaacctgacgccgcccgacggagccgccgcaagcgaggtagccgcgccgcagcctgacgccgcccgctgcaggtgccgccccaagccgccgcaagcaccgcagcctgatgccgcccgctgcagccgtcgccccaagctgctgcttgacttgctctactcgccgaaatccatctgcacctcttccattggcatctaatacttcaaagcgaccgatttttggttgatttgctcctagtttgagagaagggatgagaggatctggggtttagggttcgtcgtgcgggaggagaggaggagttctgatgcggtagagttggggaagaacacggataaggttgaatctggcaagggcaatatggtcttatcgcgttgccttgttttttaatttaattacatcaattaattttgtcatcttactcatacggaatggaacggtgatggcatacggaatccacgcacactgcttttggtggtatatttgcaattcgtgattttataatggttatttcgagttaaggagtgaaagtagtggcaaatatgcaattctcccttgtcttttggatgtgaggatgaatcatatgatgtgaacctcaactattgtcatttagtttgattatgttactgtgttcatgccagaatgacgctagttgactatgttctcttgcttgttgtctcaaatggtgttttattgatgccaaaatgctgtcaatattacaatttcatgggcaggggcattcttgtcctaattttcatgaaaaccagccatataacggtgttagtctaagctgtgagtccagtggcagttatgttgggttcaaactgtttttaatggcaaatttgcaattacagtttttttagtggtagatccacaatacctgttcaatccagtggcaaatatgcaattgaccctagttaataagggtgtatttagttcacgctaaaattgaaagtttggttgaaattggaacgatgcgacggaaaagtttgaagtttacgtgcgtagaaaagttttgatgtgatgtaaaagttagaagtttttttaaaaaaagtttggaactaaactcggcctaatttagccttcagagaccggtaatttttcttcaggttcaccggcgagagcagagcagcggagacagagctcatcacaaagatcagcagagcaaccaacccacctggagtctggagacgagaccccccaaccgcccaagccctaacacaccacgccgcccgcgcggaagcgcgagatctgaatttccgaagtccggaacgccgcggccgccgccgatggagatccccaccgacgccatccaccgcctccgctcctccctacgcgagcccttctccgcccccgcctccgcctccgcgacgccgcccttcccctccgtcgcggacgccgtggccgccttcgactcccgcgtgggagtgggcgccgcgggggccaccccccggtgcggccgctgcggggccgcgggggggctcctccgcggcgaggggtccgccgtgtgcgcctactgcgggtgccccaggcgggaggggtgcggcggtgtcgccgccttccgcggcagtgtggcgtaccggtggctgctcggctcgctcgggctggatggatccgtgagctttttcttctcctcctcctttcctcatttgaactggttgatctgctcttgttgaatacttgaattattggtgaatcgagtgggatgtgtttttttttcattccattgaactaggtaatttattagaaacctaatctcaagcaaatgctgaatgcaaatcgaagactaggcttttgttctaaatgaagaaaatttaaggtagaaactttagcaaaattttgtgctgaacagtagttgggcaatacctagagttctttccaaaaggctattaaaatgagaaattcattaatttgcaaatgttctgtatcactagtacagaaacatggtttggaatcccggaaatttggattgttcaatagcatgtcctaaaaaaaattcttggctacaacgagcgtcgagcgagctaaataacaatagaaggaccccattatgctatctgctgcagcacatttactatcaagtgtagtccatgggaacttttcttagttttcaatgccatataattgatttttttcccactcaagcttatgattaatgaaatctttggatgcaacctgattacctgaatattgggaattttaagagattggtactgtacagaacacattggaaaggtaatatgcattattggataatgaaacatctattactacaacattgcttttatagtgaacttaagaggaagaacaaagatttgatatcagtatttgatgttatctccgatttgttggatgcgacacttgaatggcgagagggcatgctgtaggtatctataattatgaaacacttaatttaatttgtatactatatcatagttttcatgcttattcactctatgcatgatttggacctacttacataaagaacatatataatgcatagcatgcaaatgaatctcccaaaacaaatatatagaccatcagaagaagtggaaattaaggcgtctctatctttatctttgcttcaactctgtgtttatgattttcattataattacaagcttaaagatttctttaaatgcaaaaaatatccatgttcaagtttcttgttttgccccttttcccatccaggagcctgtagaatttgacaacgagtctactgattcaagtaaaaccaaagaagcactgaagaatgggatggtcttatctgatctgctggaccttaaactttccttcccccctgagaataaggaaacatctggaagtaccgaaaacaatgaacagtcatctgctgaacatatgctaaaattatctggtgttaacctagactcatttttcgctgcaagaatggagaacacaaccactgctgcagttcctactcaaaaacatactgtggtgcaggaaaaacaaagcacagatagtcatggttcttccagtttggagatgcgtgctacatacttaactggaacgaaaacaagttctcaaaacacaaatcaaatagaagttactccagcatttgcaaattgggatgctgactttcagtctgctagctcagaaagtgtcaccgaggactccaagaaatctgacctatttaacagcgcctcgaatgtcaaggcttctagttttccagcacatgtaactgccatcagcccagttgtacctagtggaaatgaaacatatatgagaagtaccaagctagaagattcaaaagatttggcttcagcaagtggcatgctagttaaagatgaaagtaacagtggaatctttcctgagaacaatattgctgagttcaccgagtcctcccttagcaagagttcagcgcatagtgatcaattgcctgcaaggggtgatactggagtcggtatagatgaagcttttgatgactggcaagagtttactggtggaaatcagggaagcctgtcgaatgcaggagaacatatggaggggcctatagagagcaacccctccgaaataaaaaccgtagatacctggcctgttagtagcatggaatcatccaataatgttactgacaactctgttgatgattggcaagcttttacttccagctctggtcaaggaggaaattcggtgaagccaatagaagggtcagctgctagtcaaggaggagatgtggtgaaaccagttggacaaacagcaagcatctcatttgaacatttttcagaagctaattctgttgagttatggcctgtgggcaatattaatgagcttcataataccaaagtagtaaacgaaactaatgattcttttgatgattggcaagattttacaacctctggtcaaggtcaaggtgcaccatctaatcaagttggaggcatgattgaagtctcacgtatcactcagaaagaaacaagtgatgactcatggttcacaacagatgttaaggaagaaataaataaagatttagtgaatacaactaatgccatgttggacgattttcaaagtttttctggttcagatctagcaccacaaagttcatcgtttgtaagtggagaaatgatgaatccttcatttgggcaacatgaaggaactgatactgtgcaatcatggttgggtggcagcaataatatgggtacaaacatggccacaacaaatagtgaagacaattcatttgatatttggaaagattttacaacgtcgggtcatcaaaaagaaaacatttctatttttgagagaaaaaaaactagcacatcatcagagccagctaaagaaactgatccaatggatttgtggttaaccagcaatgcccaggaatctaatagcagcaaagatgctaatagaattaatgactcatctggtggatggcaggattttgctaattttggtcaaaaagaaagtatgaaaattcctggggtagggcactctgcgaaagattcttcaagcaattcagctgaacttaagaaccatgaacagataaatgaagatagtgacccatttgatgactggcaggatttcaagaactcacatccactggatacaagcttacaagttccatcaaattcttcatttgataactctttagtacggatgcctgatgcactagaaggactggaatttgggagctttgcacagtctgttccatcccaaagccaaagagataataaggagaattctaacgaaacaaatacggtttcatccaatcataacttagaaaggttggtggtttttatacagtgttagacttttcacattaaaatgcattttaattcatatctgtgtgcctattccccatttgatgcttgtgcatttgatatctagcactagttacctggcaacatttattggttggaagatgattatactaatctatgtggtgaaagaaagataattattggactaacctgagatttatgttgtttttcaattgtaaacaattgaaactcatggcaccagcaagctctagcagtttgtctaatcatgacatttcaatgttcatccctgatcacctaacgtgccttttagtactctttgttactcttacctctattggtcattttgttgttatactcatcagatttgctgaaatacctgagtgtttgtaagatatttgcagttcatgttgcacagcaattccattgttaatacattcttcatcacgttagtaatataacatgtttccatcatgtgcaggatggttggaaggcagcagacaggcgatttgggttcactgtctaccatttggccaactacaagtcatgacacccaatctgtttcaaaaccggaatctgctgatgcaaatgtagagagactgctgtcgcagatgcacgacttatcctttatgctcaaagatgatctgtcgatccctgataaacctgtaggtcattataagccttgaaaccatgtgtgctttgctacgttctcccaagattcgcttatgttggagttccagccttttgattgtgggacctaacatgggaaaatgggaaatagctcgctgatgtaagtgcagacaaccttgttctcccttttacagcagccttttttttctgagagctacagtgcattgataagcggagatttatactggtattctctgttgcttgccttggctagcagagagctgcagcaccttgctcctcgcttcagtttcagattcagatgctttcattgattactgcttcattgaggcgagccacgaattctgtttctgcaatgtgtatgtaccaattcacggcctgtataaattgtgtatggaacgcaaaaaatgagttgttcaattctttttttcccctctgttgtgagattgttgaggattgagatttacttttgacgacctcgttacaccctttgtcttaaaacataatgtttgtagcggacatctttgcaccttaactgcatcatcctcctaagaaaaccatgctactggcctatttggctgggagaggactcggtttgaaggatattcaaaaatagcgtgtgtgatggagaatccgctagagtatgatttttcacctccatacgctaaacaaaggatggatggccggatagaagccagcatgctcttacttcctgtatgcacagagattttgttaaaaaaatggtttggaaataatacacaatttgtaacacaacagaacacttttatacccatgttttaagttgaattaattagtgcccaatcaggcgtgtgcttgctgtcgcaggacagggtgtaagcgacgttcacagggtgtacgaagagccatgttaggttgggggggaccaagaggagcagaacagcagcaaaaatgggggaaccgaattgattccagtttatcttttcttttaggtgttagctagaacatcgttatctagtttgaactcatgctttttgctcaactacgtccaagtcaaagtaagacgacattatatgaaggccatgttgagaatttctatctgaggtcaggcggcaaatattctccctttgacataaagagttggcaaatattccaaccgagttttactaactggtttcaggatcaggaataagattgagtcatagtttgtttggaaaaaatacgaattaccccccctccgaactatcgtggtcgtctgaattacccctctgaaccacaaaactagatattcttcacctccagctatacaaaccggacgaattaccccctcgacccaatccacggtgttttggtctacgtggcatacacgtggcatcacagtcagcgtttttttaataaaaaatggtgggacctgcatgtcatactcttccactttcccctctctctcactcttcctctcttttatctctcactcttcgtctgtctttctcacggatcggcggtggcgggagacaccgatgggcgggcggcggacggcggtattcgaatgacgggcgagcggagacgactgtggtggcggcttgcggcaccacgcacgggggcgggcggtggaccggggctacaggcctggcacacaggggcggaccgtggcgttcctgtgaccggcaaaccgaagtgacttgcggcggtggctgcctaccctttttgggaacaacccccggccccggctttaccagttgacggcaccgcctgcggtgggctttactgggccccaacaactcttctatacccccccctgcactttggttccatttggtccccttccaacttaagctgtcttccctggtttctcctaggctaaatttttcctccgctctttatgttttctcttccgttctgcgccctccccttcatattgttttcccattttcgacttactgcatgtcttcactcattctttgattcctcttttctatcttccttatcaaatctgtatttttctatctcctctatccattcactattcttatttcattaatctcgcgccttttcgtcttctcttactctcacactttcgcttttctatcgaaactcactcagctct

SEQ ID NO: 21999 - DNA, 7920 bp, Oryza sativa
  unsure (1)..(7920): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcggtacggatcatcatcctttttaggtttccactatatatatacctcttgtaagccgccgtgcggcgatgtaacctcacctcagatatagtgaagatattttgctggctgacgcccgtggttttttctctcctgttttgggagggttttccacgttaaatctcgtgtcttttgtgattgatctattgttctttattgtttgttcgcctatcgtttgctaacagaagtagcaggcatgaagacagcggcagccattctgttggtggcggcactggtggcgtcgcactgcatggagatggcgtaagcgatcgacacttgccatgaacagatcctcgtggccatccactccaccgtgaacgtgcaaatcagcggcgacatcatggagctcaccgctagagccgccatggtcgtgcccagtgcggcaatgctgatagcgaggctccacaaggagatccatgcgccgccttccccagtggcggcagcggcgatactagcagcagagagcccgagaaggacatatcgcccttcgtttccatctcaagagagtcacactcggcaccgtaacactacaaattctcctagcgctgtcgtgacggccacaaccgtcttcatacatgctgctccgacgactggttcgggtgcggtggcaccactgttcctgaggaagagagaaggaagaagatggaaaatgaatgagatggatgaaaaatgtgacgtcagtggcacggtcccaattttataaaattccagtaacacggcaataatagatgaattgtaatggcatttatataaataagcacatttacccttaacaaaataaaaatggaaagcacaacttatctctactactataaaagtggggtcctccttctacccctcctatcgttcttagcgcgtccatgcgctccgcgtgagtaacaatcgtattcaatattttattctcggtcacttttctatcccatctataattatataggattgacatgttatagtacgtaatgagacactgtcacagtcatgtttttagtttcaaattaaaaaaaaaaagctcaaaataatacgatgcaataatgtcaccacattttagaaaaaaaaatgcaagcttgaccaagcatgagtgcatgactatagcttttatctataaaataaaaaaaggactgtagcttattgcgcttttattacaaagtcagtttctatataaaatttgcataaaaatattcgatttaaagctgcatacaacagatggcaaccgtgacaaccgacaaggaacccaacatgcggtgtgcctcatgctagcaaaagttcgttttttttaaaaaaaaaactcatgctagcaaaagttgatgcaacagaacaaacacgcgttcaactccaacggttgtattacttgtatgtgagctaaactcaaaatatagttgggcctgactacaatgccatctcaagtcaacaaatgatatgaatttctttttagaactcatcatcattttagtgagaaaaaaaaacagacctggtattctggtggttgtacattattcgtcacaacctctaagcctaccaaaatatatatcagtgtataattcgttacatagttttatattgatgatgaaaaagcgtgatttttcttaaagacaaagacggaacgtagataaatttgaccaatttctcaacagatgatccaaaccattcttttcttttagattcggtaacattacatccctaccttaaaaaaaggagaatgtatattttccttcggctaacaaaacaactacttcctccgtttcacaatataagactttctaacattacctatattcatttaaatgttaatgaatctaaacatatctatgtgttaaatgaatttagacatatgtatgtgtttagattcattaacatctatatgtatgtgggcaatgctagaaagtcttgcattgtgaaacggagggagtaattattcttttatttataggcaatatatccatcaccgacaaggtacctataatgactccgtgaatattaagatatacacctagtcatcaacaacactatatgtatagttacgtgtattcaatacatgggtatgagcatgtgtgtgtatataagagcgtcccatctacactgtgtttggattaagaaaaggaaaatgctacttcctccatttcacaattgaaaactttttagcattacttatattcatatagatgttaataaatctagacacatatatgtgtctatattcattaacttctaaatgaatatgagcaatgctagaaagtcttacaatctaaaacggagggagtacgtaacagtatctcgttcaaacggaatgatgcgtaacggtatgtgattcgaacgggattactgtagcataaaaaaaaaaggaaaaagaagaagcatacttttcccttccaatttgttttttttttccttcgtcaccgtcatcgcacagtacaatcattgtcatcttccctgctcatcccgaagcttctctcctcctcagacctcacctccacgttctctcaggcaagcgagccccccctaccttgcctccgaagtaaccgccgccgccgcggcagctaggtcaccgagcccgggcccaccctcccctcccctcccccacgccggatgatcgccgccggcgccggctcgatgggccgcgccaccgccactccagcccacggggcccattcgcggtggccccgcgccgtcgcgcgcctccgcctcgcgttccgctccccggcgcccgcggccagcggcggcgcgcggtggataggctgcttccgcccggcgccaccggcggcggtgaaggaggcgaaggggaagcggccggaggtggagaaggagcctgcgcggggcggaggggaggacgtgtggagcgcgcaggcggaggccgaggtggcgcagggcgggggtttccccgagcacctcgtcgtcatggtcaatggcctcgtcgggaggtggtggatccgtgttactgtttgtttttggttcatcgctttgcttgtcagctctgatgcaacctgctggcatttggcttgcagtcgtaaaattagcctggttgttttttttttttttgcagcgcggatgactggaaattcgcggcggagcagttcgtgaggcggatgccggaaaaagtgatcgtgcaccgtgagtacccccaatcgatccacaggcaaatctatctcttgcggagttcagttgctctctgaattgtggattgtaaagcaaagtaagatcttttcgtttgtgtgcctattcgcatgtcttgggggtgatatcagggaaaattagaatgttgggaaagttttgacctctcggcataaaaaccgtgttttggtaatctatatagcgtagtcccactttgtggaagaaatcgagttttcgtaatcaacatgctagagtgcaggctacgctgaagaaatatggtttgagcatgcaggatggcaacatgaacatgccattgagacccagtcatttaggaaaaacatattaaccacttgtgccaacttgctaataattgtctagttgggcctgactaaaattaattttctaattgtgtgagaccgtgggagaatcggtagttcacaaattttaatcatacttatacttaagttactatatgagagagaaacataatggtagatccaccaaccagtgtgaccaaatgcatttgattctgttgaaatataattacatccatggattacataacttggagtggggatgaagtaacagaacctgccaaaagaccaccataaagaacactaaggatttatatgacaaaggttgcattgaccaagttagcgccatcagctagttgcagccaaatcttaacaatatactgctgtttgtgtgtgatatctatcatttagaatttcattcttgttgttccagaattatcagtttacatgacctggttctagatagttccattcaaagaaactcttcaagccaatcatcttgctcctcttttttagattgtgcagaggtaaaagtcttttagatttcaggatgatggatatgatgatacatcatttatcattccttctctagttatggttgtttcagtcactatcttgttttcctgtaataagatttagattgccacttcgcatgcaggaagccagtgcaattcggctacacaaacatttgacggagttgacctgatgggtgaaaggttggcaaatgaggtacctaatgacttattgctcaaactaaattttgtcctctgtacaaacctttgtagttgtttgatcgattttttgtgtgcacttgactatttatcttgtcattgcatatgccctatggttcttgttgaagctatttattataattttcttagtttgcatctggtagatgaaatgacgtctgttctaagctgattgatagaaaagtagatatagttattagggaaaaaaaggtgataaaatggtgaagttgttactttttaaatcttattctacagaatttataactatccttcagatgaaagcgtaaaatcaaaattgatctacattgatccatgggagtttgttttcatagttcaaacttgtaagtcctgtgtattcagctacatcatttcatattggaagctaactaaattattataggttttatcagttgtagaacaaagaagaggtgtgaagaagatctcatttgtggcacactctctaggtggccttgttgctagatatgctatagggaggctttatgaaccaaataacaaaactaaatcttcttcggagaagagcagagatgaaggtgagcgcttggagggtttcattgctggcttagaacctatgaattttataacctttgcctcaccgcatcttggttcaagtggaaataaacaggtaagactaatatcctttattgtttataaactagacagatcagttaaccatctctttctctttttttaactttgcataactacccacttaagttgcctctccaagaacaggttaattggtagcgcctgttaattgctactcttatttaattacaattattgaaagtacatatgaggttcaaattttgaagtacttttggagacaaaaaattctggaaattgttattcatcaagcaacttcataaagattaatattatggattttacttttgttgctttcagctttcctatagattacttgcaaatatgtaggtgcctttgtttaacaacatttaaattcttcagtaatgtcagtctcatatggtttcagttttatgagatggcatacttttgtagaaaaatatttcttaagtagttaattagtccaacaactcgataatgactaatatttttgattttacttgttttactttttgattctctagagtttgcaaatatgtaatcagttaatcaccttgatttaacctgaagtagaacaaaacatttaaattcttcagtaatgttagtctcatgttcagattcttccaccagctccctttcttatgtggcctgcctttcctggaaagaagagcttcggaaactgcacatttgcttgttgggagaacaggaaagcatttattccttacagacaatgatgatggcagacgcccactcctccttcaaatggttgatgactgtgatgatataaaattcaggttattttctgtatgatttatgttgtcttatgtgtttaaaatggttggtgaatgtaaatgtacagaaatgaagttcattttctgtatgtttaccttcagtttcccaaagtagtccaaaaatgtttgggtatcatttctgagcacaatatgttctgttatgcagatcagcgttgcgctctttcaaacgacgtgtggcatatgctaatgcaaacttcgaccgtatcctttaacaattaactgcttcgctgtttactctgaattttctagcttcttacaagatatgcacttaactaaataaaaagatatggttgggtggagaacgtcatcaatccgtcgccaacatgagctaccaaaagtatgtcttagaactatattcatgcctaaagaaacctatggaattattacatatttcttttctgttctctttaaattgttggtttacctttcttctgcggttctgcctcttctcagcatcgacttcttgttcgtgatgagaaatatcctcatattgtccatgttgataaaggagcaacgaacagtaatgaagcagaagctcgttctgatctttatgacccagaaggtatatttttctgtttgttagttaccccgaactgtcaaagttgattgttcatcaatagatgacaaaaatcccttctatttgcagaggagatgattagaggccttacacaagtaccgtgggaacgtgttgatgtgagcttccagaaaagtagtcaaagattggttgcgcataacaccatccaggtgtgaacttattacttttccaacctgcagtatatattttgagcaaagtcgtcttcttttctactggtgcctgaaattttgaatagataattgcggagtggcatcttaactgtgattattctaaggaagttggggtatgcagtagaatttaagattttatgtgcttttctgtgagttgcatctagtgaagtattctatgataagatttcacaaaaagtactttgcatggaatgacctacatgcaagaatgtgagaagttccttattatccttcaaaccttcaatctggatggaattgacagccacattgttacatcttccacactatcaaagtataaaaatttgtgggggcgtatcttctttgctgcaaagatatcttaaagtaatgtattgtagtgtgttcctacaagcccatcagtattaccaactcttttctgtcttgaagcatcgacattcttgtccacaagatgccatccatttaaccatgaaaatgccatggtctttctcaactgttatttctccgtattgttgtgaactgatccattattttatattgcaaaagcgagagatgcagatgcacaacttctcaaatctgaccatacttttctgtactctgactgctgttccaggtgaagagctattggctaaactcagacggcgcggacgttatcaatcacatgatggataattttatcgtctagtccctgaactctacgtgctgcactgtaccaatattcagagaattttagcgattggcaattcaattttgcttaggtattttttttcccttgtaggttacagttctcatagataatgtatacagtgttttaatgggccta

SEQ ID NO: 22000 - DNA, 3396 bp, Oryza sativa
  unsure (1)..(3396): unsure at all n locations
gatttttganttgaatggccgntgtgtgatggattccaaagtgtatcataacttgtaccctctactgtatcagagtacaatgaagctaatagatatttcctgttgaattgtatttatatgtgcaaactattacaataatcaaacttatgtattggagactgtgattcggctaaaaggataagtgaaaaaaagatcatctttgctccctcttatttatcccaaaataagatcatctttttaacaatcattacattagagttgatgaaattagagaacaaatacattagaactaaaagtgggaagcaatgcattgggatttaataaaatgtggatttttcaatctttttttctattggtatgtatgggacgagtgaaaaagttattttgggatggaggtagtattcaacaaccttcttgtgttaaatccgaaccattaagaacttgagatgccgattctcactaatcttggataaattggcacattttgagtaatttccagtaaattgaacgaattcgagatgacgattaattgacacattttgagttattttcgataaattgaagtcagctctagataatcaaaacttatcaagattgtaaaccatgcttggcacagctccagcagagctggagttactgcttcataatttcacttcagaaccaactcagagttaaatttaggagttaggcactaccaaacaagccctactcattactgtacttaggagacgactctcggttgggcgcccgatcgggagggggtaaaatcgggctgacgttagcgccgatttatgtacaaaaattactttaaactgatttttctcttaaattacttatccaaatcatgatccgattgtaccattaaatttattgcaattaaatctttaaaacaagaccacacatggatatattccgacgaaaaaaaaattagcttattattgaatttttttaaatgttgcacgatgttccaccaggtatatcggaattgtttcactaagtagatcgaaaatgtttcactcgtttaaatcgggcgttgtttcaccttatatgaaaacaatgtttcagcaaatagcgaaagaatgtttcagttcgctgcaacattatatctatacatagtaaaacactgtgagtactctaggtgaaacatttttcggtggaacaaaaaataaaaaaaattcccttattaggggatttccaaaatatatgggtgtttttttgttgcaatggagtatttcagttcactgcaacattagatctatacatagtgaaacattgtgaatgtactagatgaaacatttttggtggaaaaaaataaaccaaattatcttaatagatggtttcaaaaatatgtaggttttttattgcaatagagttatttgtgtgtgaatacgtggtgggccagctggagggcaggcatgcgcgcgggggggaggggggggggggagcgtaatcattatcgtacttctaattttctctttcaagaatatgatgtgtcaatttcctcaggacctatcctgaactcgcgtagcgatggcttcttcccaaactgcccggcccatctggcccgcgctaagcccaaatcatttccagacaaccccaaaaaatccagcaccttctcgcaccgccgccgccgttcaccggagtctccctaactaactaaacccaaaccccgaactcgccaccgcctgtccgcctccagagtcccaaccgccgccctcgccgtcgtctcgtctcgtctcgcccgcctccatggcgacctccgccttcgcctccaccttcagccccttcccgttccccgcccgccgtccggcggacgacaccctcttctacgccgtctactcgctccccctccccaccgccctcccgccgccggacctccacgccgcgctccggtccctccacctctccctctcctcccacctcgcccccttcctcgcctcccacctcttccaccgcgacgccttcgcgctcaccatcccgccgcccgaccacaccggtgccacctccccctgcgcgctctgcgcctccccccccgtcccgcacctccacggcgcgctccgcttcggcgactccctcgccgacgagtggctcggtgtctccctcctcttcgagctcacccgcgcgttcccgagcctcgccgtgcgcgcgtgggactccgacggggagttcctcctcatcgaggccgccttcgcgctcccgcggtggctcgacccggacaccgccccgaaccgcgtcttcatcttccgcggcgagctccacatcctgccgccgtcgctcttccccgggacgccctccctcgacgccgcgctcgccgccgtccatgatgacgccgtcgacacccgcgcccccgacgccgtccaggccgccatacagcgccgcatcgccgggctgcctgagaaggcctcggagaacctccacaccgtgcgcgtcattgtcccggtgcccgtggcgaaggtgctgaaggaggagccttgcttgatcgcccgcgccgtcgaggggttctatgaccgggacatagacaccatgaaacacgcggcgaggatagagaaattcctcaggggacctggcggaaagggggttgagatggtgaggacatcggtgcgcatgacgcgggcaatgtacgcgcagcttgtgcagcagaactttcaggcaccgaggggttaccccatgccgaggagggaggaggggccggagaagtggatggaggcagaagttggggatgaaaaatgcttgtgggtttgagatgatgtatcacgagaggcggcgggagggggaggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgaggcgacttattggaaaccccaggggacaggatggcggaacccctgggaagagaaccattggtggcaaaaaaagggtccgggaaaccttacccgggggggacaatatgggataaaaggtggggcctgagaacccccaaagggcccagggcccggtctctcgtataggggaaaaaaaggtggtatccaaaccccggcgaaagagaatctaaaagaccctcaccccactgttttggggaaaaaaatagtgcgcccaaagtcgaaggacccccccgtgagaggcctaataaccctcggttgtggagccacccccaccatccc

SEQ ID NO: 22001 - DNA, 9660 bp, Oryza sativa
  unsure (1)..(9660): unsure at all n locations
tgggggggggtctctttncccccaaaaataatattttaccccccccgggggggcttattggggctacatattccgcgggcgggacaacacgggggcactatcccctggcgcgatnggggcttcctcccgggtcgggcacttccggggggggtcggatatggnggatcacttccctgaggagtggtcgggtgtctccttcttctgcggggctcaccggcgcgattcctgagcttcnctgtgcggcgcgtgggctaccgcgggaggattcttcttcatcgggcctgctttggcgctcctncggtggctcgaccgggctctgctcctgacctgcgtcttcatcttccggggcgagctcccaatcctgccgctgtcgatcttccccgggacgccatccatngacgctgcgctcgctgctgtccatgatgacgccgtcgacacccgcgcccccgacgccgtccaggccgccatacagcgccgcatcgccgggctgcttaagaaggcctcggagaacctccacaccgtgcgcgtcattgtcccggtgcccgtggcgaaggtgctgaaggaggagcccttgcttgatcgcccgcgccgtcgaggggttctatgaccgggacatagacaccatgaaacacgcggcgaggatagagaaattcctcaggggacctggcggagagggggttgagatggtgaggacatcggtgcgcatgacgcgggcaatgtacgcgcagctcgtgcagcagaactttcaggcaccgaggggttaccccatgccgaggagggaggaggggccggagaagtggatggaggcagagttggggatgaaaattgcttgtgggtttgagatgatgtatcaggagaggcggcgggagggggaggaagggaaggggagcacatgggaggtttacaggaagagcttggaggcgacagggtgcttcaatggtctgcttcctgggtcaaaagagtacaagagggttatggaggatgcaatgcagtattacaaaagctcgagtttgttttcacgaacaaggtaattttggtatatcttttttaatcttgtgaaattagttctctagtactagtaaattgtcatgtgcgagcatagttggcaaccagttcaaacagaattaatttgctttcagttctcaactttcaaacttgaaaaaaccatgtataattgatgccttgatggtcagttgttaatttctgtgaggtacaatgttacaatcaacaatttaacctgctcaccattagggatgattgttcaattctatcagtagtcagtaaccatgtccatgtgaaatgttagttctaggagtgttctaataatgccatgtgaaattagctgtctagtagtaaattgtcatgttagagcatagtttgcaaccatttcaaacactagctgaatgtccgcgtgttgcaacggaaattttaaaaagaatatcttattatacacattttagaagccccaaacaaattatctctatcctttttctctaatcatctaagctgcttttgcccactttcatatgggaatttggaaggcacatacaccctgacaacaaggacccccacttgtcaaggggttagtggtggtgggtggcagactcaccactcactaccaccattgtagtcttttaaaattgtatagatataaatatagatgtatagataaataatttgctttcagttctcaactttcaaacttgccttgatgatcagttgttaatttctgtgtgaagtacaatgttaaaatcaacaatttaacttgctctcaattctttcagtagtcagtaactatgtcatgtgaaatgttaattctaggagtgttctaataatgtttgtggtatgctagggagatactaagtgctcctgtgcgtcgaattgatgaaatccttgccatgccatactcggctgaggaatttgaaggcagtgaccttcctccgagcgacgatgactcttggttgtataatggggaggatgagttagctgcggaactctgtgcaaggcagcaggaaatggaagagtatgaaactgcaaaacaatacagaaaaagtcaaaggaaaaatgtctcaggcagttctagctcgcagtcaaacgagtttaatcttggagagattacagagtccatgcaagaatttgttcgcaaaatgtcaagctttgagggagctgaagttcctgcaaacaggttttcttctagacttatttaatacctctgtttcatgtgcagtttttcttctattctgttaaatcgaggattgtctacatcagtgattcagttttaattgtccgttggtcttgttcttagataatttaacataagtgacacatttttttctaatattttccattatggataattttccttttgcacttcaatttgaacacaagtcgaaaaagtctaaaccaccatcagagtaaggataggtatgtgatgaagtctgcttaacatgaagtgttcacgttcatttgtcaacaatcaagatgcactaatataacttatcaagtcctataatcatgaatctaaactggctataccatgtaatggtgtatgatacctggaaagtggaagcctaaaacttctgtaattctcttactccaattttagtgcacctttataacttagattttgtccttgttcaactgattgagtgaattaccttattgctatttgatctgaatttttttccctgtttggaaccctcttcacgtttttgtatgctggttgtattggatgcatttcttatatacaaatttcagagcttgcacctgaggattgacatttgactttatcacacaatgttagcctaagatctgcctgtgctaacagtaacccgcattttgtggtccatctctagtttaaacagttgcagctttccatcttgggttttgtatagcatgtttcttatggaatctcagttacctgagcattttagtaaaggaaaaaatagaaggaaaaaatacatactcgaacattggctacttcagggatggcaataggactttgttgtgtaaaagaattccgcacaataacactttatgtgactatcttgtgatacacctgagacatgtcctactgagatgtctgcatctttgaatactcatcaagtcatttttgttcatgtaggaaagacatggaatcagtggatctggatgtcaaccagttcttcaaggccatggaatctgtgctaggtcgttcaaaagatgaacctggcaatgaagccgggtttgatggaaaatcttcatcatctgacatagaccttggtatttcttttcttcatgtcatgcaaatgctatttcattttactgcagttttctgctaggtgctaactcacatggtcagctatttagtattggttcgcccgatactacctcatgaacaaagtgtactttttttgttcatctttcttgggggtttgttttttgggccgtgagctgtgagttcatatgattcaaggagtatgactgatttcaagaactgaagcaatagatattaacatcattattttcctttattttcttggttggggtttcctggttggagatcattatgaggcgcattgaaatcttctgcttcttcattgcacatttcgtaccaaatactctggtcaaatcgatctcattctaatcctatgtctttttgctcgactatatggctggtaactggacaaatgtttatgcccttaactgtgtgtaaagggtgatgtagtaatctgtggtctgtttggcatgggtggagcctctttgagatgcagtagtatgaatagttctcttgaaacatcaatatacataaattcacaaattccttcaccgtattagccagtcatttcgtattctggtttggtgtgaactggatcttactaattaagaatgcttttgactgtgcagaagacgattctgattatgggagtgatttcggcgaagaatctggtgagaagggtatggataatgctttcatggaatcatattctgatgcactgaataaagaactcagtatgaccactatagagaaaagtttcgctcgtgcaccgcaccctgataccagcaatgaggtaattctgtcccattctatctcatgattatgtttagcacagatcgcttgtgtacttctcaaactatgaatatgaatattgttgtgattcctgaaatttcatagtaagttaagaaaacatacttggaagtgcatggaatgcacatactcttttggtttaaaatcacagtcatggatgattgtttattacttcctgaaactctattaatattgaagcagtaatgacccacaatcttcattttttatttccttgtgggtagtaaaaacatgtaaacttgctactggcaataaatcagttcacatgagttaatgagtagttatggtcaattagttgtccaaactgaagtctatcagtaatctttcttccattgtaaacaagttgggataatgggttttgtatcagattcctgaaagaaacttggttacgatttttcgtagcacacttgttcaatttgactgatcctactctaagaaaattttggtatattttgatttcagggtccatcaggtgctgcagatactgatggggagatgaccccagttgatgtggacctgaaccttgttgagagcttccttaactcttactcctctcaacagggtctcccaggcccagcttccaatctgctgggacttatgggtgtaaaagtacctcctgatggtaaaaagccgtgatctttttgtttgtacccatgcacatcaaatttctggaaccatagcaagaacatacatatgatatttattgcaaaacataggagatcatggtccaagtagttttcttgtatgttcaaacctcaaagaaaggaactggaagtaggacttgtgactttgtgagagctcaagcggccagcttggtctctcaacgggcatcatttggataagtaaaattttggcctgacaagcatgttccgttcctgtattccctgtactgctccggtatcattggaagacgtagggctcactcaacacaggccatgggtgtgggacaactatgtactatgagtctatgagacaactatagtcaaagcagctagcatttatatgtggtagtagctaatactgttgtattatgcaattctgtaacatgtcttttgagatctgacatgtatagcaagcagttgtttatgcagttcttggagtagcatatttgttctgaggcatgaacaaacttcagctacctaacataaactgttctgtactcgtacctactcgtgctgtttgtccagtacagatctggagtgtgttgatctcacattgcagacggtgcattcatctcacacggtggaaaatacagctatcaaacaagcaagtttaacctcatgggggaaaaaattaatcatctcaccgtagaactatgggcctgtttggagagcttaagattctgataagcagctggttggtagctagtttttgagaatctggaaaagttgggtttttcagcttctagcttctagttcattttctgaattctacaattaccacttctcagaatctggactagaagctagactgtttgcgggagtttctgattctggaagaagctgcagcagctagaagcttcccaaacaggccctgtaactagaagctagaagtaacaggtacatatcggtcagcgaaaggcatcctttcacgcattagaaaacaacatttttgcacttactcgaggaacaagtcaattacacgtgcaaaaaactgccagagctttggactaggagtagtgttcaatgcacaaaatctttctgaaatgatctcgtcagacaaaggagaagggaaacagcttcagctagctccctgcctcttggacgtgtcaaaaggatgcagcccatcccaattttctgcagcagccggaaccagagtgacatcttgcttcgttatcaattaaataaaaaccactttttttaaccgtaagtccaacatggcagctatggaaagctgaaagctccatggaaatcagggcatctcaagtcaagaaaattacgagtcaccttctccagtactaccagtccgtgtatacgtcctcatcagatcagatattcgcactgattcctgtcgtcatgtacgcggccacaggcaagtgcatttcccttggacaaacaattgacatttgacagcgcttcaactctttttttttctttaaataaaaaccacaaacttaatgctcataagacttgtatactcaaccctataaactcacaaatagacatcctaccatataaacaaatctcagaagattaggttgatatatcttatctcgttgttgatatacctacgagcacctcggaagactgggttgaggcacctcataagattgggtaagggcacctcagaagactgggttggtatatcctgtctcgttgttgacgtatctacgagcacctcagaagactgttatatcttggctctgtcaatgtacctatgagcacatcggaagactgggttggtatattttgtctcgttatcgacgggtacgtcatctatcactgaaagaacaattagccgtatatgcgagcacccatatcaagtctattactttaacccgtgtggctattactttaacccgggtggattgattccactaaaaaaacttaaccggttaagttacacttacttcgctacaacgcttcagctctttgatttaactgtagaaacaacgtctgggtggatatgtaaagcaaaccgaaccccattcaatctatctagtttatttttttaatcactcttaccaactttactttctttgtggatataattggaaccgtttaattgaacttcggctccaagagaaacgaaaccagagttggagcactgtcaaacatgttctacatatataattagacaagagtaccgtacataccaaaacaacgtataggactagattagtcaggaatgatgtatgctcctttgtactcattgcgtattatacacaccaccaaaccaaactaatcaatcaaatgatccattcatccatcatcctttgccctaaaaaacaaacttagaagagaatatccattttgtaactttctttgcatcctatcatatccatcgtccgtgctggtgaatggtgatgcctcccaagtgccgttgttggatggggttacgtcaacctcacaggtgaatctgacaatacaatattaccttttgtatatgtatattcagtatatttactaaactgcaaaagctgactttgcaactcctacactgatatatatcttagatatctataggagtattctttacccttatatgagtactaaccatgattaaagaaattaattagtaacccaactacggagcagggaagaatatattttcaaaaactaatgaactgttctagggattaagtttgatggcgagcatgctgagttgccaaatccgtatgaatagatttagatcagttaaatagctcaattaatactttaataaagtgtttagagtagccttaaaaaataacagttagatgtagacatactacactactaccactagtagtagaaggcagaaggtcctaggcatcaacctccttcgaaagttcaaattacggcggtagaccacctacatcagtatggccacctgtggaacatgatacaaacgagtgcgcctcactgactgaacaaagggactccattacctagaagccaacgactagtggaatctactcggccaaatccgcatatagattacaattcatcggtgcaacaagaactatatacattagagcatctggaaatgttgagccccacctaaatacaagttcttctcttggctaatagttcaaaacagagtttggatagcagatcgactacaaaagagggggtgggcaaaccagctcctctatcctctttgccgcacttcggctgattcagctttacaccttctagcaaagtgtagaccatccaaaagcatctgggtggaggtgcaaagatgggaaaaaacatatctcaaactgtaataatgggaggattgcacatcgatggaggacttgtgatacaaaattacgcatgcggcccacagcccgaagaaagccttgaaatcagctttggtcgtgtttagttccatttctaatatacggacacatatttgaagtattaaacgtaaactaataacacaacaaattacaggttttgcctgtaaactgcgagacgaatctattaagcctaattaatccgtcattagcaaatatttactatagcactatattgccaaatcatgacataattaggctcaaaagattcgtctcgcaatttacatgcaaactgtgcaattaattttttttccatatttaatgctccatacatatgtccaaacatttgatgtgacggaaaagttggaagtttgaagggaactaaacacagcttttgctagttttactctttctctattctctatcaatatacaaagtggtaaagcttttgcccctccttaaaaacaaaataggactgtaaaaaccaaaagaaaaaaagtacgaattacccccccgaactatcgcggttgtccgaattaccccccccccccccgaaccacaaaaccggacatttttcacccccaactatgaataccggacgaattaccccccctcgacccaatccacggtggttttggtttacttggcgtacacgtggcagtctagtcagcattttttttataaaataattgtgggacccacctatcatacactactctctcttttttttgttactctttttctgttttctattttacttaagaggcgcggctttccccccttcagtcacccacgaggtgcgggtttccctcttccttggttgcgtggggggatgaggagtttgccgccgttcgtgccttgctttgcgccaccttgtctctgtttcttcgtcaccggtagaagaaaaagagagagtgtttcttttacttatagatagatagattactacctggtgatgacgacccatcccgctactagcctctgattagtggtggtttttctgacatcttaactcgtctagtggtgttctcttgcggaagatctttaactgggatgtcgggctcggtaccacttgctcatactgttgcaccttgtgaaggacgtcgtctagtcttgcatgtgtcggggtttgggctaatgtctttgggtgcggcggctcccatatcctggctttatggccatatggaaaagcctgataagggttcttatgtcccttttgactgccttgtaggaagtcttttggagttctcttatgccttttattgcagattgcgaaatatatgttggttgttggcattttgggtagtggctggtttttgatatatgtgttggtttttttcctactggtcacacgttttttacgcattctttctttatataactgtcaccttcggttaactcatctcttgatcccntatgttaatggctattctttttttttttatgtagttacttctgactcttttatattcttatatatatatcgatctcttttatctcttatctttagtgatctgcatctttgtaccgtctctttactttgtttcttgttgttattctttatcattctttaatcatatcatttcgattactgtcgtggacgatctatactggaatcggttactcacgactctgctctaggctggtccatttt

SEQ ID NO: 22002 - DNA, 8319 bp, Oryza sativa
  unsure (1)..(8319): unsure at all n locations
cggctcgcgaatagaacgcgtatatgtagaaaactcgcccctccccnccccacacgcccccataataaacgggagcgatttaatgtgttgtccccaccgcaacacgagacgagtatagacgcggccggccaantagtttaccaccacgcggtgtgtgtgcgccacatatataggcgcgcgcgaattttgtgtgctctttttctacgcgcgccaccagaaagagcaaagattatatgttgccgcgtcttctcccttcttataaagaggtttgtgtgaggaggccccccctatttgtgttatacaaagcggcgtttttgtatntgtttttgagacccaccaatagtaattgtctatatagtttccgctatagaaaagggatatgagcttcccctcccccaccccgttaaccccgtttatgtgcgcgcgttttccgccctttccccaagggtagagggtggaggagttaagtacgcccgtccccccgcttatttacattccctttgcaatcccctttgacgggcctttattcccctttcggaaaaaaaaaaagtaaaaatgttgtgttttttagaccaaaaagaagtttatttgcttccagctttagggttaacccatcccccgttcagtccactgcaaagggaggcctgtcgttgtagccaacccttacgatcggctcctcccccggaaagttcttcagcggggagtccgcgcgccggtcccacgcgcgcaagcagcggcacctcgacgagctccgcgcgcacgcagggcaggggcgggggtaggggcggaggcggctgggggcggcgggcgccgagtccggggctggcgggcgcagaggagaggccggagacgggcgccaaggccgcggctggcgggcgcggaggcgaggccggcggcgggcgccgaggcctcggatggcgggtgcggagacgaggctggcggtgggcgcggaggcaaggccagctacaggacacccggttcggctcctccgccaccggtcgcccggtagcgcgggcaagctccgcctcaacagtcggacgctcgggtgagctccacctctgccgccggccgtcgagcgcatgtgctgcctcctcggcagtcgaccgtccgagcgcgtgagcgtgagagagagagagcgtccgttgccgctaccactcctaccgccatcgccaactgccaccgccgtcgtcaactcggttcggagagagatagagctcaacaccttctccacctcaacacctcttggatcttggaggtggagggatcgatgagcgcgctgcgggcggctcaacctctccgagctcggggacaggcagtggctcgtcgtcgtcaccctcattcccccccgccggcgactaccgccgtgcgcgtgagagagactaagagagtgaggatgagtgagagagagagtgagtgagagagaggggggaatagtggaatatgagtatgacaggtgggtcccataatttttttataaagagaatgctgactggactgcaacgtgtacggcacgtagatcaaaaccaccgcggattaagtcgagggaggtaattcggtcagtattcatagttgggggtgaagaatatccggttttggggttcgggggggggggcaattcggacgaccgtgatagttccgggggaggggggttattcgtactttttccaaactgaaaaccggggtacactattcagatctcccctgtcgtttttcctcccggctgctcctgcacctgcacctgcacggacggaaccacgtttccgcatgcgcaccgacgacttttcgccgcatgaaaaccccttctcaggctcccaggcaatgggagaaatcgcctcccaacaataggaggaaagcaacaaccacctgacccaagcccccagtccaggtaggaggagtccactacacagtagtagtacacactaatagctgcttgctcgggccggcgtacgtgcgtgctcgcgacgaagcttcgttggggcggacaaattcgttcacctcactgtcttctcttctcggcggagatggagatgggcttgtaaaataataataataataaaattctccgggtctatcgtttttaacgactaataggctgtatttgagaaggagatagagaagattgaaaagatacgcaaaacgaggtgagctattagtgcatgattaattgaatattaactattttaaacttcaaaaatagattaatatgatttttaagcaactttcctatagatttttttaaaaaaagtaccgtttagtagtttgggaagtgtgcgcccggaaaacgaaacaaacaatatcacaatcacccagcgccgaacgcagcctaaagacggggacgtagaaacaacgagctttccggggacagcaacgcaggggccatcaggcgatggatgaatcgatcgatcgattgttgggacccattcatacatggcgccactataatgtgattgttgttcgctagttaatctatagcgagctagtcgctgcaacttgcattgaatctcgtatcgatcgtagtacagtattagcaacttgcttctcctgcaatggcgatgcataatttggttggtgcgtgatataccctgctcccctccggcccgtaattgtcacacctgacgtcatcccatcttttccaaatgtgcaaattttcctacttgaaccttattaaaacatactccctcctttcccgccgttgatttttttaaatatgtttgactgtttgtcttatttaaaaacttttatgaaatgtgtaaaactatatgtatacataaaagtatatttaacaataaatcaaatgataggaaaaggattaataattacttaaattttttgagtaagacgaacggttaaatatttttaaaaaagtcaacggcgtcaaacaatttgagatggaaggagtatattactaccacactatccactaatttcacctcacttcgtggtgagccagtggaggatattcggggggacctttttttggctgcatatatacttgcaagtatgctcacattgcaagaggtcaaatttccatctagtggtgaacattgaaggttaagattatgttgtcataattctctattccgttgtacgattttacgatcctaatcaaaggacctatggttttattattatttatttatatgatttgcggatcctacctagagatctctaattctaacatgtacacttgattaaaattaacatgcatttaagttaatccctttttatatattctcaccaacttgggcttttgagattgagctgattagtgcatgccacttaattaatagtgttgatgcctcttgttttttacctttttttttgtatgactgaagtgaaattaacgctctttttctattttctatattagtatagtttttttttgaaaagaactatattagtatagtagattcttctaattaaaaaataaattgttggcacgttgacttgttggaattattatttttcagatttcctatgtaatgagaaatgcataggggttttccggctagctccacaaggtggtaggctagatgatctgggttcaaagtctcactctttctaattatttgatattagttttagatttcctagctatgtgatctcggctgacatctctgatcttttttaccatcggggccttgcgattgtaatttcctagcagctgcagcgaacattcggtaaacttacccttacctcgcacataattggataagcatttcttaatcaagaagcattggactgttacggaatagcagatgacaataagagttgcaaatatgcaaagtttttttttattgttttgcttttatgcaatgattcttgcttacataatcgatgatattagccaagatcttttgattccttttggctgcttacatgtgggcttgttgcccaatgctccgtttactcgcgctagcgagcttcacaaagcaaattgctcgtagtgggtatcgatagtatgtctccctgcatgtgggtcccgtctcagagatgctgctgccattttcgaaaagggaaaaaaaacctaatattctactagtttaatatatcaagaactaattttggatcaaacaaggttaagctcatggtattaaacaaaagctgtggttgaaaaaacggaagcacacaaattaatttagagcatcaaacaagtcgtagcagcaaggtcggttcagctcacagttatttaaacagaataaattatattatgttcaaatgctcaacgcatacatatccaggtcacaacagtgtagtgaagtgagacttagcaaaacaaatttatattgtccaatgagtaaccatttttaaaataatttaacaacgggagtctagataacaggatgatgaaggataatagaataggaagcataaggtggccggcaggcatcagcatcggcaaagcccctccatcctaaaaatgaaaaggacaaaagtttcaatctaattgttatggcactaattaaacagggtttatatcagtgtgaagagacgctcccaatggatgctagctccttaatcaggaaaggccaggcgctccattaatagaagctatatggttctatcaccaacaatccatgtgtaaaataaactcacgcagtacaaaaatacgctcttttttaaaggacagggcaatagcactgtgttaataaccaaatttgataatctgagtatcggagatgaagatagaaacggggtggaattcaagatgaaaatcattccggaaatagagcaaggatcggctaaattccgaatcggctgcgaccagaatcggcaaagtccgagttggacaaggttagccgattgagccaaatccgataatatgacacggcatacattgtcgggttgagttaatgtgtttcatgaggattgccacgcatggatagagtcctgagaaggcaattgtatctgttaattaggatatttcatgtaatttccttagagatatgtttgggcaaaattctgccacaaagacttatggtatcttagagtttgttagagataagagtcgtatccgacacggacttgttttgtaatctcgggtataaatagaccccgagccccatgtaattaaacaacacacgttcaatacaatctcggcgcatcgccacccttttacttttgttttgtttcgatgagttcttgcttttggcttgagctgcatcagtttcgatcttcaactagaggtaaaacttgttatggcggcttgcgttctcgggattagtgcttccatatttatgatactctaatcttgtttatgtaattcatcgaattattatatgttttatataatctctggcaatattgctatctaactttcaatcggctaacgtctgtcattagaaggcagccgattaggttaaataccgacgttgacttagattatataggatatctaccactctatcaaacatccaacggcttgattgtctagatattgtccttttttttcatacttatagctgcatcagatgttcgaccttataagtcgtgattagaatctcgatctctagccttcttttggttgccgattagggtagcatcggggtttcagccgatcttacctgatttaactatatttatcttatatgcttgattgacatgttaaatctgccctttatattaagatcttgttgcatttaagtatattaggctctcgtttgatatattctacttgctttgatatcttaatatagagtggtatcggagtattagccgatacatgctagatctatctgatcggctatgctatgaacatatatagtcttgttgttaatatatatttcgatctaagtgatttatactgtctcggcatggcgactgatctatcccaatcacttgatttaagtatatattgacataaggatcatatattgttaatatctacagccgatcgagtagatttagttctttcttactcattcatgattgccgatcgatttacatatgacatcggcttaaagataaatgatatgtcatcggcaattagccgatcggctatcgtttatggatttaaccgcggtttctttgtctttatttcttgttgattgcaggatcaaatcaactggcacgctcacgaatctaaaggcaagcttttggacctgcacaggagttaagcagatctcctaggcctcgtgtttttacatcaacacactgccaatcaaattgtgaacagtgaacttagattcaacatgcgtttggttgaagggattgaatagaataaattcggattatccgttttttacggtggttggtttggaaacaggtgagatgagatgatcgctaacgggcagatccaggcctcgagtcacttgcgctgtggcctgaggccaatgattgttcacccactatgcccaacaagatttcacaatgtaactcaaagtatagctaaaagcctaatgggttgacccatactttgagcctattctagatccgcaataatcacttagggcttgtttggttaatcctttcacactaggattgaggaggtttagaggaaaataattcctcatttattagggtgtataattaatcctccttgatacttttgttcggttaatctcaaaagaaaggaattggaggagattgtgaaagatgattaaccgaacaagatctaaagggaaatattctcctaaggtgtgaattagcttcatatctcaaaaactgatgtaccaatccaactcacttcctctctcttattgacatgtgggccacatccttccatcccttaaaaacaaggattattacatccctcatgccaaacaggtagtgggatcacccattttgaaaaacatgatgtacctaacacattccatctcattttcaaactaaacaaacgtggttttaatcttttatcttatgagactccttggttacctttgtagtaaaaaatctctatgtaaatagcagtggcgtagcaaggatttaaaggaaaggcggcccatctatatatactaggtcaattaaaaggtggtccactatacaatttttattatattaactagtacatatactatagttttaatcttgatcaatttttaggtggtccatggaccacaacgccacctagctagctacgccactggtaaatagatactccattcaaaagtattagacatatcactaagatataggaaaaaaataacttataacgaagaccaaaaagtgtatgcatgtatacaacaaataagaattaagatagttgttctagttcaacttttagtggaccatttaattcatctcttcccatcttatttgaaaaactataaaataaaatatgtttaacacttttggatgaagagtgcactactacttccatatgcggctaggggtagaaaaaaaaactcgaaactcatgacctaactcaactcgtgtaaaactcggctcgactcaactcgactcgggtagttaatgagttgagttgattttgaacttttactcattttcttaatgagccaactcgagctagctcgttgagctcatgatgtattaagacggaaattaattgtctatatatttacaggtgtaaaggtcgtgttaactcataattattcattgtagcacaatcctatgagtcatgatatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtctaaacaggaataatccctcaggttctcgccccgaaactggcgatacaccgggaggcctcgtcagggaaaggattacattcccttaacaacggcctggaggcacnaaaaccggtgaatattaattattggcg

SEQ ID NO: 22003 - DNA, 1618 bp, Oryza sativa
  unsure (1)..(1618): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctaagtgatttatactgtctcggcatggcgactgatctatcccaatcacttgatttaagtatatattgacataaggatcatatattgttaatatctacagccgatcgagtagatttagttctttcttactcattcatgattgccgatcgatttacatatgacatcggcttaaagataaatgatatgtcatcggcaattagccgatcggctatcgtttatggatttaaccgcggtttctttgtctttatttcttgttgattgcaggatcaaatcaactggcacgctcacgaatctaaaggcaagcttttggacctgcacaggagttaagcagatctcctaggcctcgtgtttttacatcaacacactgccaatcaaattgtgaacagtgaacttagattcaacatgcgtttggttgaagggattgaatagaataaattcggattatccgttttttacggtggttggtttggaaacaggtgagatgagatgatcgctaacgggcagatccaggcctcgagtcacttgcgctgtggcctgaggccaatgattgttcacccactatgcccaacaagatttcacaatgtaactcaaagtatagctaaaagcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcctccntctttt

SEQ ID NO: 22004 - DNA, 1138 bp, Oryza sativa
  unsure (1)..(1138): unsure at all n locations
gcttccttggtatgacgnttcgagagcgcnccacnagcacaagtacgcacttctgtttctgtgcctatcacnacacctcactccttcgtgcatgtctatggtctgccctttttttttttttcttgcttctctttttccgccgcggtgagaccgtgaaacgtttttttgctgatttttttattttagaaattgaatctttcatctttaatctttgctgaaagttttgaatgtgatttaaaagtcttcaatgtttaagttgaaattatttaaatctgagttgaaagttttcaaatctttagttcaaagttttggaatcttgacttaaatagttgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaatcgtattaccgttaattctaaggccggtaacttcggttatcccaccggaatcactgggattaaccccaggaaaagaactttgtgaagcacaatgtgccacgccaaaaggccacggacaccgttataaagagccgcgctcttgttggggtttattaccatagagtttctgccccctcgtgtcaaagctattacacagaatatcgccgctttcaattctagagagtggcgaaaaacctccacgggcatttttaaaaatcaccgccgtttctcctctcggaaagtaccctttgtgcctctttctcttttcggacctctttctcttttaccggaatatcctgttttcgccccttttagtatacttctactctcccctcccccttctctttcatgggggggggaggagggg

SEQ ID NO: 22005 - DNA, 1774 bp, Oryza sativa
  unsure (1)..(1774): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgccgcggcccggcgcgcgagccgacgatggaggaaaggatccaccgcgtcgcgctgaaggaggcaggaaccggaccttcttgaccgccgtccgaaagctgccgaggagcgacgacgtcgtcgtcgtggacgatcgcctctccggcgacgccatctcgatcgatcggtggagacgttgaccaccggcgaagacgacttggcgtgcgcgcctgcacgaagcttagccgcgcttactttgtcctcctctttgtcgttgaggctttcgagtcgtgacaagcaaccgaacgcgggccgagcgagagagagacgaacgaacgatgcgtttggttaacgcccgaaaggtggtgatggaaagtttgtggagagcaagaggcgttcccttgtgtgtgcatccgcgttcatatagcggagagacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgagtttaaaaaaattgcctctaattaaagtgggaaccccccggcctttaagaacaagcgtttcccccggaggtcttttggctctttggttgnnnnnnnnnnnnnnnnnnnnnnnnnnnnnnnnnnnnnnnnnnnn

SEQ ID NO: 22006 - DNA, 1958 bp, Oryza sativa
  unsure (1)..(1958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctttcacacggattttaattattctaggcataatttcgaggatgtattttagagtcgttttgggacgcgacaaacctaccccccttaaacggaatctcgaccccgagattcggaagaactagcgaagagatcgggatgggctgccttcagctcgtcttcacgctcccaagtagcttcttcctcggcgtggttgctccactggaccttgcaaaaatggattacccggttcctggtcctgcgttccattgtgtccaggattttcactggcctctccacgtaggtcaagtcttcgcgaacttcaatttgctctgagtcggcctgctcggatggcactcgaagacatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagactcctttggcgtctccgtgtccaccttgcggtaccggtaaccgtccgctttttctttgggagaaggcgttctttatattaccccgtaggttctaaatcggggaggcgttctcccacactggttgtggacaaaccccctttaaccacacgcgcggcttatatggaatatattttcg

SEQ ID NO: 22007 - DNA, 1802 bp, Oryza sativa
  unsure (1)..(1802): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgttccggccctcggtacagagtgacagtgcgtctcgcgcaatccactactccttggaattgagccaaccaattcatcctaaggatcacatccaagttcttggtgtctagaagaatcagatccgagggaaaaggaatcccctgaatttctatagggacggcagggctataatactttgctgtcataacccctccaggggtggtgatgagcagagggttcctaagcctttctacccccaactgttttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgattgacattgctggcgcctcggctttgggcatttatccgcaaagtgcccgggctcgaagcagttgaagcacagacgctgcggaccttgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgagatacaaaaattcccgttaatcaaggtggcaaaccccaaggatatataaacccgcgggttccccggagagtcctctggcctctctgtcc

SEQ ID NO: 22008 - DNA, 3359 bp, Oryza sativa
  unsure (1)..(3359): unsure at all n locations
ccgctaatgacgcccttagganngatcaacttttggtgtaccttgcctcctgggacaaggattaatgcacgcacgtaaggaacgcccggtgggttatttcaggtcgtgacactgggattcaatatgctcaaagatgatgtgacttgccttgctcgctttcccaaacgtcggcttcaacttccacgaagagcggatcttccgaagctatagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatagccatttgaagcttatatgctctttaattgaatatttgcgaatttcttcatttaaattttaatttaaaatcggatttattgcgtcagccgaggggaaagggcgcgcggaccgggtccacgggagtggggcccacgcggcagccccacggtccacggtggaccgggtgcacgcggcttacaccggccggcgccgtgggccccacgcgtcagccgcacccgagggcgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacggggacggcggcgttccggcggtcggcggtcgaaacgggggggggggggtggacgaggtcggcgaggtcgcggcggagccgaaggaggcgacgccgaaacgggagagggtccggggcgacgacggcggtggaccggagctcggcggcgacggcggagagagagaacgacggcgcgagctcgattccgacggggagagagagcggcgagtggcggaaacggtggagggaggcacggggagcgtttaaatagtgttggagggggagagaacgnccgnatgagggtgaatcggccgcggaagatccgnccgccattgatgcaccggcgaagtttgctggagtgtttccaaacgaatccgagggagagagagagagagggaaaagtggggggaaagggagagggaatcacggggagtgatttccccctctttattgcgcgcgggggcggcggaatgcggcggaatccgcggcggcggcggcgctagggcacgggcaaggcggcggttgcggcgcgaggtaggggatgacgggtgggccccacccgtcagcgagggtggcgggcgggcccgcccgtcagcggcgcgcgcgcgggggaaggccggatgggccgcgggggagaggagagagagggagggagctaggccgagccggcccaagagggggaagggggaaaaagactttttagggtttttttcttttaataaaacctttttaactttgtttatttcttcttaattattatttgtgctctgaaaattccactaaaatttatttacgcattttaggcttttaggaaatatacaaaaatcctccaagccttattcgacttttaactttgcacatttttattgttggaggctttcacatggattttacttattctatgcacaattttgaggatgtattttagagtcgttttgggacgcgacacccagtttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagcatgattttaggtagatgcttcgctattttaattaggtaacactaggtggtttttcaactctagactttgggaatattcatatcacctggacactttggaatggtttggttattgtggaattggcttcacaccgctccttctattcaaaatccccaaaatggttttaggctgggcttggggtgcgtggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatcactaggacaaatgaaggctacacgagctgcggcccggtagtcgagatgtcatggcacagggccggtgtcctgctgctaggggctcagtcctgcctgcctgtcccgggggttccggccgtaggtgggattgagtcggtactcttgtctatggctaggatgggttggaaactatgtcacgtcttccgtctgtacaccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaactgtggaatggttggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtgcaagagccctaaagggcccgaacccaaaagagcccggttgttgtttttcatagagtctccccctggaaggattaaaaaaattggcctaaattaagtgggggacacccaggaatttaaaatacacgcggttcccttaaagtctcttggctttttgtgcaccttgtgtaccgaaacttcgcttttt

SEQ ID NO: 22009 - DNA, 31738 bp, Oryza sativa
  unsure (1)..(31738): unsure at all n locations
aaatttagagaaaacccccctttataaaggcacaaggggttttcaacacaagctggggaatttaaaccaccccactttgaaagattggatattggaaaagttttcacccccctttttttaaaatccccaaaagttttagccgggcctgggggggggttttaaagaagcactcgcccattaagagcggtttgcgccttgtttcaaagccctaccgtcttcaaaattttaggggtaaggcctagttgtggcccagtctggtaaaaccaaaggtccccgatggaaatgaaaaagtcgggggtcaatgccctccctaggccaaataaggcttacacancttcggcccggtattcaagttgtcatgcacaagggcgggtgtcttgtgctaggggctcagtcctgcctgcctgtccggggggttccggccgtaggtggaattgagtcggtactcttgtctatggctaggatgggttggaaactatgtcacgtcttccgtctgtacaccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaactgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtctacaaaatagctttgagcaactaaatatctttaaatgctgtttactgcaaccctaaacctttatagtatgactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgtctgtggtcgtcgccctagtcttccgctgtttctcgtttgtctctgtgtgtgctgggccttcgctgcccatgtaataaattaactatttacgctttcgcttgttaaactctgaattgtatcaacttttggtgtaccttgcctcctgggacaaggattaatgcacgcatgtaaggaacgcccgttgggttatttccggtcgtgacaagttggtatcagagcccccttgaccctaggacgagccgtagatcccaagccttagcaatattttcaaaaataaaaatcctttgttatttgaaaactgtctagtctctctctgtcctgctgcttcatttatcgccaaaatctgacttttaaatgttgcttttcttttgttttgtttgtagatggccggcagcgtcagccgtcgtggtctggacatgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgactacgccatcttccgggatgctagctcggaggatgacgctaccatcatgcacctggcgcgcatggtggaggcgtacgacgcggctcgtatcgacttccatcagatggtgcgccgtgggatggtcgggaacaacatgaagatcctggagctgcgtcaggagaatctgcagctgaagaaggacctagacgcagtagaggcgcagctgcatcagctcaagatcgcccagggagaggtctgtcgccccaagcgtcgccgcgtctgccgcagccagaagatcaccgcccgcaagagcacctctaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttcttgtttgtcttcttgttggggtgtgtggcataactgtgtcggagcctgtctttattttatttgcctaagcaacttgaactttaatgaaccaatttaatagcagtaataaattcaagaattatggtagtcgtgggtggttagttttaattgtcagctctctctgtttgctggttctgtgtggggttttcagatggtgaagaccaggagaaatgctgccaccggtgatggcaaccaacccgaaggcagcaaccacaaccaccagggcagcccacctccacctccttctccgcctccaccaccaccaccagacaccaacgccattctcacccaaatcctcgcccagcaggccaacatgatgactgctttcctccaccacctccaaaatccgccacaacagaatgcaccaccaccacccccacaacactctaaactcgccgagttcctccgcatccgtccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctttatggtgggaccatttccaggctacacagccagagcggcagcctattacttgagcccgcttcaccgccgcttttcggaggacccatgtgcccgccggagtcgtggcccttaagaaaagggaattccgagagttgaagcaaggcaaccgctctgtgatggagtatttgcatgagttgaacaacctggcccggtacgccccggaggatgtacgggaagatgaggaaaagcaggagaagttcttggcaggaatggaccctgagctgtccgtgcgcctagtctccggggactatccggatttccaacgtctgatggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgccccgacctcaattcgtggtgcgcgtcccacagccgcagtagcagcagagtcaacaagggactcgtgcgccctgtcctcctacgccaactgtgcagcctggtcaaggccgcagggacgctcaaggtccgcagcgtctgtgcttcaactgcttcgagcccgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatttgtgccattcgtggggagaaaacagttgggggtagaaaggcttaggaaccctctgctcatcaccacccctggaggggttatgacagcaaagtattatagccatgccgtccctatagaaattcaggggattccttttccctcggatctgattcttctagacaccaagaacttggatgtgatccttaggatgaattggttggctcaattccaaggagtagtggattgcgcgagacgcactgtcactctgtaccgagggccggaacaaccggttgttttctttgcacccccaacctctgtcagtagttcagaacttcatcagataggactgtcagaaatccccatcgtcagagagttcggagacgtgtttccggaagaactacccggtatgccgcccaagcgagagattgagttccggatagatcttgctccaggaaccactcctttgtacaagcgaccctaccgtatggcagcaaatgaactggccgaagtcaagaaacagttggaagagttgaaataaaaggggtatatacgttcgagtagttccccctggggtgctcctgtgatttttgtggagaagaaagacaagatgaagaggatgtgcgttgactacagagctctcaatgaagtcaccatcaaaaacaagtaccctcttccccgtatcgatgatatgttcgatcagcttaaaggtgccactgtattctccaagattgatcttcgttccggatatcaccaattacgtattcgtgaagaagacattcctaagaccgcattcaccacgcgatacggactgtatgaattcacagtgatgtcgttcggtttaaccaatgcacctgccttcttcatgaacttaatgaacaaagtgttcatggaatacttggataagtttgtggtggttttcattgatgacattctgatatactcacaatccgaggaagaccatcagcaccatctccgtctggtgttgggaaagttgcgggaacatcaattgtatgccaaacttagcaagtgtgagttctggttgtccgaagtcaaattcttaggacacgtgatatctgctaaaggagttgcggtggaccccgaaacagtgaccgccgtcactgattggaagcaacccaagacagtcactcaagttcgcagtttcttaggtttggcaggatactaccggaggtttatcgagaacttctccaaaatcgctcgacccatgacacagttgttgaagaaagaagagaaatttgtgtggagcccgcaatgcgagaaggcgttccaaactctcaaagaaaagctggtttcctcgccggtgttaatcttgccggatactcgcaaggacttcatggtgtattgtgacgcttcgcgccaaggattggggtgcgtgctcatgcaggacggtcatgtggtggcctatgcctcacgccagctacggcctcatgaaggcaactaccctacccatgatctggaattagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgacgtgggaattcactatcatcctggtaaggccaacgtggttgccgacgctctaagtcgaaaaagccattgcaacactcttgacgtccgtggcattccacccgaacttaaccaacagatggaagccctgaacctaagcatagttggtcgtggattcttggctacgctggaagccaagcccaccttgctcgatcaaatccgcgaggctcagaagaacgacccggacatgcgtggactcctcaagaatatgaaacagggtaaagccgctggtttcacagaggatgaacacggaaccctatggaacggaaatcgggtatgcgttccagatgacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcggtttattcctgtgaagaccacctatggagggaacaaactagccgagctttacttcgctaggatcgtgagtctccatggcgttcccaagaaaatcgtatctgataggggaagccaattcacctctcacttttggaagaagctccaagaagagttgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaacccagtatacaaatggcaccttatgaagcgttgtatgggcgcaaatgccggacaccgctattgtgggaccgagttggggaaagccaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcggggtgtgcacaggtttcagacaaaggggaagctcgcacctcggtatgtgggtcctttccgtatcattgctcggtgcggagaagtcgcttaccagttggagctgcccgcctccttgggcaacgtgcacgatgtgttccatgtgtcgcaactcaagaaatgtcttcgagtgccatccgagcaggccgactcagagcaaattgaagttcgcgaagacttgacctacgtggagaggccagtgaaaatcctggacacaatggaacgcaggaccaggaaccgggtaatccatttttgcaaggtccagtggagcaaccacgccgaggaagaagctacttgggagcgtgaagacgagctgaaggcagcccatcccgatctcttcgctagttcttccgaatctcggggtcgagattccgtttaaggggggtaggtttgtcgcgtcccaaaacgactctaaaatacatcctcgaaattatgcctagaataattaaaatccgtgtgaaagcctccaacaattaaaatgtgcaaagttaaaagtcgaataaggcttggaggatttttgtatatttcctaaaagcctaaaatgcgtaaataaattttagtggaattttcagagcacaaataataattattaagaaataaacaaagttaaaaaggttttacaaaaagaaaaaccctaaaaagtcctttttttccccccctccccctcttgggccggctcggcccacctccctccctctctctcctctcccccgcggcccaatcggcctcctccccgcgcgcgtgccgctgacgggcgggcccgcctgccaccctcgctgacgggtggggcccacccgtcatcccctgcctcccgccgctcccgccgcctcgcccgtgccctagcgccgccgccgcctcccacaatccccgcgcgcaataaagagggggaaatcactccccatgattccctctccctttccccccatttttccctcgctctctcccgttcaaacgggcggatttgcccccgcaaatctcgccggcgccattgatggagcccgagagcgccgcgccggtttccttctcctccggccgccctctctcactcccaaccctatataaacactccccgtgcctccctccgccggttccgccactcgccgctctctctccccgtcggaatcgagctcgcaccgtcgctctctctctccgccgtcgccgccgagctccggtccgccgccgtcgtcgccccggaccttctcccgtttcggcgtcgccttcttcgggttcgccgcgacctcgccgacctcgtccacctctccgtttcggtcgccgatcgccggaacactgccgtccccgtctacccgagccgcgccgccgtcttcctccgctccggtcgccgttcccgtcgtcgccgtcgacccggggtgagccgtagaccgccgtttcgcttcccccttccctcccctctctcgggcgccgctccgccgcgccggtggtcaccggcggcgaccatcggggtgcgggtgcgccgcctcccgtcggctgtgccggcgtggccgccttcgggcgcgtcccgcggctgccatgtggggcccggccgtcagccgcccacgccctggggtgcggctgacgcgtggggcccacggcgccggccggtgtgagccgcgtgcacccggtccaccgtggaccgtggggctgccgcgtgggccccactcccgtggacccggtccgcgcgccctctcccctcggctgacgcaataaatccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgaacaaggcaagtcacatcatctttgagcatattgaatcccagtttataaaattatgttgctttaaattattacattatcgctttatttaaattcccgcgttatcactgttttatctagccatgcctatttacctttgttatgaccttattattattgttattgttattattaccttgttcaccctagattaaacaaaaccccaactagtggacactcttctcatggtaccactagcatgattttaggtagatgcttcgctattttaattaggtaacactaggtggtttttcaactctagactttgggaatattcatatcacctggacactttggaatggtttggttattgtggaattggcttcacaccgctccttctattcaaaatccccaaaatggttttaggctgggctcggggtgcgtggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatcactaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtacaccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaactgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtctacaaaatagctttgagcaactaaatatctttaaatgctggttactgcaaccctaaacctttatagtatgactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgcctgtggtcgtcgccctagtcttccgctgtttctcgtttgtctctgtgtgtgctgggccttcgctgcccatgtaataaattaactatttacgcttccgcttgttaaactctgaaatgtatcaacttttggtgtaccttgcctcctgggacaaggattaatgcacgcacgtaaggaacgcccgttgggttatttccggtcgtgacacctcccgccggccacgctgacgtggccgcctccgggcgcgccgtgtggccgccgggtggggcccggccgtcagccgcccgtgccctcgggtgcagctgacgcgtggggcccacggcgccggtcggtgtgagcccgggtgtgtccggtccaccgtggaccgtgaggctgccgcgtgggccccactcccatggacccggtccgcgcgccatctcccctggttaacgcaataaatcctttttaaattaaaatttaaatgaagaaattcacaaatattcatttaaagagcatataaacttcaaatgaccataacttggccatttgaactcggaattggaccgttcaagtctctaatttttccttaagaagccaagaacccatttttgtgctttattttggtttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcctagtttgtaaaattatgttgatttaacttattgcattatcgctttatttaaattcccgcgtcatcactgttttatttagccatgcctatttacctttgttatgaccttattattattgttattgttattattaccttgttcaccctagaaccaacaaaaccccaactagtggacactctactcatggtaccactagtatgattttaggtagatgcttcgctttaattaggtaacattaggtgggtttacaactctagactttgggaatattcatatcacctggacactttggaatggtttggttattgtggaattggcttcacaccgctccttctattcaaaatccccaaaatggttttaggctgggctccgggtgcatggttttgatagtagcacctctgttgcaaagcactaccgtacttccacatgtctagtgggtaaggcttagtttgtggctcattctggttataaacaaaagtacccggattagagatggacgaagtcgggggttcgatggacatctctaggacaaatgaaggctacacgggctgcggttcggtagtcgagatgtcatggcacagggccggtgtcctgctgttaggggctcagtcctgcctacctgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaagtaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacctagaagaggagttcctagaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtggttttttctttctgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggagggtgacgatgcagagccccacgctggttgggaggtcactgcagtgatcctctctggctctcccgagcggacttcgctggcagtcaccgcgggtggagattctttccccgccgcttgccagagcgccgctctcctcgccatcggcactcttcaccagcgatacccggacgagttgcagcactcgccctaccgctaccaccctcgccgcggaggagcccgcgactacgccaccttccgggatgctagctcggaggatgacgctaccctcgtgcacctggggcgcatggtggaggcgtacgacgcggctcgtatcgacttccatcagatggtgcgccgtgggatggtcgagaacaacatgaagatcctggagctgcgtcaagagaatctgcagctcaagaaggacctagacgcagtggaggcgcagctgcatcagctcaagatcgcccagggagaggtctgccaccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctagcccgtcgcagcggtagacgaggagttagtaggcttgcgcgtgtgttctttctcgtttgtcttcttgttgggttgtgtggggcatggttatgccggtgtgtggtataactgtgtcggagcctatctttattttatttgcctaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacctgaaggcagcaaccaccaccaccagggcagcccacctccacctcctcctccgcctccaccaccaccaccagataccaacgccattctcacccaaatcctcgcccagcaggccaacatgatgactgctttcctccaccacatccaaaatccgccacaacataatgctccaccaccacccccacaacactctaaactcgccgagttcctccgcatccgcccacctaccttctctagctccaacaaccccatggatgcgttggattggttgcatgccgtggggaaaaagctagacactgtgcagtgcagcggagctcaattcctaaatgatacaaagaacagttcagtaattatttgatcaataatgatctaattataattgttaagtgcttttatcgtttaaaatccttaaattataaattgttgtttaaaaggaattattagaaatgattttaaaagcttaaaagagaagatctaagtttaatttgctaaatctcaatataaaattgggctagataaaattttattaaatactttgcttgttcctctattttctagaattttctgggaattgtttgagcaagggaagtatttttaataattgaaacaacatttcaccatttattttaattaaaaagttccaaaacccctccctaaagttgttgggccgtttccggcccaactcttctcttcccgcgcgcggccaagccggcccaagtcggcccagccgagccgccccgccccctccttctctagccaccgacatgtggggcccacatgtcggggtcatccctaacctccagccggccggccgcctagccgagcccgagctgccgcctctctccgccaatttcgcctcttccggtcgccctccagtccgattagttgaggggtttaaataaaaacatcctcctctatctttcccctcaagaatcggagctattcgttgagtatcttgtccgaatcgaactcgttttcgagtttatctccaaaaccgagttttgtttttccggagccgatttcttgcgggaggagtcggatctcttcaatccaaggctataaataggaccccctagtcctcctctttcgtttgcccctgttcccgagccttcccgtgctccgtagctccgtcgccaccgccgccaagcaaaccgccgccgcgggccatctccggtgccgccgcgccgccgcctccatcgtcgtcgccggtcgccgtcaccaccgttgggtacgccgtggtgaggggaagctcggccacccttccttttccgttgccggtcaccggagctccgccgccccgtgcaagccgagccgccgccgtcgcctcttcgtcgccggccgtcatcgttcgtcgtttggttcgagggtgagtaccgttgggttcgtctcgtcgccctctatgtgtctgtgtcctccaaatccgcagccggctgctctaactccggcgagcttgtcatccgaagccggccacctttgatgatgtcatcgtgacatcatcggtttctctttttcccgtttttctaatagattaaatcttcggaaaatcataactaattaaccgtaactctgtttcaggtggttcaagttgctaaatttttctaaaatcaagatctacatgttaaaaatattcacatgtactgtttatgcttgtttttttgtactgttttattgatttttattctttcgctttagtttccgacgttccggaggagagcgtttccgttgaggaaggttccgaagcgtttgcggaagcccaaggcaaatcacacagatcccaaacaaccctttgagcatgttaaacccgtttaaagctattattttatttcaactatgcattattttttaatgtcatcgggtggtgaacctttccccattaattaatggccgaagatgatcttattttcctatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgattcattatagtgcgccagactgtgaagcggcgagaagtccatgggggttgctggggagtccatgccttgtttataagggggtgattatgatccaggaaaggtgcgctgtaatggcttatgttgtgcaaggggtattgtcacaactcctttccgaggtaccgtggtggtattgaggcacatggtgacatgatgtggggttgtgtcttgtgggtacagtggtacacgtctggccagagtaaaactattcgaatagccgtgcccgcggttatgggcgggttgagcaatgtttttcttgattagtctcacacctctcacaataattatggatgttaatacttggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctctggtatccttgtgcacttgcatatttgctgtgtggcttgttgagtatgtcatatgctcattcttgcaataatcatcaaacctcagttgaagataaaggatccagaaggagaagacatttggcttataccccagttgagctgcctgtgggagtggagctgaagccatcgctagaccgttaattccgctgctgttttcttttctttgtaagtatgtaacgttattattaagatggatttgtatattaaaattgtcagtttgtgtacctcggctgattcctggacgaggattttatgcacaaataagttcggaaattactagtgaatttccgggcgtgacatcttcggctggggatgcccagagccgataaggccttgtcagatccttcagagacgaaagaccatgtaagacctggtcgtgtaagagttctcgccgtgcgtattaaccaagccgtgtaatcggaaattgacttttccaacctcacggctgggggctaggatcagagctatttcaaccaagacaggccaggagtccaagagccttgtcacccgaggacatccctccgacgacaaggctgggggctagggagagtgtacaactcaaacggctaactaaggtcgttaactgagaacacgctcttacaaacaacacccagagtaagaaacatttgttaaagatatatttctttattcacaaaatattccttacagttagcacataaatattatgtcaaattacgtcttttcccaagatatcttgttacagggtacaaattctaccaagaaggccaacgaaaatcttctcggccagcggcgacattgatctcgcgagatggtcaatctctgccggatttctccgagaacggccaaaaccctcacgaagaaattcgagatccaggcgcgggcggtgatctcgcacacaggccaacacatgccccccggcatatcgactcgctcgacgacactcttgcttcagggcctcgtcgatccgctgaccaatgccgtcgagttgagcgcaggctccattgagccacgagatgtacccggccgccgactcttcaggatcaccgcgggctacccgaagatctcggcacaccctcgccatcgaggtgcagcaattcttcagataagaggagaaccacacctctcgacctcggagtgtttccacagcttggtcctttttcatggctagcatcgccctctcgagttccgccacttcacatttcgtcttccagtattggatacgacgatcttgagtcgcaaaggcatcctcgagatctgccaaaaatgatggtcattaccacagcttggaaaccaacaaaaagcgacaaggcgcacaagatcactcactcgggtcagttgccgccacttcggtctctgcatcagcaacctggccatcgacgatatgcgccgcgctcggttctaactcgagtaccggggttatcgccatcgattcaggttgcccgcgctgccggacatcctcatcatcgacatctctacaatcgataagatgaattttcaagatcaaagatgaacagagctggtagtaatatacatgaagacaaccaaagtttggggttcacaaatcatgagaaggaaataaaaatacaagtgctcctactcttcgaagagggggaggacagactcccccagatcaccgacttcctccatcacccccttacgtgcgtcgcttgccgccccctgatccaggatctcgcggagatctagttcaggacgcgacaaccgcacggacgcgaggacgtgacacgccccggtataaataccgttggacgtctcctccgcaactcaggccgcctgcttcgcagggatttctcccatcgccgtcgccagctccgctagagaagaggtgagggagaactcgtcggggttcttggggatcgtcgacttgaccccacactccgcggcaagctggtggaggccggtgtatgtgaccctcagagaaccacggatctcggagaggttatctccgagttccgccatgcggttctcgagtcccttgcgttggcactcgttgccggccactagttccctcattttcacgaggtcctcgcgggcttcggccagctcccgcaacagccgctccgcgcgcgcgttagccgccgctgtctccgccctcgcctccgtgacctcgcgaccaatgccgcgagcgccggcttcgagaaggcgccccatctcgacttggagctcctcccaggtgaggatggactctggcgcgccacggtttctgacggggtcgccgctggggccgcttggcgtcgcctcccgagtcccgatcacgggagcgacgtcagtcgacgctgttacaggggacgcgctagaagtccccccagacttggcccgagccgctttcgctcgtgcctccctgtcaacaccgatggatcagagttcggttcaaaaagaagacttaagaatctgagaagtttcgcgacttacttctcgccgatcgtcacaaggcgttgacgactgcaagaggaggggatgcgtcggaaacctgcaaagtcgccagtgagaacaagaactttcctagttgctcagcttaacgacaaggcgaatgttaccgtcgaagtctctgccttgcgacggtgtccgagcacggacgagaacatccttggcttactcggagccttgccaccactaccagcagcggcgtcggatgcctcctcgaccaccttctccttcagagaagccgccacctggtgatccgcgagcggtccgatgacgtcagtcaagggaagggcctacgctaagtccgatcacaagctgattccaaatgaaggaggaaaaagacatctaaatagacttacattgatcgcctcgtcgcgttccgcctctcccttttcacaaaggggcacagggatgtcgctcgcggttgtcgcgccgctgatcatcacctgaccaacgcgtcgctccacgccgtcactgctcagagctatcaaagaagaatcattttccgataagtcaaaagcgaacgcgaatacggccatatcaaagtgaatacaagaaacataccccgaggagaaacccgggtcgcgtcatctggcctggaataattatacgccgggtgggctcgagcctgaagcggctggatactcctaccaacgaagtctgcaacgacttcataccccgataagccccgttctcgaagatcatcgatgatgtcgataaacgattggagagagggggtcaaagggggcttggcggtccaaaccggaatcttgtttggctgctcgtcaggaacaatgagggcaggattcgagtccttaatctcgagataaaaccacctgttctgccatttgctgcgagaagaggggcactggaaggggacgtgctgcgagaagaggggcactggaaggggacgtattgcgacttcatcccatcacgaagtcagaacccaacgcagccagacaccttgttgagttccatccaacgcaactcgtaataaaagcgaaacaaatctagaaaaggctctactccaatgtaggcctcacaaagatgcacgaaaatgctgagaaatgcgatggagttgggattcaagtgcaaaagtgaaagcccatagaagtttaagaccagcaaaaggaattcagaggggggaggaagaaacccgcagacaatgtaatcctcaatcgcaaccatgcgacctaggacgggctggggagtagtacctcctgcttccctctctgccttgtcgtggccagggaggccaccctcctcctgaagtttcttcagggtcgcggcggtggaggtcgacttcccaagatccatggccgtcgggagatcgccggaagatcgccggaaacggacgatgaatcggtgaggctagggctttttgcggcggcgaggaaggcgaggaatgcaaaggagcagtgtatacttaatgaagtaggcggacctcaaagctcacgccctaaatacctttaaatagacgcactcccgacggtgcgaattccaaggaaataggagaaatccccgccggagatttctatgtccgttgtgcatggtggtttttggacttcagttcaaaattcattcgtgaccgttggacttcaaacggtgcgctcgattacacgtcatctccttggttctcgcacctggaatggcaacgttctcgacacctggagtcgcaaacggtctcacgagttcatttttgagcagaagtcgggggctactgtcagggttacgggttaggcatacccttcaccctacgatatacgtcacgtatcgacaaggtatatccacgtgtatatggataaatcctctagcacttaaggaaattcttcgtaaagacaacaaacaaggagaaaccttctcgaacaagaattgggttacctacgtatcgtatcaggtttggtacatccgagtcctactcagatatcgcccaacctacggtataaaagggaccccccgcggaggccatagctcatcgaatctcaaagcctagacaaccaacacagcctacgaagtcagagcctacaaagagccaagtcgacgagagctagtcggatcatctcgactacgatctcgtcgaatctcccgagttaagtcttttcctttgtaatctgtgttttccaccatataatcccatatcaactggattagggctattacctgtcaaggggcctgaaccagtataattcttgtcttttgattgctcgatgtcgtactacgtagatccttataccggcgtaccccaatactctctatatccggtctacgggtatcccccgtcgacaccatccattgagcaagctttgcgtgaagaagagattgaagaagatgttgatcaagccgcagccgaagtaagtgacacagaaaaaactccatcggcttcatccaaacaaactcctccaactccttctgccccagctcatttctcaagggtaaacatctctctctgatttccttttaaaactatttcattcacagccgatcacttataaatctcatctttgtagaaaaagaaaactgctgtaagaaattggcagcaacaacacttaaaccagctccaccagaaagactattgtgtataattattttcattaatccaatcatagctgatatttacttaacatttgtctttttacagcctcctcccccatcttcacctcctgtacaacaaacatcaagtgattgaactccattggctataggaagtcaccatgttgaggaagaagaacaaccagccgctcctgccatcccagtaagtcttgtctatgaaaatcttgaatcggctgaataactcattttgataatcaactgtcttcaaatttcttcttgcaggccttagccgatctgttctctttcgatatcaaagactatcttgatgaacaaacagaagaagacacccccagcaaggccaaccattccacattttagttgttaagaaaattttaagaattaaaacactaacttgggtacattgctaggcttgcccataaccgagggcgtggctattcgaatagattatactctgatcagaggtgtacatctttacccacaagacacgtcttcctcacgtgtaaccacgtcccaacataccaccacggcatacggacgtaagacatgacatagtgtcacgcccggaaattcactagtaatttccgaacttatttgtgcataaaatcctcgtccaggaatcagccgaggtacacaaactgacaattttaatatacaaatccatcttaataataacgttacatacttaaaaagaaaagaaaacagcagcggaattaacggtctagcaatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatatagtctcatttgcaaaagcagcatttagcaaagatttaagataagtaaaacagtagagtagttaatcatcaattttaatcaacactaaacagcacacccatgctgcttaggcccaaccaaacctgaacaaccaaccccggtcgtacagatcaaacctccaaaccatgaattattcattccaaaccaggagtcaaattaattatcacattattaacatggatgagtagtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatactctttgcacaacacaactcaaaacagtgcaccgttcctggatcataatctccccctcaaaaccagaggcaaatggactccccagcgacccccacggacttctcgccgcttcacagtctggcacactataatgaaccatgctatacaaaaggtaaagccgttgcccatgctggcttgtggttggcacggtaaatgtttcacaacagtagctcgcgaaccggtccttaattaccatgagcacaaccatcaaaaccatatgctcacaacccaccttaaccaggttttaattatcatcgtgagctaccattaaatataaccataattaataagaataatataatataatttatatttaatcccctttaattagctaatgtttctaagcatggctaagcaaacatacatatagcatttagctgaaccaaaccaatatataaggttcatgctaatcaaattataacccataggaaaataagatcatcttcggccattaattaacggggaaaggctcaccacccgatgacattaaaaaataatgcatagttgaaataaaataatagctttaaacgggttcaacatgctcaaagggttatttgggatctgtgtgacttgccttgagcttccgcaaacacttccgaaccttgctcaacgaaaacgctctcctccggaacgtcggaaactaaagcgaaagaataaaaatcaacaaaacagtaaaaaacaagcataaacagtacatgtgaatatttttaacatgtagatcttgattttagaaaaatttagcaacttgaaccactcgaatcgaatctacagttatttagttatgattttcagaagatttaatctattagaaaaacgggaaaaagaaaaaccgatgatgtcatgatgacatcatcaatggcggccgaaccaagatgacgacctcgccggagatagagcgaccggctgcggatttggaggacatgaacacatagaggacgacgagatgaacccaacggtactcaccctcgaaccaaacgacgaacgacgacggccggcgacgagatgaacggcggcggcggctcggacctcgccggagatggagctccggtggccggcgacgaaaggggacgggcggtcgggctttccctcaccacggcgcacctaaacgcggcagcggcaagcggcgacgacgacggagacggctgcgctacctcgccggagatggccggcggcaaccggtgagctaggcggtggtggcggcgaggctacgggacacgggagaccacgggagagggggcaaacgaaagaggaggactaggggctcctatttatagccttggattgaagagatcggactcctcccgcaagaaatcgatccgggaaatcaaaaactcggttttggagataaactcaaaaacgagttcgattcggataagatactcaacgaaatgctcctattcttgaggggaaaggtagaggagaacgagaggataaaaacccctcaaacaatcggaagaaaaggggagagattggggaggaaacggcgcggcaaggcgactcggcaaggcggctcggctcagctacagccggcggctggagctggaagatgaacagtagcgcgggggaaggataatagacttcttgccgggcttttcttttctcagcctgattagaagagggagcaaaaccggactttggctgagagaagaagagaggatgaaggctcgggttgggccggcggaagagagaggaaggaaaggaaggaatgggccaaaaatggcccaagctgaggaggaggatttttatttactttttccaattaaattaatcaatgaaatgatctttgaattgttaaaaatacttccgatgctcaaataattccaagaaaaatcttgaaaatacttgcacactcaaagtacttaacaaaattataattagaccatttaatgattaatttaatatgtgggtaattactgaaatgctctttgtatgattaaaattaggaattgagctctgaaaaatccgagaatattccagagagtataattaaccatggagaatttaaaaaaaaaattaaatccatccatgctttatatttaggaaattttatttcccacatttaacttcacttgtaaattaatgaacatttaatataaattctaataataatttattaaataatttataaatcctgaaacaaaaatcaggatgtgacacatagtttccaacccatcctagccatagacaagggtaccgacccaaccccacctacggccggaacctccaggacaggtaggcaggactgagcccctagcagcaggacaccagccttgtgacatgacatttcgactaccgggccgcagctcgtgtagccttcatttgtcctagagatgtccatcgaccctcgacttcgtccatctccatccatgtacctttgtttataaccagactgagccacaaactaagccttacccactagacatgtggaagtacggtagtgctttgcaacagaggcccgaagaccggtccttatgtggccaaggtgctactatcaaaaccatgcaccctgagcccagcctaaaaccattttgagggttttgaatagagggggaggtgtgcgtccatttctacaataatccaaccattccataatgtccaagtgatatgagtattcccaaagtcgagagttataaaaccacctaatgttgcctaactaatcagcgaagcatctacctaaattcatactagtggaaccatgaatagagtacccactagttggggttttgtttattctagggtgaacaaggttataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggcctgctgaaccttcggcgacgaccgcgaaccacgcttcgagaacctccggaacgacagaagctacgcgaagcacacaagcaaagctaaaccctataaagaagtaataacaatacataaaaagaaagcacagggttctttaggttataacaaacattaggagacttgaacgggtcgattcagagttcgtatgaccaagatacgatcatccgaagtttaatgctgttatatggagatttgcggattattataattaagctttgcaactataaaacatgtggaagcactagcctggaaaagacaggaaggctgcgctgttgacatgcggaccccacatgtcaacctaaaggaccgcggtaggccgagtacatagacacggtccacgggttgacggaagcggaccccgtgtgtcaaccgaggcgagtggccgacaagcggactccactagacaccacgcgggctgcacacgtgaaaccacgcggctaccgagcgggcacactaacacggtcaccacacgcacaagcgaacgactaccgacaccggtacatgggtaccggggtcgacaaccacacaacgggtacggggcaacaccgaaaggatgaggacggggcagcgagaggagagatccttaccaccacgcgacgaggcgcggcacgacgacaacgaacgagcacggcggagtcggctcggggacgacggaggcgaacggcgagggaacgacttcggtggcgatccttggacgaagtcgagacgcggccggcacgaggcttcacgacgcggagccgaggacgaagacgatgatggggctgcagcggctcacttgacggaatgcggacgacgaacgcgaacggcttgacggagggacgaacgccacgacgatgaggacgacgagaggacgacgatgacgacgacgaccgggccggcgaggaggcgacgagggaagccggcagcggctgcacggagacgaggacggcgcggaatacgctgctgcgatgacgacgatggtggcggcgcagggagacgatgagccggcgaggaggaacggccgaccggaggaggggatggcgatgtcggacggagacgacgacgacgaacaccggcggtgttcgggtggaagggaggcgagcccgagggcgaccttaccgctgcgatgccggagaagacggcgacgtcggtcggcgtacgggcaaggcgaaaggggttgccgaaggaactccggcgaggcggagggcgagaccggcgcgggcgacggcattccggcgaaaccgagggcaggccggggttgatggcgacgtcaccgtgccgagggaggggacagcagcatcggccaacgctttaggtgtggcgaacggccgacgggaggcggtacagtggcggcgatgccactgattgccggcgggggcgcacctccggtgggtttccggcgaggatacggtgaggctggggaggaggatggcgtcgtagtgccggggaatgcggtggcgacatcagccgccgcacgggcgaggcggcataggcggctggagttggccggcggcgcgggacagagaggaggacggcggggagaggtggtgaggccacgggagaacgcgggagggggctaaaactggagaacggatcgaggggttccattttataggggaggagagggagccggccacgggagagacggggaacggcggcggaattcgtggtcggcggccatggaaggtgaccggggttggcgcgggcgttcccgacgattgggggcacgaatcaagggggaaattggggggaattgaacaggaaggaaaggggattaattccccctaatcaatttggaaagagccggctcgaatggggtggatttgcaggaggaacggcgctaggttttgcacgggagagagaagaggccgtgcgggaggaaggagatgaccgggtgttgggacccacgcggtcgcgcggtcagcgcgcgtgacgggcgcgtgcggcgcggcctggggaggctcggctgggccgggacacggcccaggtgggagggggagaggagggagctgggccgagggggaaggggaggcccaagagaaggagggagaggaggagagggagagaaagagggggaggaagagaggactttggcctcgggccgagagatagagagggaggactttgggccagacttggcccaaagtgaggagggggattatttttagctttttctttttaataaactttgttaactgtttttgttgcttaataatatttccggtgctctgaaaattcaagtaaaatttgagggctcattttagaccaaggagaatttaacaaaaattctccgggccacattcaaatttttcttttcttgtacgtattttagtgtttgccaatttcttttcgaattttaattaattctattattccttttagaaaatgatttttatttcgggatgaatttatctggacgtgacatgtatgattcaaatacctcattattcgcttgaccgcttgacgatgtgaagcacgaggagaagcttgaaagcgtgcacacaaacacacagcaaattgtatgtctggcctagaagcagttagatacaacaaagatccaatcatacttctatattccttttgatcaacagcttcaccatcttcatcaggatccaacacagctgtagaaccaattggtgttcaaattggcttgcaattctccatcttgaacagtctcaaaagatccttcgtatacttcgtttgatgcacaaaagtaccttgaggtgtttgcttaatttgcaatcccaaaaagtacgataactcaccaatcatgctcatctcaaattccctgcgcataatcttagcaaaatctacaaccaaagcgtgagtcgaacaaccaaagatgatatcatccacataaatctaaacaaaaagttgattatcaccatgcttaagaacaaaaagcgttttgtcaacctttcccattgtaaaaccttttgcaagcaaaaagttattaagcctatcataccatgccctaggagcttgtttcaaaccatacaaagctttagacaatttaaaaacatggttgggaaaatcaggattttcaaaacccggtggttgtttgacataaacttcctcctgtataaaaccatttagaaaagcacttttcacatccatttgatacaatttaaaaccttttgaagcagcaaaagccaacaaaagtctagttgcctcaattctagcaacaggagcaaaactttcatcaaaatccaaaccctcaactttagtaaaaccttgagcaacaagtctagctttgtttctcacaatcaaaccatcttcattttgtttatttttgaaaacccacttggttccaataatattatgtccagaaggtggttcaactaaagtccaaactttgtttctctcaaaattttcaagttcttcatgcatggcgttaatccacgattcatcagttaatgcatcacatctttgggttcaaaagaagcaacaaatgcagaatttgcacaaacatcatgagtcgttaccttagaccttgtagtccgctcacctatattaccaataatttgttccggcggatgtcgtcgttgaatgtgcaaaggagcagtaacttctgaagttgatccacgttctgtatcagtattggtcgaagtagtaatttctggaggaccatctcgagcagcatcaacagaaccctcagccgacgacccaggccggtctgaccacacgtcatgcgtcggtctgaccggaggtgtgccagcggtctgactggcctggcgccctgtctgaccggccgagccgacctcgtcgttgtcgtcatagtcgctctcgtcttcaaaaatacgaccatcctccccctgaacctgtgacagtgtacctgcaatatcgggtctagtacctggactagcctcatcaaaagaaacttcgcaagtctccacgattttgttagtccccaaaataagtacacgatagccacgagtatgtgcggggtaaccaagaaacaatccgtcggtagagcgttcctcaaacttatccaactttccagattttaagacaaaacatttgcaaccaaaaacacgcaaatgtgaaacttcgggttgatgaccaaatcgaagtgtcgaaacatgaattcggcaaacggggtagcgcacaagacctaaaagtggatggatgcagagacagaggatttagacaggttcaggccctctcgatgagaggtaataccctactcctgtttagggatttgaatccgccggatgtattatagatctgatgatctagttgtctcatgccccctagagggcctcctgcccaccttatataggatgggggggcaggattataagatagaaaccttaaccaatacgatatcggtttcctaaatctattttacaatattatcaaatcaggactttaggccgctccataatataaaaggaaacgtaatacccaagtcataatctgttacatattccatagatataagctatcccctatgactagtcggataaccatgccgtgtgggtatggggtacccataatctccatagtagcccctgagaccttcacagtcgaaaagaaaatcttctctcgaactagattactccaaagccgagtgcttcaatcatcttcgccatgatctcccgagtactttttccaaatcagaagactgtggagggctgaaaaaagtaaagtcaggtgcatcaaatagatgcacctaataggtgtagcccccgactatgtgattagctgaacaaactaaacatatagtcaaggaataaattatccaattaaccgaatggtttttgataattatagtcaaccaagtgacttgatactaatatatagcatatgcggtgtgaatccccaaataatacgatccaagtgatataccgactgcttgaaaaatatgatgcgtacaacctaaggttgacaacatctctgaaaattcacatagcaaaacaactataaagaagcttgaatgctgtgaataatgaaatttccaaagtattgggcatacgccatgcgcacactgctttaacagatgtgcttaagtccctaaaagacacatggtttcaccacacctggaaatatatggcatatgtggtataacatccgagtaagtaaactcataaaggatttaccaaccgcctaaaaaatgaccataatatataatcagcctaaaccataatattggtcaataaaagtgcacacttatgtggcaaaaagcaatgatattgtatccaatcaattgcttgataatcccaaacaacaccttgactatataaaaaaatcagcagggcagctatataaagctttactgtttgacaccttttaagatgcattgtaccaactcctaaaaagttgagtaactgcggtataaaaggattttaaggtattgggcacttgatcacacgcactttggcctaagcaaaaaatgcctaagtccctaaaagaacatgacaggccacacctgaaaatatgggctgtagacatattaggcctaggccaaaaaatatgccttcgacaccctttaaaggatgacgcatgtaacatgctcccgagtaataaaccttccgggtaatatagaccaagtgtagctcatatgaatagcttatgatctgagtgattatcccttatggatactccaaaatacatataataattgaatcctgactgacgcaagtattcggttgataacctttacggggaataataaatagtctagtctttgagcatagaaaatagaaccatgatcatgaattcatgttgcatgtatccggaacaagtccaaattgaaggtatgatacttgtgtttgatctagtaagctcctgagcatatagcttgtccttctgtcatagtcacaattgttcattgatggtagctgacacaagtggcatatagacaagatgaccaatttggagaatatatttgtcacctgaagtggcaaaaatattggttgtagtgagaatagtgatcncattcaaaggtatggagtgcttagccttgagggaaaaaaaccttcgtngcggccgatcacttacaatgagattaagggcccacgttaagtgggtgccacggaggaaaatatattggggacgacaggcggtcaaagggttccaattccccacctgaaagaaaaaatattcgcccaaaccaccccccctatacaatggtgcaaaagagaaaaa

SEQ ID NO: 22010 - DNA, 3671 bp, Oryza sativa
  unsure (1)..(3671): unsure at all n locations
ttatttnnattagcgctctcgtgtgatggatgaataggctatgttgaagaggcttgacaggatattgatgaagatgacgatgtcggtgatccagtcaatagcaatgtagcaaccaatgataatgacgaagacgctcatcagcgtttttataataggtcaaccgtgaaggcgaaataacaagccggcaatgacggaagcaactggaggcgaagacgtagtcatccattagcaacggcagagatgtcagggccgatgaagtagaggtgctgatgatgaagtcagtgataataatccatcaaactgttgagaagatataaagctcgagtagtttccttgatgcgagcgtgtatgcataaagaagactgatgcaacgcttcttgatttatgaagatggcaataaaatttaatgttgtagctgttggagatgcttcacttgaaggaaagtagatgatgttgtccaacttgtcgaaactaagttgattggttgatgactccaaactcccagacatgtaaatttaatcttgacctactgctctaaagcgaagacaaaattgatgactcccagagttgactcgttggctgattaattgattaattcatcttgacataaagcttgtcgaattttgagccatgtatttgtgtagcccccgactctttgattagttgggaaacaactgaacatagagtcgagaactttagcttcttgtcgtcgaatagtcattgcttgattgaagatggaaaatgctacacatacgatctttttagtacgatcttgttacgataagacgcaacggcacggacggcaacggcaaaacagcacgcacggcgcgcgcggcagtctaagcgtacttatgggccctaaagcccaatttacctctaaacctgactttacgttcactacaccaaaccctaaatctgactttcatgttctgatctaacctgcaagtgtgaaactaatccaatagcatacgcatcgaagacaaaggtatggcatcttatttacttgattttctttagcttcacaatcatctttttttttttacattattctctctttcttttttttcctaggcaatgttcatggccatgaaatgctttctttattattatggatttaatctaaaattttcctttgcaaaacatatgccattatttttaatttaatctgaaactagggttaatgttatcactgtccaaggttcgaggaacatatttgtatgcgtaatttgcttaaccatgccacatgataaattcaatgttgggtgctaagtacaattcttatatacagtaagatattaggaagaggattgcttaagatatgattgaaataaaaattgcttgggttggctcattggctgtccaagcaagccaaccagatagcaggccaggacgtcaggagcttgggcttggatatgggatcaactaaggcctgagggatccgtttgatcgtacaaccatcgtacgaaataattcgtacgtatagcagcgctgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagtagcagcaatagagtttgccggtgccgaagataataaagatgaagttgctccaccatgatgacaaagttggatagccgtgatgaagtgaacacgagtcagcagcaacagaagcaaacagcgatgacgatgatgccagtcaatgatgacgaagtcgcgcagccgtggaggtgaacgagccagtcggcgtcagacaaggcggccagcaatgaaaacgatgacgtccatcagtagtggtagcagtataaaccagcagtcggcagcagacgtagacagcttgcgttgaaggtgatgacgcctatttgcagtggcggagacgtggccagtcgtgaagacgatagcaccagttggcgtcatacgaggtggccggtcgaagaagatgtagatgtcctacaacggcggcataataaaccagccctgcaggcggagacaccagtcggcggcagcgaaggcaagccggtcggtgaaagcgtagacgcccaacaaacggcggcataataggccagccgtgcaggcagagacaccagtcggcggcggcgaaggcaatccggtcggtgaagacgtagacgcccaacaaacggcggcataataggccggccatgcaggcaggaataccagtcggcggcggcgaaggcaagccggtcggtgaagatgtagacgcccaacaacggtggtgtgaccacttaaccgtataggcgaggacaccagtcggtggcgacgacggcaagccggtggtgatgttctaactaatccattcctgaagcgtaggagataagcttaaagccatgaatcccttctatgcatatctggatctggatcctacagaacaaacatatcggatgagtagtatctgatataaatataatactcgagaaaaattcaagtatttaaaatatttacaaatatgtatttctcctcttgtcaattttgatttccccgagcggatgactccttacgtttaaatactctgcccgactagtcatagtccccaagcatcgggagtcggccaaagcacttcccagacatgcatatgagtgacatgagttcgtcattaatggaacaaagtttcacagatcggagtttactactcgggtacttttgcaattgtaaagagcagaaaataaatttatcttatctttatgcttttgatttattccgaataatacttagcaccttgcgttactcggtccatccaacgagcccccgggtgctaggaatcggcccaaaggcaactatccatcgacaaaccaaacggagaacataggaagataaaactccataactcgataggcacatttgtactcagattatatcgcaagcaatcaagataaatattatgaaaattgttgaaaatatgatataacatctgtagcccccgactcactagtcaacggtgaaccagttaatgtagtgaggcagaggaaaaggaaaatatcatataagaaaaaatgatgagttagctttttagtattcccttggtgatggcagaagtagccgatgtgggatcgaagtagtccatcaatggtgacaaaaacaccagttggcgccagtggaaccaagccggtggtgtcgatgatgaggcccattaacagcggcggagtccggcaaccgtataggcgaaaacaccagtcggcggcggcgaaggcaagcccggtcgtgaagaggtagacgcccaacaacgggggcataataagccagccgtgcaggcggaaacaccagtccgcggcggacgaggcggccggtcggtggaaaggtagacgcccaacaacggcggcataataggccagccgtgcaggcggaaacaccagtcggcggcgaacgaggcggccggtcgatgacgaggtagacgcccaacaacgacggcataataggccagccgtgcaggcggaaacaccagtcagcggcggacgaggcggccggtcgatgaaaaggtagaagcccttcaacgccggcactaataggccagttgtgcagncgnaaacaccagtcnnannnnnnnaggggnntgcgagntgacntaaggttcatggacatggg

SEQ ID NO: 22011 - DNA, 5995 bp, Oryza sativa
  unsure (1)..(5995): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgatgggcaaatagnccagccatgcagcggnaaacaccagtcgccgncgaacgagcgncccagtcggtgaaanacgtagacgccacaacgnncagcataataggccagccatgcaggcgaaaacaccactcggcaagagtagtgccgcggcgttacatgcaacagccagaaaatacccagagattaatttgatatttagagatcaatctaatgaaaaaacaaataagtcgtaaggggaaaaaacccagcgaagtcgaagattaaattgttgaactcggcaaagattattggtcttcctggatgcgtgcatgtcatgggatccatcctcctgccatgcgtgtgtacagatcgcggacccgagtctggatcaaatcccagtcggaggcttcgcgcgtggtcttaactcagaaaagtccgataccacaacgcaatacgacagctccgataacacatgcatgtaaacaaatcaatctgattagcagagaaattaatgcatatatgtagttggttatgagagcaagtaagcaagttaatttatttgctccctccatgcatggcctgcatgctcctgtgtgcacgttggtcgtccatgcaaggttctagtcggtggcatgtcaactgaatcagcacatgcgtgtgtttgctcctgatgcccgggctttcctctgcccaactaatggcagggccatccgcgtgggaggaaggggaaaagctctcggcaacggttaggcaggagtggatgacgatgataatgaacacgtcttgatctcaaccagcatgtgaaaaacaaccaaacaccaggaagtcaaacaacgattaaaagttaatctaataaaaattagattggaacgataaacctgattgaagatttgagccgtcgaaatcgatgagatcgatctcggggtttcttctgaagttgattccatcgcacttttcgataggtaattcgacgcaacccctacttggcgcgccaactgtcgaaacatgaattcggcaataataaaacggggtagcgcacgagacctaaaagtggatggatgcagagacagaggatttagacaggttcaggccctctcgatgagaggtaataccctactcctgtttggggatttgaatccgccgggtgtattatagatctgacgatctagttgtctcatgccccctagagggcctcctgcccaccttatattggatggggggcaggattacaagatagaaaccttaactaatacgatatcggtttcctaaatctattttacaatattatcaaatcaggactttaggccgctccataatataaaaggaaacgtaatactcaagtcataatctgttacatatttcatagatataagctatcccctatgactagtcggataaccatgccgtgtgggtatggggtacccataatctccacacgaagttcataagaagtttttccaagtttagattgcaagaaaactcgatttgaaatataacatgcagtgttaatcgcctcatgccaaaattttgtaggagttttgtattcatccaacatcgttctagccatctcaaccaaaacacgatttttcctttcaacaacaccattttgttgaggaacacgaggagaagaaaattcatgttcaagacctctttcgctgcaaaattgttcaaatgaagcatttttaaactctccaccattatcacttcgaattcttttcaaagaaccagaaaattcaagctccaatcgaagaaacaaaccacgaaagtgttgaaaagcttcgtccttagttgccataaagaaaacccaagaatatcgagaaaaatcgtcaacaataaccaacacataccactttcctcgaacagattgcactctagctggaccaacagtgtccatatgtaaaagctgtcccggtgcatccgtcatcacagaaacaataggagcatgtgaagtagaaaccatcttagcatgacgacacggggtacaaaccaaatcacgatctttcttaagtttaagcaaaccacgaataagatccaaaccacttagcctagtgagatgatcaaaaccaacatgtccaagtctacgatgccaaaacatcacatctttatcaaacttagcaaccaaacatgttatcacaggtgaaacaggattttcaaaatctgctttaaacactcttccatatcgagaaatattcagcacagaatcaccatgagaatcaaaaactttactttcagttttcttaaagtgaacctcaaactctttatcaacaatttgcgaaaccgaaagcaaattggactttaaatcctcaaccaaagctacattcttcaattcaaaattttcatttacctttaccaaacctgtagtgagaacggcacttgtagaagcatcaccaaagataattgattcagtattagatgccttctttagggaggagaaccaatttttatcaccggtcatgtgccgcgaacaaccggaatccacgatccacacgttctccttccttgccaccaaagcctacacacaaacagaagtcgaagcttcagtactggggttagataataataaaaatttagtaatccagtactgagacacacgaccagaagaagtcgaaagcttcagtactgggttagataataataaaaatttagtaatccagtactgagacacacgaccagaagatccaataggcatatatccacgtgcaaaatcaattttagaattttcagaaaaattcctccgaggccggtctgaccgagggtgtgcagccggtctgaccgggtgtcacgaccggaattaacccaacgggcgttccttacgtgcgtgtattattccttgtcccaggaggcaaggtacaccaaaagttgatacatttcagagtttaacaagcggaagcgtaaatagttaatttattacatgggcggcgaaggcccagcacacatgaagacaaacgaaaaacagcggaagactagggcgacgaccacatgcgcttgatggcaggcacgagctagacaccaaagccttcatcatccaggaacacctcttctgggtttgggaaaaattgagcaagactgagtacaaccaccgtactcaacaagacacacccacgagtgcagaataaatgcaaaggagtacaagggagttataatataggggattagggtttgcagtaaacagcattaaaagtcactttgttgctcaaagctactttgtaaacacgatcctagagctatacaatattattaatcaaggccatggacccacacgaacctgccttaacccaaggcctacgatgattcagaccgaactggcaacccgaccctgggtcccagctcgtcccaagccaacccacgccaaccattccacattttagttgttaagcaggctttaagaatttaaaacactaacttgggtacattgctaggcttgcccataaccgagggcacggctattcgaataggttatactctgatcagaggtgtacatctttacccacaagacacgtcttcctcacgtgtaaccacgtgccacataccaccacggcatatggacggaagacatgacatagtttccaacccatcctagccatagacaagggtaccgacccaaccccacctacggccggaacctccaggacaggtaggcaggattgagccgctagcagcaggacaccagccctatactatgacatcttgactaccgggacgcaactcgtgtagacttcatttgtcctagagatgtccatcggccctcgacttcgtccgtctccatccgtgtacctttgtttataaccagaccgagccacaaactaagcctaacccactagacatgtggaagtacggtagtgctttgcaatagaggcccgaagaccggtccttatgtggccgaggtgctactatcaaaaccatgcaccccgagcccagcctaaaaccattttgagggttttgaatagagtgggaggtgtgtgtgtccaattccacaataatccaaccattccatagtgtccaagtgatatgaatattcccaaagtctagagttataaaaccacctaatgtcgcctaattaaacagcgaagcatctacctaaattcatactagtggaaccatgaatagagtagccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgttcaaggatgatgtgacttaccttgctcgctttcccaaacgtcggcttcaacctccacgaagagcggatcttccgaagctgcagcgtctacacgaccaacaaaaaggaaaaaggcttttactctaataaactccatataacaagcaggaacaaagcacaaaaatgggttcttgacttctaaagaaaaaattagagacttgaacggtccaattccgagttcaaatggccaagttatggccatttgaagtttatatgctctttaagtgaatatttgcgaatttcttcatttaaattttaatttaaaaaggatttattgcgttaaccaggggagatggcgcgcggaccgggtccatgggagtggggcccacgcggcagcctcacggtccacggtggaccggacacacccgggctcacaccgaccggcgccgtgggccccacgcgtcagctgcacccgagggcacgggcggctgacggccgggccccacccggcggccacacggcgcgcccggaggcggccacgtcagcgtggccggcgggaggtgtcacgaccggaaataacccaacgggcgttccttacgtgcgtgcattaatccttgtcccaggaggcaaggtacaccaaaagttgatacaccaaaagttttatctagccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaatagaggcccgaagaccggtccttatatggccgaggtgctactatcaaaaccacgcaccccgagcccagcctaaaaccattttggggattttgaatagaaggagcggtgtgaagccaattccacaataaccaaaccattccaaagtgtccaggtgatatgaatattcccaaagtctagagttgaaaaaccacctagtgttacctaattaaaatagcgaagcatctacctaaaatcatgctagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgtaataatttaaagcaacataattttataaactggaattcaatatgctcaaagatgatgtgacttgccttgttcgctttcccaaacgtcggcttcaaaatccacgaagaagccatctcccaagcggccaatcaatggtcaaatcatggccagta

SEQ ID NO: 22012 - DNA, 3238 bp, Oryza sativa
  unsure (1)..(3238): unsure at all n locations
cccctgatgacactcgcttgtgccatggatgaaaaaaggactttttagggtttttctttttgtaaaacctttttaactttgtttatttcttaataattattatttgtgctctgaaaattccactaaaatttatttacgcattttaggcttttaggaaatatacaaaaatcctccaagccttattcgacttttaactttgcacattttaattgttggaggctttcacacggattttaattattctaggcataatttcgaggatgtattttagagtcgttttgggacgcgacaggaggcggcgttcccgcgcccctatggtcgccggcgacggccataggcacggtggagcggcggccaagagaggggaatggaagggggaaaagaggcggcggtccacggctcaccccgggtcgacggcaacggcaaaggaggcggccggagtggagggagacggtggcgcggctcgggtggacgggaacggcggcgttccggcggtcggcgaggtcggcgagatggtggacggggtcggcggcggtgcggcaaagccggaggagacgacgccgaggcgggagatggtcctggcgagtggagagggccggctggaggtcgacggcgacggcggagagagaggatgacggcgcgagctcgattccggcggggagaaagggcggcgagtggcggaaacgggcgagggaggtgcggagagggtttaaatagggttgcgagtgagagggggcggccggcggggaaggaaaccggcgcgcgggatccggccgccattaatggcgctggcgagattaggggaggggtttccatccgaattagagagagagcgaggggaaaatggagggaaagggagaggggatcacggggaatatttcctcccacttaattgcacacgggaacgatcgggggcggtgggattcgcagcggtgncggtgctaggcgcgggcggggcggcaggagcggcgggaggaaggggatgacgggtgggccccacccatcagcgagggtggctggcgggcccgcccgtcagcggcgcgtgcgcggggagaggccgagtgggccgcggggagaggagagagagggggagggagatgggccgaattcggcccagagagagggaaggaggtttttagggtttttctttttataaaactttttcaactttgtttatttcttaataattattatttgtgctctgaaaattccactaaaatttatttacacattttaggcttttaggaaatatacaaaaatccttcaagccttatttgacttttaacttcgcacattttaatttttggaggctttcacaaggattttaattattctagacataatttaaagggtatattttaaggtcgttttgggacgtgacaccgggggccggtctgaccgaggcttcaccgccggtctgaccggtggtcgatctgaccgaggctgttcagccggtccgaccggtcgccgatctgaccgcgggacccactgcggtctgaccggtttcctcgagggaaaaccagatttttgccactttgattttgcaaaagcaatctctctctcctttttctgtttatgagctaatctgaaacaaaaatcaacaatatgtccatctttaccacaaaaagaacaagtatatttttcacgttgtttagacacattgttagcattagaagatttagcaacacaagcagcaacaggaggttttgcatgcacaacattggattttgaagaagatgcattcatggtagacatgataccagcagatttaaacacaattttattagtatcatgtttaatcaaaatctcaccacttctagcaccaacacctaacacaacaggaggatgtctagaattatgagcataaggatcaaaacctaaaccaaggttatgtgtgctaaccttagattgatccaaaatcatgttgaggttctttttaccatcacaaaatctttgcaaagaatttttccaaataagaaacctatttttccaaattagcacaattttcacaatctaccatgacacctttgcttctacgacatttggggcaagaaaaccacttcattgtttttcacaacatcttctatgtactcaacacgacctaaagcatcttttagtttcatcttattcaaattacatgctgagcaatccaaaacatcatgaggttgtttcaactttttagcagaaatcatgttaaacatcaaactagcatgaaaagcaatttgatatttttgcaacaactttttagttaaaatcaactcatccaatgtgcgtgtacgcaaggcaaaactcaagcaagagaagatctatttttcaaatcatgtgcagcattaatatctctaatttttgaaatctcattcattaaaacctcacaatttgagcaatcatcatcattacgaataagagattttaatctagcaacttcagatttaacagattcaatgataaattcctgttttctatatatcttctcacacttcttatttttttcactcaaaatattaatagcttcctcaaacgcacttacctcattatcttcaaactctatgtcagattcaccacgcgccatgaagcaaacatcggagatgttcttcctcttatcatcatctccactttcaccatctacatcacttagtggctcgaaagcagcacaaacttgttgaaaagccttctgagattcttcatcttcttcccttgngatgaactcttcgaccttgttgtgtagggcttgggtgtgcttgtcttctcaccatctcttgcttctctttttgctcttcccaagcttangacaatgcgaacgaagatgatcaattgaccacatttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacccgtatccgctgttttggagtacaaatggaatattgccacccggccaccgagtgatccccttgccaagacctttgtgcaaataagtttcgggaacttaccgngggcatatgggatgaagcctggcatgaaacaacctttgccacgtgccgtttcgttn

SEQ ID NO: 22013 - DNA, 1927 bp, Oryza sativa
  unsure (1)..(1927): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggggtcctatttatagccttggattgaagagatcggactcctcccgcaagaaatcggctcgggaaaaacaaaactcggttttggagataaactcgaaaacgagttcgattcggacaagatactcaacgaatagctccgattcttgaggggaaagatagaggaggatgtggggataaaaacccctcaactaatcggactcgagggcgaccggaagaggcgaaattggcggagagaggcggcagctcgggctcggctaggcggccggccggctggaggttagggatgaccccgacatgtgggccccacatgtcggtggctagagaaggagggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggacttaanaaccagcgtttcccccggaagctctttggcctttttgtcccaacttgccttaccgaaacctgtcccttttttctttggaaagcgggggttttcaaaactacacgtgggtattcaatcgggtaggcgttcctcaaactgtgtttggcaccaacccccttaan

SEQ ID NO: 22014 - DNA, 1807 bp, Oryza sativa
  unsure (1)..(1807): unsure at all n locations
aaaaagggtggagaccccccgcccttcccttaaaaaccccctgtgttacgcgaggtgctttatacataaagaaggcccactaagccctccccagtgtttcttaatttccttgggaagccaaaaaaccaaggggtccaagtagccacaaaggtcacaaaacccagtggggacagggaccaagcgggtgtttaataatggggccatttcaggggggagtcggcaccgtatagcgaaaacacagttggggcggggaagcaaccggttggtaaaagttaacccccaccacgccggcataatagccaacctgcagcggaaccacagtcgcggcggacaaggggcccggtcgttaaaaagtancggccaacaacgcgggcataatgggcaacccgtgaagcggaaacaccagtcggcggcggacgagcgggcggtcgatgacaggtagacgcccaacacggcggcataataggccagccgtgcaggcggaaacaccagtcagcgcgggacgaggcggccggtcgatgactaggtagacgcccaacaacggcggcataataggccagttgtgcaggcggaaacaccagtcggcggcggacgagacggccggtcggtgaagaggtagacgcccaacaatggtgccaaataggccagccgtgcaggcggaaacactagtcggcggcggacgaggcggccggtcggtgaagacgtagacgcccaacaacgatggcaaataggccagccatgcaggcggaaacaccagtcggcggcggacgaggcggccagtcggtgaagacgtagacgccaacaacggcagcataataggccagccatgcaggcgaaaacaccactcggcaagagtagtgccgcggcgttacatgcaaacagcagaaaatacccagagattaatttgatatttagagatcaatctaatgaaaaaaacaataagtcgtaagggaaaaaaacccagcgaagtcggagattaaattgttgaactcggcaagattattggtcttcctggatgcgtgcatgtcattggatccatcctcctgccatgcgtgtgtacagatcgcggacccgagtctggatcaaatcccagtcggaggcttcgcgcgtggtcttaactcagaaaagtccgataccacaacgcaatacgacagctccgataacacatgcatgtaaacaaatcaatctgattagcagagaaattaatgcatatatgtagttggttatgagagcaagtaagcaagttaatttatttgctcccctccatgcatggcctgcatgctcctgtgtgcacctttggtcgtcccatgcaggttctagtccgtggcatgtcaactgaatcagcacatgcgtgtgtttgctcctgatgcccggctttcctctgcccacctaaggcacgggcactccgcgtgggaagaaagggaaaagctcttcggcaccggtacgcccgagtggatgaccatgataatgaacacccctttgtctcaaccgcctgggaaaacacaccaacccctgcagtcaaacacgcttaaaagttatctaataaaaaatannnnnnnnnnnnnnnnnnnnnnnnnnnnnnnnnnnnnntgtatcccagtcgcgaccaccttgaggataagtgagtatttcatacgcaccctaatagcttggcgaaatatgggatagcttgtcctgcgggaatggtattcgctacacatccccacatacaacgcgaacttaaagaaaacccggtgcctaggagagctatcacatatgcgtggctcacggccctttcaacggaaactgtcgcccctcttaagaaccg

SEQ ID NO: 22015 - DNA, 1786 bp, Oryza sativa
  unsure (1)..(1786): unsure at all n locations
aaaaaaaaaaaaagcggccaaaggcgtgcaagttaaggtcccttgggaaacacacaccccggtgtaataccctatagaggaggtcattcccataaggccggattttaattccccaacacacggttaagggcgttttaatcaatttcgcggtggtgagataaaccctttcttccccaatacggaaacgggcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctatagaaattcaggggattccttttccctcggatctgattcttctagacaccaagaacttggatgtgatccttaggatgaattggttggctcaattccaaggagtagtggattgcgcgagacgcactgtcactctgtaccgagggccggaacaaccggttgttttctttgcacccccaacctctgtcagtagttcagaacttcatcagataggactgtcagaaatccccatcgtcagagagttcggagacgtgtttccggaagaactacccggtatgccgcccaagcgagagattgagttccggatagatcttgctccaggaaccactcctttgtacaagcgaccctaccgtatggcagcaaatgaactggccgaagtcaagaaacagttggaagagttgaaataaaaggggtatatacgttcgagtagttccccctggggtgctcctgtgatttttgtggagaagaaagacaagatgaagaggatgtgcgttgactacagagctctcaatgaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactacaatttgtccacaaggccccctcaagggtcgcgcaacctcaacaaggccgcgttggtgggacttcttcctatactctcggcctctctcagcgacttaccaaatatagcacgccttacatctgaggatggcggaacaccccaccagcgcctaatatatataccaaggcctctctctctcctgaactctctcct

SEQ ID NO: 22016 - DNA, 22743 bp, Oryza sativa
  unsure (1)..(22743): unsure at all n locations
gagatagccctcgtgtgtgatggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgtacatgtatgcttggtgacatttctagtctaatgttgggaatgaaaagattttattctgttctcaaattataatcatgcaatggtttaagttggtcatcacctaaattaaaacggaaattttttgctctcaaaattggagaagttaacctctaactattttgacaagaaattttaagtcctaaaatttcaggtacgttataggcaattacctttgggaaggtaattgagatgcggcatgtggagacataagcgccatattgccatgataatgatgacatgatttgtgaaattaggaaaggaactaaacacttgttttagaccggggcggacggtagatttgggtggtatccgggaaaggctagtatcgtccccggtcaattaaggaccgagccatgaagttaagcatgaaacgaccccgtacaatcacacttctcgaatggggatagacctagcggagtaaatagccgagcggaggcagtatccatgcatagtggtttctcgatgtgtaaggcaggggctctacaatggtgtcgccattgttaggactgccatgtgatgagttgaacataattataacttaatacatgtgtgtgaattttccctccccgggtgcgctagaactcctctcactgctagaaactgtgtacgcctagagcgcatgaggatgaaaagttcatggagcgggtactgccaatgcgaggttatcgaaaagctttgccgtgacgcgtctcatgtgttgagacaaggctcatgtgttgggcagtcgcagagtgtgggtaaagtgtacatccactgcagtgtgagtaaaccaaatctattcgaatagccgtgcttgcggttattgagcatcgggacatgtattacacttggctagactttaaattcttaacttgtgtgggatgggttattgcatgatgaatttttatggtggacgtcctcagaaaaccatgacgactcaatggcgggaagctatccttgggatcacaatggatggtggacagaaccgtcgttgtttaaatacaaacactggtactaaaatttgatcagtcaatgctaggtcttaggcttgtgaaaagaattacaaaatttgctttgcgcaaaagaaccatagccatcctttgaaatacccctatcatatgcattgttgatgtggtggcttgctgagtacggttggtactcacccttgcaaatataaacttaatcagaggcgggacttgaagcttcggaggatccctatgcctattaccaggagggtgatgaagacgatggcgctcagtaggacttagtacggtcgttgcctgtggcattggcgtgccgctgtcttatttccgctgctttatctatttctgcttttgggatgtattccggaccgcccggtccgatgatttaagataatgcctgcgggcttatgttgtaataattcgcactagactctcgtgtatgtgcatttggtatttcagctatgaactcgtgtgtaccagactacttgatccagggaaatggtactgtttacacgattgattcctgttataaaaatgggggtccacatcactggagttggagctgttgcaacgcgggctataggaatgcttcgggatgcatggatgacaattcgctgaggagcaagcttctgattgtggggagttgcgtggactgacgtgctggtagctatgtttctcggttttgggcacttgtcagtgaaatgacacatttcttgacaattgaagcaacagatatctttccggactcagtattttcttttctcattttgattcctctgtcctggcactggagttaggctgaaactgtaatcttggcgaggattggtgttgccttgatgcttctctccattagaacgggcatgttggttggccatcttcttcgtcagcagaaaactgagttgacaatcttttggtacatgatcagttccttcacacaagaaacaagtgatcctgctcatggggcactcgccgggtggatggtcttccttacaatgaaagcaggtagtggcacatgagctggcaacatgaccgatttctccacaatgagagcatgccttatgttccattttattctggttgaacccttggggagacttctcatcttcatcatctgaggagacttgatctgaatcttcactatcagacactctacctccattagctaaaagatgctctgtcaactatggtgcacctcggaaggaatttcttctctgacgttttgtcattcctggtggaggccattctgtactggtaatgatcatcttacggacttcatcttcggttcgcattggtgcttttcttttctgctgaggacagttccttgcatagtgcccttgttcatcacacataaaaccaatgatacttgcttcttttgagtcaacatgtgacatggcatgaggggccttctgggatgttggcggtgcgctgacttgtggtgtgagtgcttggattgcctccaactgcgcctgaggttgcatctgactcgggttcagaattggcatccgatgctgctgtagtatctctataagcaatttgttctggttaatcaagtgttggaccactgccacacaattggtgtctggtgcttcattcactcgggagcttgaggtacccatttcctgacttctgaccttattgcctttctcattatccgccatctgttgcaggttttggagagggagagaggaaaaacaaaggggagagacagatcagaaactaaggataggaccttaacagagctacactttttctgttgtgatgtatgttaggcttattctgcaagttgattacgcaaacaacctagcatggttacatcacaccccactgatgcaaaccacgcgctacacacaagagcaaggaaacacacgactaacgaaaccctagaggtggcttaggttctgcgacgggttctccaagatcttcactcctgcttcacatctggcttcactgcttccctcgcttcgctagcagatccaacagtcttgcggagcttcggcagacaattgacgacatcttcttcttcgcaaagctgaccacctagtactagttgaaattcgaaggaggaagaagggagtaaaccttttgcaaatagcattaggcaaaggagaaaaaaaaggaactttcgcaaatagttttatttataaaatatgtccttaggttttatccacttggcttaacctacagtcaaccaggctctgataccagcttgtcgcgcccggaaaaatacctttttccagaacgctagtgtattaatccccgtcccaggaaaagccggggtacaccacacaaacatgatataaaagacacatctttattatatcgctaatatttacattattacaaaggcacttcaggcctgacaatcaaaaataaatagcagcggactagcgggcctacggctccatcttcacaggcgctcaactgaggtataagctaggactccacaaaagacttctcccaagcttctcttactgaagggggaaagatagagcaagaatgagtacaaccacagtactcagcaagtcacaccggtagatgcatgattaatgcaagagggtacaaggggtaataataatagggttgggtcttgcagtaaagagcgtttaaaagacacttagttgctcaaagctattttgtaaacatgatcctagagctacacaatattattaatcaaggccgtgaaccctcacgaacctgccttaacccaaggcctacgatgattcggaccgaactggcaacccgacctgggtcccagctcgtcccaagccaacccaggccaaccattccatattttagttgttaagcaaattttaagaattaaaccactaacttgggtacattgctaggcttgcccatatccgagggcacggctatgtgaatagattacactctgatcagaggtgcacatctttacccacaagacacgcctttactctgcattccattgcaattggaacccatcataaaaaacgtgacataaccctttacccatcctagccgtgaacaaaagtaccgatccaaccctgcctacggccggtatcccgggacaggcaggccaggattgagcccctagcaataggatctagaccgggtgcgccacacgcataggggtgagaccacccgtgtactagtccagtgccatggcatctcgactagcgggcaccgacccgtgtagccttcatttgcctagacatctcgattaccgagccacagctcgcgtagccttcatttgcctcagagatatccatcgtcgcaacgacttcatccatctctatccgtgtccttttgttcaggactagactgagcaccgagttaagccttacccattagacatacggttagtacggtagtgctttgcaacagaggcccgagcttaatccttatattggccggggtgctacttcccacaactggcatgcacccaaaccccaccggaaaacaggttttaggggttttgaaagaggaagagacgggtatgtccaattccaccataagccaaccatttcatagtatccaagtgatatgagaattcccaaagtctaaagttataaaaccacctaatattgcctaattaatcagcgaagcatctacctaaattcatactagtggaactataaatagagtacccactagttgggttttatttgcctagggtacgcaaggtgataataacaattgcaataataaggctataacaaggattaataggtaatgctaaataaaacagtggtaacacggaaatttgaataaagtagtaatgcaataattcaaatcaaaataattttataaactaggattcaatgtgctcaaggatgatgcgacttgccttgctcagagagaacggccttccgaaccttcggcgacgaccgtgaaccacgcttcgggaacctccggaacgacaggagctacgcgaagcacacaagcagagctaaaccctataaagaagcaataacaatacataaaaagaaagcacagggttctttaggttataacaaacattaggagacttgaacgggtcaattcagagttcgtatgaccaatgtatggtcatccgaagtttaatgctgttatatggagatttgcggattattataattaggttttgcaactacaaaacatgtgtaagcgctagcctagaaaagacaggaaggctgcgccgttgacatgcagactccacatgtcaacctaaaggaccacggtagaccgagtacacagagacggtccacgggtcgacggaagcggaccccgtgtgccaaccgaggcgagtggccgacaagcagactccactagacaccacgcgggctgcacacatggaaacaacgcggctaccgagcggctcactaacacgatcaccacacgcacacacgaacgactacctacaccggtacaagggtaccggggtcgacaaacgcacgacgggtacggggcgacaccgaaaggacgaggacgggagcagcgagaagggggaccttaccaccacgcgacgaggcgtgggaacgacaacgacgaacgagcgcggcggagacggctcggggacgacggaggcaaacggcgagggaatgacttcggcggtgatccttgcacgaaggcgagacgtggccggcgcaacgcttgacgacgcggaggcgaggacgaagacgacgacggggctgcggcacttgacggagcgaggacgacaaacgagaacggcttgacggagggacgaacgccacgacgaccgggaacgacgagaggacgacaacgacgatgaccagggccggcgaggagacggcgatggcagccggcagcagctgcacagatgcgaggacggcgtggaacatgccgctgtgatgatgacgatggtggtggcgcagcgagacgatgtgccgggcgaccgacaggacgtcgacgtcgaggacgaacggtgacgacgacgacggacagcggaggggttcggatggagggaaggcgatgccgaggacgtcgtcgccggctcgccgctgcgatgccggaggagacggcgacgtcggccggcgcacgggaacggtggaaggggttgccgaaagaactccggcgaggcggagggcgagaccggagcgggcgacggcgttccggcgaaaccgagggtaggccggggtggagggcgacgcggcgatgtcgagggaggatggcgacgacgacagtcgctacaccggcgaggcggcacaggcggctggaggcggtggagtggtggcgacaccactggtcgtcgacgaggacgtggctccgataatttccccgcgaaacggaggcgacgccggggaagaggaggcggctacgaggccgctgggggtgacggcacgaccggacggcactccggcgaggagggagaggcggctggaggcgaccggcggcacgggagaaagaggaggacggcggggagaggtggtgaggccacgggatcgaacgcgggagggggctaaaactggagaacggatcgagggggttccattttatagggaaggagagggagctggccaagggagaggcggggaacggtggcgaaattcgtggccggcggccgtggaatgtggccggggttggcgcgggcgttcccgacgattggggtcacgaatcaagggggaaatatgggggaaagacagaggaatcaatagggattaaaaccccctaatcaattttggaaaccctggtttgaatcgcgtggattttggggaggtttggcgctagggtttgcacaggagagagagaggaaggaggccgggcgggaggaggacgacgactcggcgcgtgggacccacgcggtcgcgcgatcagcgcgcgtgagggggggtgggcggcttgggaggctggggcggctgggtggggtggcttgggccgggaggcggcccaggcgggaagggaggaaaagagagctgggccgaggggaaaggggaggcccaagagaaggagggggagaaggagagggagagaaagagagggaggaagagaggactttggccgcgggccgagagagagagagaggaaggactttgggccagacttggcccaaaggaggaaggaggattatttttaggtttttctttttaataaactttgataattgtttttgttgcttaataaatatttcctgtgctctgaaaattcaagtaaaatttgagggctcattttagaccaaggagaatttaacaaaaattctccgggccacattcgaatttttcttatacgtattttagtgtttgccaatttcttttcgaattttaattaattctattatttcttttagaaaatgatttttatttcgagatgaatttatcaggacgtgacaaatccaccccccttacaggaatctcgtccccgagattcgaggaggctagcaagaagataggttgggtggtcttctcttcttgtctgacttcttccgctccgtgttctataataaacttgcctaacaaaacttctccactctagactgcttggctcgatctcctgttccagatggaatcttctcttcacctgacttttccatggttgcacctctagctgacttcgactgggttgtggcacttgaagatgggacttcagttccagaacttctcataattcatatctttggcgtcaacctcatacaagttacccacttcatgttatgcgccgatatcagcttgtcattactaggataccatgcttaccatcgtgagaataccacgcttggcgtttccttccagcttaccaccctatgctttagactatgatatcccgcttactaagaataccatgattgacaacttgccacaaactgtctcatattagctttcctggtctccggtgctagatatttcctctattcaatgcgagggtcgataattttgcctttgaattatgtttcccaagggaaccaacttatcccacttgacatgctttgacgtcttcccaaatgactttactgctgaacttattattgtctgatcgttatcctgccaaatctgaagcttcgttgttggatgtgattttaatctgacctctgtagattttccttgaacatatcacttgtttcataactgggaatggctctcatgaacaagcaactcagattcactttctttacattcggtttactttccagtattctcttcgtgttgtcatcatttagcattcaacgtattcctttacaccttcagccttgatgtgttctttcccgatggatcgattgctaggaaagtgcgttgaacgatactagtgcaggtgcttttattctagcagcatctgatgcagagcccaaggttgaaccgagctttagattccaactgtgcgggttttcttgttgacttcttggtcatgtcacgaaagtttccatccttgtcctcatagaatcacttctacctgtggtcatctcgcttactcgcgaattcatctgctttgatgacagggtggctattgtagggtcaattgctatcgggagtcttcctcgagtgacacaaatcatggttctcgttatcctttatcaatcacctttcgacctacttcttttccctgtaaccaaacatcttttccgatctcttccattaatcacctttcgacctttctcaaccaggtactcttcactccgggtgttgaggatgcttctggggcaatgaggtccttgggcatgctgtctttcagagaaactttgaagtagtttgtcaaaagctagactgacgattgttgcctttgatccgaagaagacacgtctgaaactcttagtccaaacaaatgtctctttggttgatcagttgattttcttttctatctacaactaggttatttgattcataatagagtaggagctcacggaaatgagactctaggtctccttaatcaacaacaaaacgtacacaactcacagcacttgcaatcttaacatggatccttcataaacttgtcaaactcatgttttacctcttgttgaagatcgaaaccgatgcaactcaacccgaaagcgtcgtcaagcgttgcgccggcagcatgtcacgactcaagttctccctgagcatttggttcataatgtgcagccagatcaatcggtgataccccaagttattccttagcatttggtgcgcaacatacagccaaactttcagaattatcaggggggcaatttgaattaccaatatcagccttcgtcgcaacaggttcagtatcagcaaggaggatcagctcagcctcagtttgctcctcagtacaatcaatttgagcctatacctcaacaagcacaaggggtgcctcagcagagaccttgggccgatatgtttgcagatgtgatgagagagcagtttgggcttaagccaaaggatactcgaaacttgtatcggcatccgtaccctgagtggttcgagacggttcaattgcctaaccgatacaaagttccagatttttcaaaattctcaaggcaagacagtgtttcaacctatgaacgtgtcagccgattcttagctcagtgtggtgaggcatcggctgttgacgctttgagggtcaggttgtttcctttgtctttatccggattggcttttactaggttttcttctttgccatacaattcaattaacagttgggccgatttggagaacaatttcatagttacttctgtagtggggttcatgagatgaaattgtccgatctaagagcaattagacaaaggcatgatgaacctgtgcaagattatattcagagaatcagagagatgaggaatatgtgctacagtttgagtctgactgatgcccagttagctgatttggcttttcagggtttgatagctccaatcaaggagaaattctagtctcaggagtttgatagtctatcacatcttgcatagaaggtaaccctacatgaataaaggtttgcagaagccaagaagaacttcaaaaagatcaatcatgtctatccttacatgtatggatccgatgatgatgatgatgattccgaggtagcaacagccgagtgggtcagaagcaagaaggttataccatgccaatgggtaaatagttctggaaaagaggagaggtatgacttttgacatcaccaaggctgataagattttcgatctgttacttcgggagaagcagattcaacttcttgctggtcacacaatcccatcggctgaggaattgggcaagagaaggtattgcaagtggcataactctgggtctcattctactaatgattgcaaaatattcagatagcagattcaggcagctattgagggaggaaaaatcaagtttgatgattccaagaagccgatgaaggtcaatggcaatccttttcctgtcaatatggtacatacagctggccgaacagccgatggaggaaaaactcgaggttttcagatgaattcggctagaattattaataagtatcagaggaagtatgataagcagcaacaggagaggtattatgtaacataccgaaaattaaccgttttctaattgtgcatcatgccgagtcttatatttttaatagcatcctaaacctaggaaaatataattagagggaccttctaaaactaacttgcataaaatccttctctggtattttatttcttttgtatttttcatttaaaaatatatttggttaaattgaggtatttcttgatttggttttaatttaaaaccttctttcgactaaaactcttttattcaaatttagtttgaaaaacccctttctatttttatggattatggtccaagaaaccttcccaattttgccattgaacctaaaccaaagtaattccaattttagtgggattatttgttagcccatcctttgatcttaaacatatcctttgattcttgatccaaattcttccttttgatctagctgctgatctaattcctgtggcttgatttccttctcggcacaagaataatattactacaaacattgtgaataattgttcttgtgctaagataatagattatatccttgtcatccaaatctcctattagcctcaaacaattctttgaaacccatgccatatattttgaggctaaaaatcctatctatcttcctccatttattttctctccctctcatttgagtgcatcaaataaattccgttatattctatctctcaaaatattgcactcaaactagaaaatatctcttttggaaattatatccaaatataatttcctttcaaaattccctattcaaattccttccaaattctaatctcatccaatttctatcatacaaacaacctacaaaatttagaattgatttttaaatttaattgggctaaaatccctttgtctcttccttttggcccatcttcctcttcggcccagcccagccgagccgccccttcctcctcccgtgggcgcttccaggcgccgccatgcgccgctactgccgccgtgcacaactcagctaccgccgctgccatattgccttcgatgccaagcaatcgccgccaacgtcctgccgtcgccgctaaggcatcgccgccgacgtcatctgccacctcacgccgccgacgtcagcctctggagcaaaccgacatctccaaccaatcacaagccacagccggcgccgtcgccttccttctccacgtcgccgccaccaagaccaactctatcttctcctctacaaccgaccttcacaaccgacgtccgacgcctataaatagaaggccagccctccccttttctccacatatgagccgagctcctcgagctctctctctctctcctgttatgtctagccaccaccggccactgtcgatctccctcaccggagtgtttctggccaatcccttgcgccatcaggtttgcctcgacgaggcaaactcattttcctagtttccccttcctttcctcttccgaaaccaaccatcacagccacctcctcttgttgccggagcaagctcttgcctgcgccgttccagcctcctctctcacttcctctgccgactgtcaccctccccgggtgcgcgtcgctcgggaacatgtttttccgccaacgtcgcagcctctcaaccaccggagtatcgatgcccctcctctcccttctctctgtttgttcgtggagaaagagagaagaagcaggaagaaggaagaagaaggaagaagaaagagagaagaaaaagaaaaaggacagctactgacaggtgggcccctacagtactatttcacattttctagatttgattcaaaatccaaactttagaagcccatatctcctaaaccgtagatccgattccagtcaaacttggacctaaattcatctaaattcaaaccctaccttttgataccaaatttgctatttaaatattttatttgaatttccttgatttatttaaatgccatttgcctttcaaatatctcctgttactccaaaatacccgttagccagtaaaaagccgccgattggaactttacgccttctatggagacgttcgtggtctattggccccgacatggaaccattggttgtaaagcccggcataaaccaaacccaaggtcgaagtgctgctcctggcaccccacgccttgatgcatatagcggtcggagcttcactattctatcgacctccacagcacgccacacagttagctctcgggctctgtgtgatcctagccgctccgccgccacccacggttgtcggagtaacacttccgccccactaaattaacctgcacctacctcatatccctctagccgttatactgtccgtcaacaccgactagagaagacaccaaatctagtcgttatactattcaacactagcatcgactagtacacaaccaaaccctagctgacaccttactagttaaatcccagccgtcatccaaattccacacccaccagtatcacctatccaccatactctcagccacctactctccaactacctagaacctatacataaaatatagagcctagccgatatgttgtcctatccccaattggcttaaatataagcgacatttgttgcttgatcccctttctatcttagcctccaaccctttagaacccatacatgaaatattagccaataatccctatatcttacaaaggagatatttataccccaaacccagcctttcttgcccttcatcgctttcttgttattttgtgacttttattgaatttggttctttctcttctttagtagagtctattttggatggcagcctgtgatatttcgaggatcgaataatcaggttgcctatcttggatttatttgcgttggagcaaggcaagttattattcctcccctttgagcataataatcctatattctatatctccagtatcttgtgcattagccttacatgattttgaatgcataacttgaacatatagcaaaccagatatatgctagattttgcttagccatgcctagttagattgcataaaatataataaacttagattggaacaatacggaagaaatggttgatttccgggtggctagtactgttccaaccgacataaaattgccaagtacatgtgaagaacatacgagtacgaccgcaattctcgtatgggcatagacctagctgattaagttatctagcaaaggtggtacctctgtattgtggttcttcttaagtcctcgtgcaggaggcaaacttacgccgagcagggcgattgtaatatttaccgaggcgcaggtaaatatttgagataaattgtgatatcacaaactgtgtgtattgtgaaaaccttgttgagatgacgggggtctctcaactagttctctccaaaaacctcgggaacgccagaactcctttcgctgctgataacgttacgtttagagcgtatgaggactacagttcatggaacaggtaccactaatgttagtaactgaaaagctttgccatgactaagctgatgaatattagcatgtcatggattgcgggtaaagcgtacatttactacagtaaagtataaatgaatctattcgaatagccgtgctcacagatttgagcattgggactcatatggtatttggttagaaacttaattccaaactttattaaatactgttgcatttaaaacattctaggctttcttcctctatattctttgctttctgccagtaaacctagatctactcagatattaccatttcatgcattcattattgaatataatagtttgctgagtacgttgtactcacccttgcttcaacccctttttcagagtccaattgatgttcttaccgaagctgggagttcaatcatataagttagtctcattctaacttagttctcaagtatagattagataaatggtttaagtctataataaaacattagtgtttaaatccttctatagcctctgctggactagttagccacaatcttgtaaattcccctattattttatgtaataacatctcctttgaaaccttgaccaaatgtatgcaatgaagaaccagattgtttaacctgtatcaatttactgatccagggcttgatacagtctaaacatgtcggtttccgaatcattagttttgggacccgacatattatgaagaagatgatagcggttttgaccctcattgggactgagtttttcagattttgctggaatgaagttatgaggctgccatctattgaagattgccctgggtgtagtgatattacagaaagttcaagccgatcttacaattgaagcaatcggctgtggcaaacgcgggttcctattcattaaaggttgggcccagtaaaccaagatcgtgaccaagaggacgatgaggataggaaaactcaatggtatccttctggtatttttacaaaaaatcagaagagaagggttcaaaggttgaggaacatggggcgctttcggaggttgagcaagaaatcaaccatcggctgaagaaagcaaagccgaagcaggagtggcgtgttaagaatcaagctcccacagccgatgaggtgaaaagattggctaaggggaagagtgttgtgactgcatcggttaacatggttttcacgttacctgcggaattcggagctaaacaagccgatgttgatgaagttgaggaagcttcagctaggttggttttgtcaccagagcaaacagtttttgagaagccggaagggacagagaatcggcatcttaagccattgtacattaacggttatgtcaatgggaagccgatgtccaagatgatggttgatggtggggctgctgtgaatttgatgccatatgctacattttggaagctaggcagaaatgctgaagatctcatcaagatgaacatggttctcaaggattttggtagcaatccattagaaataaaaggagttttgaatgtggaactgacagtcagcagcaaaaccgtccctacaacattttttgtcatcgatgggaagggttcctacagcttgctgcttggaagggattggattcatgctaattgttgtattccttcgaccatgcatcaatgcttgattcaatggcaaggcaaaaagattgagattgtgccatccgacaggtcagttaacgttgccagtgccgatttagctctttgggagatggacgatattgattgcttatctggaaaagtttgggatggagatattctaagagtgtccgattgtgatatacagccaattgaagatggagagcccaagttattattttgagggcgtcgtggagggttcaaacgtttacaccaaggacacagtagatgatctcgataacaagcaaggacaggatttcatgtcggccgatgatttggaagaaattgatattggaccaggtgatagaccaaggccgacattcatcagtaagaacttatctccagaatttagaaccaagttgatagagctcttaaaagaatacaaagattgctttgcttgggagtattacgagatgctaggactcagccgatcaattgttgaacatcggctacttatcaaaccgggtgttagactgtaccagcagccaccgagaagatgcaaagccgatatgctcgaacctgttaaggctgagattaaacgattgtatgatgctggttttattcgtccttgtcgatatgtcgagtgggtttccagcatagttccagttatcaagaacggcaaagtcagggtgttcattgatttctgagacttgaacaaagctaccccaaaggatgagtatccaatgccagtagccgaccagctggtttatgctacttcagggcacaagatattgagttttatggatggtaatgcagggtacaatcagaactttatgtccgaagaagatatccataagactgctttcaggtgtcctggtgcaatcggcttgtttgagtgggttgtgatgacttttggcttgaaaagtgccggagctacatatcaaagggccatgaactacatttaccatgatttaatcggctggttggttgaagtctatattgatgatgtggttgttaagtccaaggaaattgcggatcatatagccgatttaaggaaggtttttgagagaactaagaagtacggcctgaagatgaatccgacaaagtgtgcttttggtctatcggcctggccaatatttaggatttcttgttcatgaaagtgggattgagataactcagaggagtgttaatgcgatcaagaagattcaacctccggaagacaagacagaattacaggagatgatcggcaagataaattttgttagaaggtttatctctaacttatctgggagattggagccttacactgttgttgaggttgaaagccgatcaaaaatttacttggggggcagagcagcagaaagctttggatagtattaaagaatatcttagctctcctccagttttgattcctccacaaaagggaataccttttagattatatctatcggccggagagaagtcaatcggctcggtcttgattcaggagcttgaaggaaaagaaagagttgtattctatttaagtcgccggctcttggatgcagaaacaagatattctcctgtggagaagatgtgcttgtgcttatatttttcttatatgaggctaaggcattatctattgtccaatgaatgcaccgtaatatgcaaagccgatgtggttaagtacatgttatcggctccgattttgaaaggaaggattggaaagtggatattttccttgacggaatttgatcttcggtatgatctaccgaagccgatcaaggggcagactatagtcgatttattgttgatcatcgtgatgattcaaaaccgctcggtgagattgtgccttggactttgttttcgatggatctgtgtgcactcatgggtgtggtatcggcttggtacattttccccctcgggggcagttttgagttttctnacactattaaccctnatgcgaccacaatcaggcntgagtatgaaggcggttctcaaaggggttgcaattactcaaggaagttgaagccgatgctgttgagattatgggtgattccttgctggtgattagccaattggcgggagaatacgagtgcaaaaatgatacattaatggtttacaatgagaagtgccgagagttgatgaacgaatttcggctggtgactttgaagcatgtatctcgagaacagaatgttgaagctaatgatttggcccaaggggcatcgggatataagccgatgatgaaggatgtcaaagtagaagttgccacattaacagccgatgattggaggtatgatgtgcatcattatttgcataatccatctcgatcagcttctcggaaattgcgttataaggctttgaagtgtaccttgttggatgattagctttattatcgaacgattgatggggtgcttaaatgtttgagtaacgaacaagccaaggttgcaatcggcgagctgcatgaaggaatttgtggaactcatcaaaaggctcataagatgaagtggttgcttcggcgtgcaggatatttttggccgacagtgttggaggattgtttcaaatattacaaaggatgtcaagattgtcaaaagtttggagcaatttagagagcgccagcatcggctatgaatcctatcatcaaaccatggccattcagaggttggggaattgatatgatcggtatgattaatccaccatcgagcaaaggacacatgtttatattggtggcgaccgattacttcaccaaatgggtagaggcgatttctttgaagaaagttgattctgaggatgctatacaatttgttcaagaacatattatttatcgattttgtattcctcaaaccattacaaccgatcagggttcgatctttgtgtccgatgagtttgttcagtttgccgatagcattggtatcaagttgttgaattcttcactatattatgcacaagctaattggcaggccgaggcatctaacaagagtttgatcaaattgattaagagaaagatttccgattatcctcggcaatggcatactcgattggccgaagcattgtggtcctatcggatggcttgtcacggttcgatccaagttcctccttataaacttgttgatggacatgaggctattttaccatgggaagttagaatcggctcacgaagaatggagttgcaaaatgagttaacagccgatgagtattataatctcatggccgatgaaaggcaagatttagttcaatctagactaagagcccttgcgaaggttaccaaggataaggaacgtatcgctcgccattacaacaagaaagtggtgcccaagtctttttcggaaggtgaacttgtgtggaaattgattttgccgataggaactcgagataacaaattcggcaagtggtcaccaaattgggaagggccgttccaaatcgataaggttgtgtctaagggagcttatatgttgcaagggcttgatggagaggtttatggacgagcgctaaatggcaaatacttgaagaaatattacccaagcgtttgggttaatgcatgatcggctggtgttgccgatacatgatagacgatgtgtttacatcaccttgagatggccgatatgattatatcgcccttagttgttttcatattgtaatcggttgtgtcttgccgatatacaatggccgatatagtaatatcgcccttagcagttttattatcataatcggctatgttttgccgatgtatgacggccgatatgattgtatcgcccttattggatttctgtgtgattaacataatcggttgtgtccttagtccaagttataattttatcaatgccttcgtcattgcaaaattaggggggcacatatatacaaaattgaggaaaacagagaaaatttttgagcaaattcagaagttatattaatcggcacaaaggattatcaagacaagttaaataaaagtaccagagtatcttagctgtttacaaaaatttcctaaggtctattacacagaaaatcactgggacagatagcgctggatagccgatatagctctttgcctaatttgttgtacttcttcaatagcttgggcatcttgagtatcggttctagggatgacttttaaggacttggtcatatcagcgacattcttaatagccgatttcatccttgtcttctgttcttcaacagcttgcgggagatcggctagctttttgtgttctagatccagttcggcgttgcattcttgaagttgtgccaagagctcaatcttacgagcttcaagctgtaaaatcaaaggtgtttttggttattattctatgatgaacaattgggcattggagattattggttttgttatttggaatttattcacgaagtggttttggagatgattggatttcacaggtgaatctataggttatcattttatgtgtccggtcagaccaggcaggtgttgccggtcagaccggcggtgatcgagcggtcgaaccggccagcccgcggtatgaccggccgacgctgtgtcggtgtcggtttcgggttgtttatttggatatccgtgattatttcatgattatggcttctagatggatactatacgtatgtaatactattgtttgctgctaatgagtcaagttggagatagcttggtctcggaatatggtttctttgtttgctccacgtgtaggtgacttgatgtctcgggagagtatttgcggtgatggaccgggagtcggcttggggataagacgacgtccgtggtggtcagagatcatgcgggatactaaggctagagttgatgcacatggttgatggagattccatatggcatacgatggagttattgtgtgcgtatgggatgtggagtcgaatttggaaggagtccaaatttggtacgattggtcctgtaaagtttctttcttgaactagagggtttcctaaggtgttacgnactcntagtatgagtttggttcgtggctttgggctgcctacctcatgtataaatagagggggagcgtgaggcttcccggtatcgctttagagagcaattgagttgagttttgaattagggtttcgagtttagtcgaaatttttgtaaggagtgttgttggtgcnctttataaccacagagagaagaaataaagttgtcatccactttaagagttcttcgatttgtgtttcaccgagtttcggtggtccaaccggcgacataccgacggttagaccagtggcatcgcggcggtccgattggcggaaggacggcggtcagatcggcggcggcgacaggcgcggcaggcgacatcgatggtcagaccgggtgatctataccggtcagaccgacggcatccacttggtcagaccggtagatcaatctcggtcagaccgatctccatcgaattcgagggtaacttttattttcgctaaaagttttcggtttttgggtataccaaccattcactcccctcttgttggcttagttcttgctatttgatcctacaagtggtatcagagccaggctaggttaacatctctggcccgatggacacgtgtgaaggcctgatggaccttgggtgcctgcggggcccgcatacctgatggaccgtgggccggtggggcccggatacggtgaaggggcggtgaagggctaagggacactaatgtgtgaagcggagattgttgaatagtcccacattggttgtggaagggcaaagaacctaagatataagtgggggagcccctcacctcaatggctagcttttggggtgggaaaggccctttacgatcctacaattggtatcagagccatgttttcttctttggatttttatcgatctagagtttttgccatggctactcccgctcgtttttcaactaagcctcatgttttcgatggaacggatttttctcattggtgtagtaggatgcaatcttacatcatggctgaagattatgatatttggagaaaagtttctcatgcttatgtgattcctgaagctattaatactgctgctgaaaaaactgcttttgaacaaaattgcaaagctcacaacattcttttgagtggtatttctcgttcggattatgatcgtgttgctcatcttcaaactgctaatgagatttgggttgctttaagtaattttcatcaaggaacaaataacattaaagagcttcgtcgagatgtttttaaaaaggagtacattaaatttgagatgaaacctggagaagctttggatgactatctttctaggtttaacaaaattttgagtgatcttagatctgttgattcttcttatgatgctaattatccacaatctgagatttctcgtcactttttgaatggtctcgatatgtctatttgggagatgaaagttacatctattcaggagtctgttaatatgtctactttgactttggattcactttacaccaaattgaaaacaaatgagatgaatgttctttctcgaaaagctgattctaagtctagtgctttggtttcttctacttcttcttctgttgttgatgcttcttcatctatgccttcttttcttgctgcttttaatgccacatccgatgatcaactcaaacaaatcgaggaggaggatttggctttggtcgctaaccgtattgctcgagctatgataatgctaggaactgaaaagaggtggccaatcggtgcgtgaatgtggttcaattgatcatcttcgttcgcattgtcctaagcttgggagaggcaaaagagaagacaaagatggtgagaagacaagcaacaacaagccctacaacaacaggtcgaagagttcatcccaagggaagaagatggagaatctcaggaaggcttttcaacaagtttgtgctgctttcgagccactaagtgatgtagatggtgaaagtggagatgatgataagaggaagaacatctccgatgtttgcttcatggcgcgtggtgaatctgncatagggttttatcaagatgggatcaaccggccgtg

SEQ ID NO: 22017 - DNA, 1541 bp, Oryza sativa
  unsure (1)..(1541): unsure at all n locations
gcatgggcccgcaccacaatcctgtggcgggaaggtttacaaaaaacccaatagatctcttgaaagtacccggaaaattaaacccggcaaggaacccagcttttctttaagagttggaaaggcttcctggcatgcggggttccacacaatattctcttctttcttcaaccaattgtttcctggttagaacaatttttgaaaaagttctcgattaactccggtaagtatcttgcaaaacataagaacttccgacctggagtgactgtcttgggttctttcaatcaagtgccgcgggtcactgttcgggggtccacggcacttccttaagcagatatcacgtgtcataagaatttgacttcgaacaccaagaattcacacttgctaagtttggcatacaattgatgttcccgcacttttcccaacaccagacgaagatggtgctgatggtcttcctcggattgtgagtatatcagaatgtcatcaatgaaaaccaccacaaacttatccaagtattccatgaacactttgttcattaagttcatgaagaaggcaggtgcattggttaaaccgaacgacatcactgtgaattcatacagtccgtatcgcgtggtgaatgcggtcttaggaatgtcttcttcacgaatacgtaattggtgatatccggaacgaagatcaatcttggagaatacagtggcacctttaagctgatcgaacatatcatcgatacggggaagagggtacttgtttttgatggtgacttcattgagagctctgtagtcaacgcacatcctcttcatcttgtctttcttctccacaaaaatcacaggagcaccccagggggaactactcgaacgtatataccccttttatttcaactcttccaactgtttcttgacttcggccagttcatttgctgccatacggtagggtcgcttgtacaaaggagtggttcctggagcaagatctatccggaactcaatctctcgcttgggcggcataccgggtagttcttccggaaacacgtctccgaactctctgacgatggggatttctgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngca

SEQ ID NO: 22018 - DNA, 1539 bp, Oryza sativa
  unsure (1)..(1539): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtcgatgatgaggatgtccggcagcgcgggcaacctgaatcgatggcgataaccccggtactcgagttagaaccgagcgcggcgcatatcgtcgatggccaggttgctgatgcagagaccgaagtggcggcaactgacccgagtgagtgatcttgtgcgccttgtcgctttttgttggtttccaagctgtggtaatgaccatcatttttggcagatctcgaggatgcctttgcgactcaagatcgtcgtatccaatactggaagacgaaatgtgaagtggcggaactcgagagggcgatgctagccatgaaaaaggaccaagctgtggaaacactccgaggtcgagaggtgtggttctcctcttatctgaagaattgctgcacctcgatggcgagggtgtgccgagatcttcgggtagcccgcggtgatcctgaagagtcggcggccgggtacatctcgtggctcaatggagcctgcgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 22019 - DNA, 1890 bp, Oryza sativa
  unsure (1)..(1890): unsure at all n locations
tttttaacacgaagggtgtaaatgtttttttatctatggaaggaagccccgccccccaaagccaaccaaacacggcgaagttgaggggggaccacgggcatttgcggaaggcccaatttagacacaaaggcttccatcctttaggaactcttttctgagtttgggaaaaattgagcagcttgagtacaccccggtcttcaacaagacacaccnccaattgcagaattaatgcaaggaagtacaaggagtttatatataagggttagggttgcagtaacagcatttaaaaatattttagtggcccaaagctattttgtaaacacgattctagaactattcaatattatttatcaaggcggtgaacccacacgaacctgctttaacccagggcntacgatgattcagaccgaactggcaaccggacctgggtcccagctcgtcccaagccaacccaggccaaccattccacattttacttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggtaggcaggactgagcccctagcagcaggacaccggccctgtgccatgacatctcgactaccgaaccgcagcccgtgtagccttcatttgtcctagagatgtccatcgacccccgacttcgtccatctctaatccgtgtacttttgtttataaccagactgagccacaaactaagccttacccactagacatgtggaagtacggtagtgctttgcaacagaggcccgaagaccggtccttatatggccgaggtgctactatcaaaaccatgcacgccgagcccagcctaaaaccattttggggattttgaaaagaaggagcggtgtgaagccaattccacaataaccaaaccattccaaagtgtccaggtgatatgaatattcccaaagtctagagttataaaaccacctaatgttacctaattaaagcgaagcatctaccttaaatcatactagtggtaccattagtagagtgtccactagttggggttttgttggttctagggtgaacaaggtaataataacaataacaataataataaggtcataacaaaggtaaataggcatggctaaataaaacagtgataacgcggaatttaaataaagcgataatgcaataagttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaaaccgaaataaagcacaaaaatgggttcttggcttcttaaggaaaaattagagacttgaacggtccaattctgagttcaaatggccaagttatggtcatttgaagtttatatgctctttaaatggatatttgtgaatttcttcatttaaattttaatttaaaatcggatttattgcgtcagccgggagagaggagcgcgcggaccgggtccatgggagtggggcccatgcggcagcctcacggtcgacggtggaccgggtgcacgcggcttacgccggtcggcgccgtgggtcccacgcatcagccgcacccgagggcgcatggatcactcaaagacgtcaatnggcaat

SEQ ID NO: 22020 - DNA, 1457 bp, Oryza sativa
  unsure (1)..(1457): unsure at all n locations
cgcgcggaacaaagagaggctaccccaaaaggaaaaggttccgggcatcaaaggcggtggaacggaatttgggagcaaggagggaaaaaaaaaataaagcggcaaagttttatttccaacgggaaaagaaaatcggcaatgtgcggaacaggttgaaggtaggcaccggaaaggttttaaaaatttttggaagggaaggaaaaaggaatccccttaatttctatagggccggcaggaattataatactttgttgtcataacccctccaggggtggttatgaagcagagggtttcttaagcttttctatcccaaactgattcctccccacgaatggcacaaatataaacgagtgggaagctccagaagtcgaacaaaaatggtagcaggaatgaaatgaatgaggaacgtaccaccgatgacgtctggagttgtcagcacgtcctcggccgtcacatggttcacccatccccgaatgacatccttcccaccgttgttggagcggggaggcgcttggccttgctgacgcctcggctttgggcatttatccgcaaagtgcccgggctcgaagcagttgaagcacagatgctgcggacctgaagcgtccctgcggccttggccaggctgcacagttggcgtaggaggacgaggcgcacgagtcccttgctgactctgctgttgctgcggttgtgggacgcgcaccacgaattgaggtcgaggcgcggagcgaggttgctgctgttattgttgctgctgcgaggaggatccccctggatagggattggtgtagcggaccctttggttagcaccctgttggttgcggcaattcgccaagcggcgcttgtgcgactccagttccttgtgcttggcttccaagcggatgctcttgtccaccagacgttggaaatccggatagtccccggagactagacggacggacagctcagggtccattcttgccaagtacttctcttgcttctcctcatcttcccgcacatcctccggggcgtaacgggccaggttgttgactcatgcaaatactccatcacggagcggttgccttgcttcaactctcagaattctcttttcttaagggccacgactccggcgggcacatgggttctcccgaaagggcggtgaaacgggcccaagtaataggttgcccctcttggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatcctggggttgttggagctaaaaaaagaagtggggcgattccgaggaactccgccaggtatatgttgtggggggtgtgtggaacaataagttttgcggattttggattggggagggaagcatcattattttgccctgttggcaaggattgn

SEQ ID NO: 22021 - DNA, 1169 bp, Oryza sativa
  unsure (1)..(1169): unsure at all n locations
cgccntttgaacctgatttgcatgtatgggaaagcgcgtggcgacggtacagaaagacggtcgaagagtggaatttacagctacctcagtcaccgatctcaaaaagtatattgctgaccttgaatctcaggttggtaccacatcacgacgccaggggcctgcaaggttttacgtatgaaaataccatctttagtgggtcctgacgggaaaacatccctccgggaatacgcggggtatcatggcggcggcggagggtttggtggtcagttgcggggctggaatccaccaagcgaaagtgctgatgcggctcttctgcctaacttctcgcgcggaaatgcccgtgctgacgatctggtcagaaataatggctatgcggcaaacgccgtgcagctccaccaggaccacatcgtcgggtcatttttcagactcagctatcgaccgagctggcgctatcttggcatcaatgaggaggattcacgcgcattttcgcgggatgtagaagccgcctggaacgagtatgccgaggacgacttttgcgggattgatgccgagcgtaagcgaacgtttacgatgatgatccgagaaggtgtggccatgcacgcgtttaacggtgaattatgcacgcaggcgacctgggacagcgattcaacgcgtcttttccgtactcagttcaaaatggtcagtccgaagcgcgtcagcaatccgaataatatcggtgatacccggaactgtcgcgccggtgtgaaaataaatgatagcggtgctgcgctgggatattacgtcagcgacgatggttatcccggctggatggcgcagaactggacctacattcctcgcgaactaccccgcggtcgaccttcatttatccatgtattcgaaccgatggaggatggacagacccgtggggccaatgcgttttacagcgtgatggagcagatgaaaatgctcgataccctgcaaaatacccagctcacagcgcgattatgaagcttggttgtcgttcccaatcggaggaactggttaccataccgggatggacttttatttccggccggataataagagacacggagcaaattatcgggttggttggggaaagaggcctatatttaaattgccttggttcctggtggggcaaagttctccaactcgtttcgggggtatctctt

SEQ ID NO: 22022 - DNA, 4460 bp, Oryza sativa
  unsure (1)..(4460): unsure at all n locations
ctcttcccactttggagggtgttttccggtgtccctcctctttaaagggggtgggccgctttttggtattcccgccctttttgttgtaattgtcttgggttcgccgttttttttctgaggaccgcctcctttttggtctaggagcggggtgtcctgttgttcttgtccccgttcaaccttgtccggctttctttgtcccctcctcccggttccggttggtggtattggactttgtcctttggtagttccgatggtcggtgcgttgtccctccgtcaagcgtttctggtccgtggtccgggttctcaaagaattcgnttcaagccccgtcctgttgttggtcctcgggttcgggtttttcaagccttgttccggccccagctctccttggttccagggttcgccggcgaaagccgtcccttcgccgttcgtctacgatggtgccctcttgtctccccggcgcccgttcgtcgttgtcgctcccacgcctcgtcgcgtggtggtaaggttccctctccctcgttgcctggtcttggtcctttcggtgtcgcccgtgccgttgtgcggttgtcggccccggtacccgtgtatcggcgtcggcagacgttcgcttgtgcgcgtggtgaccgtgttagtgtgcccgctcggtagccgcgtggtttccacgtgtgcaggccgtgtggtgtctagtggagtccgtttgttggccactcgcctcggttgacacacggggtccgcttccgtcgacccgtggaccgtctctgtgtatccggtctaccgcggtcctttaggttgacatgtggggtccgcatgtcaacggcgcagccttcctgtcttttccaggctagcgcttacacatgttttataaatgcaaagcttaattataataattcgcaaatctccatataacagcattaaacttcggatgatcatatcctggtcatacgagctccgaatcgacccgttcaagtctcctaatgtttgctataacctaaagaaccctgtgctttgtttttatgtattgttattgcttctttataggcttgtagctttgcttgtgtgcttcgcgtagctttcgtcgttccggaggtttccaaagcgtggttcgtggtcgtcgccgaaggttcggaaggccgttctctctgagcaaggcaagtcacatcatccttgaacatattgaatcccagtttgtaaaattatgttgatttaaattattgcattaccgctttatttaaattcccgcgttatcactattttatctagccatgcctatttacctttgttatgaccttattattgttattgttattattattaccttgttcaccctagaataaacaaaaccccaactagtgggtactctattcatggttccactagtataaatttaggtagatgcttcgctgattaattaggcaacattaggtggttttataattttagactttgggaattctcatatcatttggacactatggaatggttggcttatggtggaattggacatacacctctcttcctctttcaaaacccctaaaacctgttttcggtggggtttgggtgcatgccagttatgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcctgtctaaggctaggatgggttggaaactatgtcacatctttacgacgggttccaaggccatggaatgcggaataaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaagccttgggttaaggcaggttcgtgagggttcacggccttgtttaataatactgtgtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatcttttcccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacattttcactacaagaggaatttcgtgcttctgccggatcctccctatctcctgatcgagcttgtgtaggtagatattgcctagtagggccgatagtagtacactgtttgggacggagtcagggcccttctcacctcctacgagtcgtccggcggaaaactgtttctgagtggggtaaaagaacttggaatcgtcgatctcttccttcaagattgagatgaatcgatgtcggtcgatggtgtgaaaacacttcctgatgtcgaattccaaaaaccagcgagaggttccccactcttctttgatccgtctgagggccgagtggcagcctcgacccgagcggaagtgcgatgtgtctggaaactcgctaccagttccttcttcaactccaggccaggcaagagccgagaagctatccgtcaaagaaaaagaatatgttcaacccaacaagcaacggattgagccactagcgcaggctgtagtttgatagcgagttcaccttcctagtaacgtttactcatttcattcattctcattcaaatctacttctaaggcatgtgaagtaccagttgtagacagattccttggcttgcgtagagaaatgtgaaattcatttctaaaagcaagagtttcttttctttaattagattataaatctgcgtaggataggtgagatgaatgaaaaggtcctcttgtccgtcgatccgaagaactcactcgattccccatgatgatatgcgtcaacgtaaggaagttgttaaactacacgtgccttcaacacccatctcgggccgggtgagaaagaagcaccaatagcttaatgcaattgctatcatgcttggagcatagatagaagaggtatgggtataggtaaaatgcacacttctaccaggtatgtgagactctttctaagtaagagagagctcgttctagctttgtcaatcgtggaatgagcagctccatccttactgtcctggtgaattaattgggtaattaatgagcacactgactcacaaagtctatagctagtctctacgaatatctcgatgcaactattaccaatagttggaggtaacttcgtgcttgaatgtattagtggaagttagtagcttgaagaatggaaagagtcttttcgtccctctcaaagagggaggggagtagttcacagctactgtctcaaataatctagtagggaatggagtgaacagcagggagtttagtgggttgttttgctataatgagtgcgtacttccagagtgaaggaatgaacaacaagcatagtagtgagtgaaaagcatcgatgttggtctgatcaaagagccaatccccaacaagaggagagcggacagctagaggagaaatgcgtttgtttccacaaaacagggaatagtgaggtgacccgtttagaatgcggagtgagaaagagtatttcaatgagttcttgtacagaatatgagagtaggtgataggttacacaactcaagcttgcaacctgggtggatcgtcggcaataaagaaagattttgctggcagtggactgggccaataccttccttgtcataaggaagtccctggcggccgtattttaaaatctgtaaaagattttgtgcttcctttttgttcatggggaaaggtccgtctaattaatttcaaggggaacgggtttatgctgagtaccacattttaaaggcttgtctttaaaattgagctttcttgttttggagggtgccctactattaaatggcccacaaacctggatgaaatttttttaattaaatcct

SEQ ID NO: 22023 - DNA, 5575 bp, Oryza sativa
ggggggtggacttcgcgtcttcaggtttgtggagtgttttgctttagaaatggaatttcttttttgtcccttccagaggggggggtgtttgtacagattttgttccagttttcttttaggcatgggttcctcgcaggcttttagggggtttttttgcagaaatggggcgtcttccgggttgaggatttgccctccgggttgttagtgtgtgaaaagcctcggtgttggttgtcccgtgggttgattccggctttggagggttgccgtttattgggaatgtgttgttttccgccagcccggacagttgttattgatcggttttagaggccggattgagaaaggagttgttccatgggttggtttccaggtgtggggggttacttttttggtttccaaactcggttgtagcaacttgtgttgtatcgttggtcgtcaaagggagatttatgctgtgcgtttgattgggggcattgccttgcttgcgagtaagagagtctttggggggccgttttttgatgtcgttgaaggaggttcttggacttcctttttctgtacctgggggagcggttcgtctattgggttttgcagggagtctgggtttcatgctgattactcactctttcaatgctatgtctttaagacattgagctttcctatgtctgagaagggatgccatacttatagactggccaagcaaagcctaggatgaatctctcttctagtctagcttccgcttacactgaagcttccactcccatacgggcaagaagagctccttctctttttgccaaagccctttcttcttttccttgtgcaagtcaacttttccctggcacaccgcacagttcagctgtgacatcttgcacttgtaagatcacttgcttgcctttatgcttgagtttcagcattcctttactccattcaactgtgatttgagcaaaacttgacaaccagtcaatgcctaaaataagatcataacgttgtacatgaagcacgctaacttctgtttcaaattcatggttttgtaacttgaattgaaggttgtcacatttggtactggtcaataacttacggcgagacgagcatccctataccacgtgtatccacactcgtctgtccttttctacttagttgtacagatcacttcagaaaatcgtataaaaatcaagcaagaaaacgtatgcgctttagcaacaaagcgctcatcccttcttctttcgcttggaatcccctcgcttcttctttcgcttctacgctcgtgctttcagcaagttcgtaccagtcgtcaggagctccaacctccgcgcctagccgcaaggaacctaaacgctggttctatcccggccaagcaagcaaggtgaaccccggtgggaaagaaagaccagggggaagaagcggggtagaggaattggtcaactcatcaggctcatgacctgaagactgcaggttcgaatcctgtccccgcctaatcacgtcagatacttctacgagtcctgatcacctgggtgaaagaatctatgttcaagtcgcctgcctaacgaatagacaactacgtgttctagttgctctgttccgttggtccccatggaaagtgttgttgtgtcaaatcgagattgtgtgggtgttcagtctaccgctcatgttcacgttctcaaaatcaggctttcgttggaaaaaccaacgccgaccccaaacaagtctctccaatataaggagagcggagcttaaaaggatatagttacctatgatgagatttagttcaatggatatgaaggatagaagaaataaagtattttctactactctacccactcgtagcttgacaattcctccccaaccagtggtgcaacctgctcctcctgctgatctgaaagggatcttcgtattgcaagttttgatgcacccgagccaaatcttactttttttagtaaagccttatgatgttttcaatttattaagggaaggggcttctttgcaaagaaaagggatagcgctaggaatatcaatagcgtatggatagcattattccattccatttctattttccttcgtttcgtaaagtagaggggctcgcaacaccgacaaggaatgaagtcaacagagctagcgttagggataggagcagtgtcgcaatacgataatagaatgcgctttatcaaataaatatcatcttctttggtttggatatgcgattaggattgttctaaaggaaacaaaagatacctttgccctggaggattggacctttttacattaaccttcccccaaaaggagtacgaatcgctacgctctagctcgtaaaagggatagccctcctaaaggggatagcgataggtctaggaatagcatttctctagcgtataagggctcgcggtcgagggaaggtatagttgaaggtatgaggatgaggattagaatttcattccattgctttgttagagggagaggaagcttcgattggtggatacaataattccaatcttctttgccaatactactactcttccttgctctatcttatttcaactactactactttgaatcccgttttattatctctatactacttcttatctcttggattccactgccaagcttcaacagctggtcttgtctctacttgattgagctgcccctgcaagtctgactatgcaccagcggcattgaaggaaataaaaaacctgaaaattgattagccagatcaaagatcaatggggaaactctcactagctggctagaacgatgttcgttcttacccacagccgcaaggggcgcttgaagggcactaagatccgctggcaaggaactgtgaggagatgagattctctttgccttatttataaagttcttatatagagtttggggcatgcatatagttagggcatatccttttttatgtgtttgttatctcgctgcgcgccttttcgatgataagatcattttttatctgacttggttgagtaatgcatgagatcaacctgcggccttgtgaaagaaaagttggtagactgcttctttttcagtatttgtattggattggttgaagatgtttattgattgtcttcggctttaactctttccttagtagaaggatccgtgggtggcttgacttactttctttcatcggtagcgcattgtcaacctgcggcctatgcttctcgtgtgaggagagctaagtaggaaggagggacggacttagactttaggtagagccaggcagcctgattgaaccttacaatgaatcaactattcccataataagcaagtggaacaggtacggctactgagtcgcaacactcacctacatttgacctgactttgatagtcaaacgatgtagaggaatgggcgtacctggaatcagcttaccattggaactatgcctacgcgacgccctccccggaacgcaaatgccctctttcgcttcgcccttggtccttccacttcgtgtaactccgaatttacctgcgaataaatcggaaaggcaagctttcctcccctaagagttctttctttgttccgctattccctgctttcctcgttctctcctcgagacagattttcactacaaataaccggatagagatatttccttacttatagagccagactgtgctttaacacacgacatcccagtcagaggggggaatggtcaaaagaaactcgttccattgaagatcttttacaaagcactttcaaaaatgtgcatgatttgtgcaatgcaagtcaacttagaaagagctcttcttttccaaaaaaaacacttctctctcgaaaacaaaccacttgcttgggcgggcatcactttgcctctttaaccatccctttacttacttggttcctgatccgcacagacacatagttagggagctttcaatcagcaaatcgttgctgtgcgtggtggtcctctcatgtctgggctgcccctctcttctgtttttgcatttctgtgcagtgattagtggaaatagtgctatgacattgatttgttgccaatgagaaaatgcatagataatgagctgcgccccctcaaaaagcaattaagtgagctcaggtccataaagaatagaatagaaagatcgcgagaagaacctctgcgaaatgagaacgtaacttgtcgcgtgtcctcgactagtagtgtctaattgaaaatgtcttcttacgagatgagtctctggtactgttcctgtaaaagtgccagtactaactggtaagtcggctcctggaaaagtgaatactttaagggactatcgagctctgtttatgaaatgctcgaaatagctcagttcgagaaaggggatagagaagagaaataaactattgatcgagggatggagaaggtgtgggcccgcttactaatacggttccgttccgcatgaaaaagaccaatcaaatcaaacttttcttggaaaaaccgacgccaacgttaagatcagtctcctttcttttcggcggcatccttccgcattggcggcgagtggaagagttgggttcgattccctttatacgcgatgtggcgaaaaagactgattcaacgaaatatgccatgcctgcattattacttaccaccagtatctcgggaaacggaaaaccggaaatgacaatcctttctatggtctatactaaattactttgtacgaatgcacatctcggcgggcgtcgggtagatgctcaccatttcaatgtctatatctgtggttccagaagtggaattgctattctcgattcagacaagacactgatttgtttacgaaccgctcttcattttataggatctcccattcgtaaaaaatgccgttccttccttttaaagaccaatcatttatttcgatgtgagatattggaaaaaatggcgagctgtatcaatgattctcaatggaagatcgggactttttttagcaattatttggctaaaaaaaaattccgtttaagaacgaaaaagataaattttgggttgaaccaacaacccgattgtgcggttattctgaatgcagatagaaagtcttcggtcatactggaagctgctcgatcacaaatacctattgcattcttagttgattccacgatcccaggggaatcccataaaagaatcacttatcccatcccagcgaatgatcctatacagttcgtatatctatttcgtcattcggtcacgaaaacagggattctggaacgtaaatctgtgcacgaacccatgcaaacaggcttaaaagcagtggatagcctggttcctataggccgtggtcgacgagaacttataatcgggggcagaaaaacttcaatctgtagcgctacttccagagttaccaaaactcgagttttatactgcgcttgacagcgaatattttaggtgcccgcctttctttcgaatgccaaacaggtgtttcactgtgaacctttcttttacatcccggacagtagttcacctcctttccaatgcaaatttaggtgaaatctaccattaaccagtccagggagcttgcccgtaatctaagggtgggctgccctctcttaatattgggtagcggccaaccctcttctaaacattttgggatttcggaaaggggacaatactaa

SEQ ID NO: 22024 - DNA, 3564 bp, Oryza sativa
  unsure (1)..(3564): unsure at all n locations
cgggatccataaaatactttttccctcccgaggatgctcaacacgtggatatttattggcatcggtccaaaaaaggaattgtgaatgtaatttgggcggacccatgccaacggtttaagccggtgaaacactgtttcttaaggcggtgtgcacaagancttaaatggcgggacaaaaatctcaatgtgaggggtccttccaagttcccaaaactgaaggttttatactcggggtgacagcaaatatttttagttgtcctcctttcctttggaaaatgcaaaaccaggtgtttcaatggtggagccttccctttcacatatccgggaacagggtattcccaccctacattccacaaatgcaaaattttatagggtaaaacttctaccagtctacccaagctacaaggggagggttggcccgagtaactctacagggggtggggctgccctttctttttcaatttaatctggtttatgcggccgaacacgcatctttcttaaaagcaatttctgaggagctttaccggagagtaggggacaaatcaacttaaagagtcccctggcgaggagaatataaggaatatagtctacaagatcatgaatgatgattttgaactcttcttcgatcccatagaagatttgaaggactggctacaattcattaaggcgaatccccttagttttcaggatcttatacaattttggatggcattagccaaatagtcgatggggatgggggatccaccagtaaaggatttcaaagaaagaatggttgggatgggggtatcatagatagggttggggacttcagtgattcatttgaagagcaggattgggtggccgaccggcccgcagacgtaggaaggcttttatcgccgactgaactgcgtcaccaaagtcgcgatctgaaagagacgtctctttcaggaagggcaatgcgggttcgactcccgctcgtgacaagaagcaagctaggtatgctcgctagctgaaaaggcaagggaaagagattctgattcaaacccaattccgggagtgaaatagtctgctgtgatagaacctggcaagggaaaaggaatacaactgagcaagataactggattgaaccagatgccgtaaagagtcaaagtaaaatccattagcgcccagaggcagagcaaagagattcggagatagaagagagtgggaccacttcgaagtcaacgggttaaacatagtgcgagttagacagatcccacatctcaaacgtataaagaagtcccttctcttagactccaaaggcacgaactacggctatgacctatgagctagggggcatccacctgtagtacaccaaactctttcattgtcttgaagcaatctatattactttagctgaagattgatttggtgggtgtgcagactatgaaccgtgcggttcgggtgagagtagctgatgctggtgaatcgaagacggatcatagcagtggagtggaggttctatggcagaagccccatatttatgaagaaaaacaagttctaaccgcattctaggagttgccacgagtgattcccttcaaaacaggtgtggaaaggtcattagaggctcctctggaggccatacaagaaggatccttaattcattgcaaggcattctccaatccccattcacactctccttattcatacatcagttcagctacaacaaagaagatatcctcccatacaatggaaaggagtcgtcgataggcacactaccttctccaaggcggtgcacccatctcttcgagaaagaagaacaagaaaaacaagagtagtatttctccccgaagggaacaagataggtgccatcaaacaacgaggggtttcacggtcgtgagctccattccaattcaacagattggtgaaacaacctagaaaaccattgtcccctcaaaccggtaataacttgtcccatttctgcatccgttaatgatttaagaaccgttcgttgagacctcaaaagataagaaaactgtccctttttgtcttgcctcgataaaacaatgaatgggtaaagccgaattgatctgaccaaccaaacatgggatcttttgtttgatactcaacacatgagaatctaggaggatactgattggcgctcaagaatggcgtagttaatgttatgatttgccagcattctcagctgctgattctcaggctgattctacttggttggtagaaaatctacttatccaggaacaggcgacggaacatacgaaggacacacgtcctacgaagcaatatgagattctcaaaacagggaaggctacggatacacatggggctaggctaacaagtatcttcgtttgaccctggattgtttcattccacccttccctcttctaactagtcttctcttatccacgaacggatagaactctgatcctctttagccccgagaaaggaagatgagctagggcaaagagatggcaatacttacttaataggtattatgaagggggaaatcaagctttatttctctttatagtgaagctagcctcttaggcgcagtgtcagacatcttagctatgtagggaatagcggtcagtgctgcttgattgagtctttgtcttgcagttgcaggagtgatgtcaaacctcttgcttgagttgtctgtattggaagtcgtgtaagcggcttcttccgccttccgggtctagtacgtatgaaaagatgtcagcgtcgtggcgattgcctttcctggtggtgaaggattctattcccgagcggctaaggtccaatccggtattctatttcgtctgtgcgagcattaaaaccaaccatttccgacgtcaagatcaataggaagaaaagggagtctttttctgtcttgaaggttttattttaaatccaaatcgaaatgcctaaacttgataaattgacttatttctcacaattcttctggttctgccttctnctagtaagtagctcacgaggaatggggggacagattccctcaatctcgagatacgaacgtatcgtgtcaaaattattggcanatttttctcagtgttttgtgaccgatagacttaaccttattttaattttatttccctcatttttttgggacttattatggcagaaggaggagggaggctnttnctctactctaattggatcctttctggttgggttccgtttttttttgggaaagcccaaagtttgtttcggtttggagacccaccaagcctgggcttatggaacgggcccttccgatcccttggggccagataattgaaacccttactccgcggcctctttttcaatgggctttggggcacaaaacccgaaccggattccccccgggaaaagagggcccaaagggaaacaacccctttggcctcttattaattccggaagtcccccggaaacaattttggggctgtgtcaaataggggagaattctcaaggctcaaccccgcgnaaaccttaacctaatattggaaaaaaaatgccgggctctacaaccacncatttccactttggttattagaagcctcttagaactcttctccccaagggaatagccgnctctttatattct

SEQ ID NO: 22025 - DNA, 11905 bp, Oryza sativa
  unsure (1)..(11905): unsure at all n locations
ccacccaaatcccccctatctcatcccttctcccacttctcccccctattaacaccccctcctncccttcnccccccttataantctcnctacccccccccccccccccccgcgattttgacactcctggaaacgcccnnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtatgaagaatcaaaaaattgcaaatttgctggttcaaagaaagttcaaactgacctgtcccatctcaacaagtttctatttgacagaccccaaccaaaaggaacctggattagctttttttaaaccttgaaaagaaattcaacaagattggacgtggcttaggcttttcgtgcactaacacatgtcaagactggtacagctttttcttttcctgtattaactcgtgtcactcatgcacatgtactaatcagttaatacattcaaacacatgaaaaatgaaacagattcaatagaagaactcacagccaatacaagcgaaagaggaagggcggaacatggattgcctttttttcctaactatcagaaggtcgttgctgtctttttcgcattggatttctttcacgagactcggaaatcaagaggatgggaacgactactgctcaaacgcataggactgaaaaggagggagactctcaaccagagccgttagcagaggaaatctttctgcctggatctggaaaggtccgtgccgacgacttctgtcacaatccagatcttaaaacgacaatatgcatttctcaagactgaatgatattctcgtctttgagagaaatcttcgtgcttatcgatttccttacttggatgatttggcagttacactatcagtttcatccatagctgatcgatatacatctcgggcagtacgaacgaacgacttccaatagagcgtcgatctatccaaatttagatagaacggaaatagacttgtaaggaacagccgtcgaggcagtacgaccagtagcctatggcaccaataaaagacaggaagggactagatagactttgaatagctcaaacccgaaagaacacacgttttgcgaatcgaccgaaccagatgaaatgccattgaaggaacgttgaatgcgataggggcggtagtatctacatcccatctgatgatgaaatttatcccaacggaagcaggagtgggagtagagtccggtcaccataaaatggcgaggttatgttatttgatgtctctgaaggggaagaaggggcttgtggcagcagttgagaaggaagaggtgatataagaggatccatgggacgaaccgagagaaggcgaaaaggtaaaccgttagacccccgaagccaagcagaaggaaaagaaaatgagtgagccgactgaagaagtggaaaagtgggaggtgcttccgggaaaattcgtaaacattgattgcgggtagaagaagggaaagggagatgagtgtgagggagcccttttcaccattattaatgaatttttccattagacctagctcttgaaaaagtaatggaacatgcagatgggcagcaactcttcttttacgctaggtatgccggtgatctagtgtttaaggttttggatttaggacctagatgtcatcgaatgaatgctcggtatacttgctttcggaaggaagctaatctgaacactgaatctagaagaaagaagcttttctattttgagagatgaattcaaagagagaaggttgtagaaggtaagtaatccgatgcgcgttcaaatccaacaagaacgtctaatgaaatgacggaagatgcatattattctctcgtagctggggctaagaacgatcctcttatccaactttctgtctgtcccaaaaccgaaccttgcttctgcttctacttgaccggtgcttgcttattactggcattagttagtagcctagctagcgcccttctgtgctattaagcatatcttgcaaacctactgaatgttgaatctcgattgatgtcagaaaccaaccgtagaaagagaggtcgaagcacctgatcactcgttcagctcgtttttcgctcgtgcctgtatggaatgcataagtcattgtgttttggcggtggagaagtacagaagtaaacagtgtgttagtatttagttgtgcgaagcgttgttgccaagacttactcaactcacgactttcacctgcttccggtgacaactaccactctcttatgaatgggagggtagagtaccaagacatagggattagccagcgaaggcggtttatttagtacctttacttggtaaagcatgagaggtgtgccatcttttgccgaaagtgaagaactcgagcgcttgcgagcccaatttgatagcgccagggccgatttaaacgcatccttagcggaacaaggcttcactcctaaaatgaaatcgttagggacccacgctcaatcgtctctgcgcagtcagtccctcgtgcagcttcgaattaaatatatgatgtggtctcgctcattttttaagggctgtgtctttcggagttatgggctcttccctgtgtccgcaaagagttctgcttaaaactatcgtgtctgcttgatcctaagctgcaaatgagtgaaatttggggttgaatttcgatcataaacatggcttcgcttcgtgttattggttcctttatctccgtcttattgggaaaatggcagctcgaggagggcccgactatatccaatcttactggccctatgtgcaaaagttttcaagtcaattttccctcgagtcagtgtcacaaactgagaaacaagtatgatctccctatcgacaaaagtcctactttttcactttttagtgtattttatatgtgctatcatatatatagtgagtgtattttcttgtcgtctggttgatagaaagaacccggaatcaaaccggtgaagggagtcccgagcgcacccttccatcccaagcgtccttcctttttttttcccggttcaccacccactcattaaagtggctacgtccggggggcttacttatcgaccacatacccactattctttcccgacgcctcctttctcttgcttgatggaatagttcaatgcccgagctcctgctttgcttgcgttcttcaccggcgctcgccagatgtatcactcatcccgaaaataaggcaaggagtctgcagtttgttataatcattacgggaatgaatcgcatatgttggtttagaattgctcgggaattcattgatagtgacttttttcagttctaggggggctagtctactcctcttttttctcgatcgagcccctcattctaatcgtccagccctcttcacgaacttgtacaatcaatgccacaaagatagcaaactcgattatcgaatatataaggaaaggggcgacgatttggcaccagatatccggaggtgtggaaagagcagctgtgataagcggaaaaaccatcaaaaaacgacgattgctcgtgaaggtttccacagaaagaccccttggttctggcaaacagatcacaattacaggtacctgagagcataccgatggaatgaacaaaatacgaacagttaacataatatagtcatagatcttaggttgtaacttgatcatgagcgaatttgttgatgttgcacccacgaagtatggaaagtgccaaacattgggaactacccggggaggagttaggaacaggaacaaggagaagcgagaaccacttaaatggaggaatctattgtatttctgcctttgttccccatagcaactggggatcgaaaagcaccaaatttgatgacttattaagggaaagacgaagtaagagcatgctattgaagacgttgcaacatatgtcgggggggcctccgttgattgtgtacgaacaaaatacgagtccaaaggtagggtaagaaagggtttagctaatggagaaattgactcttccgagaaccagtaacgcgtaaaccatgtcaaaccaagaccgatcaatatccgaacggaacggattcgaacttttcctagaaaagtttccggtgcgaaattccattcaatgagtaattcaaaggataaatgcattttcggcatgcggtcggtagggtctacttcccccttcctcgcttccgtccgctatccgttgtgtcatggcacagtgggacatctgtcagccttgcatttctcaacagggctatcttcccttttccgaacatagatatcaaaaaatgatgaccaaggaaaaatgagtgagttgattcattctgtctaaaaactctatttctatatgatatgataatatgtcaaaacaagttcgatagcccattcataacacaagcaatccccttctctcggcacgtgtaactattcccctccttgtctaggatttctgtcttcaggaaggccctaatgagatctaccagtgcttcgttttcattcccccagttccccagagcaccgaaaaagcccatgatagaagtattaggattaagactaaaaagaataccattcataccgaactatcctgaataaggtggattggctaaggagtaggaagtttccagagaataggtcccggtcaatcccaatccctcattctgagaatagtgagaaaagcagttactttatcgtctaaatgtcggaaaaatgggtcccctatcctccggtaataaaattccataagataaagcctgccatttaatggcataataaaagacaatggatttatgcctaatccgtatataggtaaactccaggtccgaacagcattattatctatggatcccccttatgtacatatctctgtggagaatcgttctttaatttttcattgcattaaatatcttgaaaaaaaaaataaaattgactttgatatgtagaggtccagaactagattggtatgtacttaaaaaaagtacttactttattttaggattctacaacgaaatcttatattttctagcaattctactactacgaaacaaaaaagaactcgattttccagggaaggacagctttctcttttggcacgagagactgataaggcaaggttttcttattcccatagggcaagctaggcttggcagagaagaaggatagagaagttctcaagtcaagtagactgggctagggcctattactatagtaaaagcaagcttatagtcgtaccacttttcgaggtagtcacgctaatggctggagtcatgctttataagcttatagccagagggaggatagcgtaagcagactagtgaagagaaagctgagcagaattcctcctcacgagatcgacttgtctacttacgagaatatgcatttcgaaatgaaaagctatccccagaaaacaaagaaaacgaataggggcgtagcgaaggcgcgtagcgatgataatgttaacaatcttctggatgagctcattgctcggactcgcatatacttgttctatgctctacaggctaatctgagtaaagaggaggcgcgaagcgtgagatggacgagagaacacacacgatcggcacatagccttcaaagtcgtttttttattggtagacaccgagaagggagcccttgatcctagatcagtaagagaaagacgtaatgaaccggacagagactcccttgctttattcagtcatgacatggagcttcggccaatcaagcctaggtgcggaaataaagtaaatgaattctattcaagcaagacttgatccaaatggatcccctcaatgctgagcttgttgatgaagaaaaagagagctgaaatagagattgtcttcggtccacgcccaggccgaaaccgagctattaatctctaaatacgctaattgaatgtgctttaagcaaggaagtagccgttcaagaaatgtagaggttgctcgaccaaagccggtcaataaggcagatctgaatgccacaataccggctgttcaattttagaaaggcccatctcctgattgtctcaaatcgaataaaactctttagcaattggtctgacagaacggatggtaaggtgggggacccatacctttattctattcccgtgcttagagcgagtgaatgtttggatcatatgctgccttgcctgatcttactagagtgagtttccttcgctaacgagatgatgcatattctcagtctggactattcccagatttacaaccaacaactagtcttatcttagtccatggagaggaaaaagcaaacgaagcacgttgagttatctttcaattgaattattaaatacgaccgtgaaatgcgtaacttatggcttcggtctctctctttcaattctttgaattgctttgctttcgcgcagccggtgcttgtttggccaaagataaccaaatcgtctgcatacattgagtgagtaatgcacggtgctgtcggtgccagctttataccactgatttgaccattttgctgtgctaggctgaacatttggggaagatactccattaaaattctgaacaagtaagggaacagctctggatcccaagacaagacttcctcttaactagcgaggaggtttaagggaagtttccttcaccgggcctgggaaggatagaaagaagtggaatattcaaagcatcctagtaagaaacaaaacatgtcaaaaaatcctttttctgggtccctgagactcttgtttttccattttgatgttgttataggcttttcacccacccgccttattcccttatgaagagaaagttgactaaataactagattctcaagctctcattaacttaaacctcttctttcgcctacttgttttcctgcttgctaagcggcttgtcttgttcgcctcggcccagcttcctttccgtagtgagagaagtgattacactcgaccatcttcgaggctgctttctgctagccatattcctaatctgggtatccttccttgttcaggaattcctggccatgggcggtattcacttgatatcgcgttcacaagcttcttctggcgtacgtaatgtgaggtctttccttcgctccgctactagttctcctgggccaagattgatttggggcatcatgttcaattgtgagttggacagttcgttccggatctgcatagtcagaaaatctcgttccaaccggtcatgaaagttagtggaagtgtatgactgctttctttgttaggtgattgatagagtttcgttttccataactctcgagctcattcatcgtagaaagcgtgcattgtgctcttcctatcgtcgtataaagaaaggtgtctgttttttcagaaagagagcaaagctgccagaaaagtagaatgccgtgaacaagggtggtttaaaatcgtgcgtgaaccccaatttccactcaatgcgataaaagcggaggcctctctctccgggctagaaacaaaaacgaaagtgcttgcattccattagctagaacccgacagtcgaaggcgtctaaaagaactctttatttcttattggctttcatttcacttcgaggtaagaccttattgtctagtgagtggagtatcatttcctctcttatctttgttcttttccgaactgaatagaaaagagaatagctctcgaaattgctttttccttttcttattcttcctttcctttcgaccatcttactttgaatccgggctcgcctacactctgttccgggctggatgaaagggaatagagctttgactggcgcgaggtctttcgcgaattacgattccaaggagggggttacattccctgatgatggattccttggttttatcccaacaatactaccctatcctacctataccggttcatagcttttgagaattctcttaccgaggaaggcacaaaccttttgaagtagtggaattgccaaccctatcttacttttgttttgggaatgctgattcattttccccttttctatactactcattccattctctttgtctttctccaacaggttaatcctagcatctgatcccttaccaattagggaattctgtattcgggtttgtcttaaagtatttatccgggtaaataagggaaatgaactgtttcattcctcacggctttccctccttgctattcttacctttcacctgtaataggtgtgatgctataccggattatctatccgtggatagtgttttccttcagatctgagtatctcacatactttttttccaaagggttctgtttctggtaccgccaaggggttgttcacgtattaactttccaatgatgctcttttgtacctccatatgtatcttttaggcctgtattcaacttactgaataagtaagaatcccaacttactctctagcttgaagcactcttcaggaatttctaagagggggaaagaagtcaaactcaagcctatccgtcccctcctctgggaaagaggagcaggctgttaggcagcccgggtttaatacaacctctagggtaggccgtgaatcacactgtcaaaaacagagtagtttatacactccaacaaggaagaaatgggaaggcttaagaaaagatatcgtctttgatttacttatccttagtaacctacttactcctcaacctatactatcggatcataacgttcgtgatacgtgtttaaaccctcgctctcttttgttcaaagagtgtgtatcaacctatacttggattaaaccaatccctataagtgagtttagttagctatctcttgcggcgttctctaccgggagagctcgatcttccgcatacgttgagtatcgtttagtgtaaactttttcctatgtttaataacattctcccctctaattacctaccccttatcgaaggataggtataaagatacaattgaatagaagaggaggttgtagcagcactcgtatatgctaaatatcatatattaggcccgtggaactgacagcacgccgaactaataatggggggcgactcgccggagtcgaaccgacataggttaaccctatcttccaataaggggaatcgctttggttacgcagttcagttggcgctaacaaccaacttacgtttgcggcccatcacaggcaaggaaatcgttccaattctatatatgaaaaaaaaaagaaagaggaaagcgtaaatcaatttagttatcttagctctttcagggaatcttctctagagccctacctggagtactaggatctttccttagtcctcccagagactgcatgcaagaaaaccgtagggaagaggacaagctggaagaacactcccaagataaactaaaaatccacgttgacgcaatctctccactttttgaccagcagaggaaaggcacacagagggtgcaattacatcaagaacgaggtggaaggagcataagctcttgtaataagtccggttttttggcatcatctatctatggggccgtacacgttagatagcgggaaggtataacatctgccggtaggaagcccatctggagcggtttggtttactagcatttcaggcattattgaatatagttgcaagttttgtttggctgtaggcagaagtctttggttccgctttgttaacaaacgtgcctctctttgctttctcactttcccagaactgctactttcctgcttttagtacattgcttttcgtatcatctatgagaattctcgtttcagaaactcctcaatatagtcgttatggcaattctaaccatgtagattttattaccaaattgtagttttttcttttgccaattccacgcctctgtaaaaaaatgcctaaaagggagggcgagagttgaagtggatggcccttctatcacctgaaaggctgaaactcaggcatggctttacatggcacacttgctttctttcaggctgttttggctcgcaataaagctagggtcctgatcgagcaagactacgtcctatctatctacctctccaaacacaatatcttgagtacctatgatggtgactacatctgctggcatgtgatgtttggacatagaatcgagtccttgtgaatgggcaaagccaggtgctcttattttacaacggtagggacgattactcccattactgacaagaaagacaccaaattcacctttaggtgcttcaactgcggtataggtagaaggagctggtacggaaaaaccttctgtataaagttcgaaatggtgaattgaggtagagtagaccgatgatccggtagtcatttggccggctatggaaagaaaaagcttgcatctgctccccttaaactataacaggtcccatctctctccaaacctaacgtggtagtttcccatcataaggctttccatctatagattgattgagccattacccaccaaggatcccattcgttcagaactcagttgactgcttctatagataaggcggaacgtccttagttcagcattatagcacatagtctccgacgctactacagcgcttcgctaactcgaagcgcctcgctatgagaatgacgcttcgctaacgctcggctaagtcgtcgaaccctcgcgctgaccattcactttctcagtagcaaaagcgcttctctttgccccttaacttaataaagtatttggaaaagaaagagattcttggttttattgctcctcatctgcgctcgtcaagccaacttagctttttgggaggtgaaagaggggttgaagcggacatttcgaaatgacagcatcgaagatatctatatacacaggaacgcttattccggactgcgttccggaaaaagtagcctacttgacagaaagggcgggcactctcggctcggaggtaggcactctcgtctttcaaccccaccgtcactttgaatttagtggggcactgtttacttacagcctctacgagttgcaagtaatggggcccgggcgggtgaacccaagggtcaacaagccttttttgccttaaccctaaacaaaaatggaaaaggggcctcgctaatagggggcaattggtttcaacccgactgggaaggcccccttggaaccttatgtcaactttcaaccaggtaacccggttcccttttcggacccccctgggcggggccccccaccaggaaaggggttaggcgttttccaagggggccaaaaaaactaataccccctttttttgccccggaaaagaataaaaaagaggcaaacctctctctttgggttccccacccgtgtggtttataaggggggcccctcctctggcgggaattggggcccacacccttatacagagaaaccccttcccggccacaaagggttttctccttccggggttccgcgggttcctattgccccgggttttacgcggcctcttttttttagtttttcccccacaagcgagaattttccccctttttcgggcacaaaataggagccgccctcccttacaataaaaggagggcggcgggggccccccccccaaatctttttat

SEQ ID NO: 22026 - DNA, 2552 bp, Oryza sativa
aaggtgttaataaaaaaggcccgatataaaatacctctcgcaacgcgggaaagtggtgaccccgcggtacacatatcttttaaagagaaaaaggttcttttgccccttatataaaaatgtttgaaaaaaaaaagtttggtgttatatgccccatagggcgcggaaaacaaatttatttttgggaggtaaaaagggtttaggcgacctttcaaaatccagcctgaaaattttttaaacccaggacccttttccggatgggtttcggaaaaagtagcctacttgcaaaaaaggcggccattctgggtcggagtaagaatttttgtcttttaaccccaccgtcactttgaatttagtgggcactggtttactaacagcctcaacaaagttcaaattaaatgggcccggtgcgtggtaaacgaaaggttccatcaagccatttctggccgtaaacccggtaaacaaaaataggaaagagggggactttactataaggggccaattgccatccgcacctgcctgtaagggacctcttgatacctattgttcacttcataactagtagcgggtttcctgtcgcgaacccagttgcgcggagccccaacgaggaaggtgttagtgctttctcatggggtcaataatactaatccctctttttgtgccgggaagaagataagaaaaggcgaagccttctcttggtttccccacctgttgcttctaaaggctgccctctctcggctggattttggtccagcctactacgaggatcccgtatcccgtacatcgtctttctccctcctgggttcccgtggttcctatgccgccgcgtttcccggtccttttcttttagtgcttcgacccgaagcgatagcttgacgcgttttccgtgcataagatggcagcgctccagctcactaaagaatgggacggcagtggtccgccggcaagctcgttctgatcttggacgcagtacattggaatcctgaagcaccaccacgaacgctaccgcgcgtgcgcctgcggtgcggtaaggcaccaccctgttgtgccagcagccaactccggcgtgtcagcttagttatcctcatcaagccacaaccttgatgtctagcttcccaactggtagacggttccctttcccccggagcaatgaagaagggagaagtcagttgattcttccgaagaaccggaagcgaagcgctatgccggggcgaggggacgggaaaagaaactgctccgaagaaagatattggggttcccaatgcttctccacgcccaacgagatgcgccaacctcgggatgctttactcctaaccccacgacggttccgagacggagcttaacctgagtctcggttaagaacggcgatgatctacgtttcacacggcgcacgattccatggatagtttcattcgagatcgtgatggaggacatagcttacgatcatcggctttgatcatgccactaggcatttgattaggacattgcacaatgatccgtacactttgtcgcatctcttcgatacggatacagtaacgatcatagcgatctcctctggtacctactggtacgtcaagatccgattggtcatgaacatcgtaaggtgctgctcttcgcgaatcccagcataccccaggttgggatgggtaggcccaccacttcactttttcactttcacttaggcccgggccaagtcagtggggggaccctatcgggctccttcccccccaaaacaaactgtacgtgggagtttcccttcatacggctcgaatcattctcagatgccacgagaggcatctttccttatgatctggtggttcacacgcgcgcaaacgagcaccggccgcaacagcaaggaactatgaccaatagagtcagacacagagcgtcatacttctttatcttgtaatggttgaggagtttctttctcagagggtgcgggacgcttgcggagtccgtgccttccgtaccaccacaggtcgttcttgggcagatcccgctcctaaacataagggagggatagggggaaaggggccgggcctatcatataaatagggttgtagaaagaccacgtattttcattcgacgttccggggattcgatcgacgaatttggcgagctgatctgctttgatccaggagaaagcccagtcagccaccttttcggtgcaggtcacgtgacctacagctcggctttcgctttttgagacttcctctacccacatctctatgtgcccgcagcactttcatatggggaaagatgggcttaccatgttccatcaatagcacctaacctatgccgattttggcggaccgtgctccaccccggtgaactcatgcggttccgacgtgcccagaggccagaggcgaatccgttcacggtccgtaggaccaacaccattcgaaggttgatggcccgccccgcctagaataggaatctttgactgggcttacgcacattcgctcacttacgctgtcccccctaagctcaccccagccccgggtacgttgtctccaaggcttcacacaaaatcttcagtgacaaaatagcatcat

SEQ ID NO: 22027 - DNA, 9482 bp, Oryza sativa
  unsure (1)..(9482): unsure at all n locations
cattaaaacacactcttncantgtctattaacgtcgtntttaattatattaaanataanttnnccctctttcactttnggccgctttnatanaaaggngcncncatttannagcctgtctaaccaatcctcccccccccncncccccatgttttgtagacctctcntnnncncncgnnnnnnnngnctncatgtcgcacgacctcttaacattacaccactgaatccccaatcctttgcttgctgtgcagtgacagtaccaatatccactaatcgttgtttccagatacggttgccggttgacatctcttctaattcgtcgatacgagaagcaaattgttgtgtggaggaatcaatatctcgacataagccaagaggcagatcttgtgccactccaccaggtcgtatgaaactggcatgcatcctggctcccgggactctttcatagaattccaacaatttctcccgctcctcaaaagcccaaaggaacggagttgatgctcccacatccatagcatgagtagttgaagcaagtgaatgatttgaaattcgagttatttcacagaataacactcgtatatattgagctcgtaatggtacctcacaattcaaaagtctctctacggctgaagaatgagcgtgttcttgggccatcgtagaaacatagatagggtcaactacggaacgaacaacgaaactttacgacagctttttcgtacacgttcacttgcatcacatacacaagtgctctctgaaccgtgcaataaggtcacccataacacggctctcccactggagttaccttagccccgggccatgctattccatgatattggaaaaatggcagcctaactacttattatcatcgtctttaaagctgggcgccttttgaatatgagtggggctcctagtctaggcggcgccttcgtggagccaaaccgaaggaagagcaaaagggcgaggccacacccggcttcgaataggagggggcttagctctggatcccgcctgcttgcagaaatgaatggatcagaaaggggttctatttccgggccgggcaggaggtgaaggccagaagaagaagagaagtgcgccttcccggtaaggaagaggataaaaaggtgctgtcatctatctcgacctgtttcccgaggcgttggaaatgaagaccggctcggagaatcactggcgtgctttctcccccccatcgtttcgccaacaaagaagtcatccttgacttgacgattgaccattccatccctaccgagccgcctcttcgaagtatttacctctgcctttctttttttagaacatacccttcaaatcaaaaagcaaaaatcaagaaaagttcctcgtctgtgatttaatcggccctaagggagtttactcgacccattctccagtctcccgcactgctcaagtgtgcgactccgtatgaggacctccttcccttttgctctacccactctccattcacacggttatcaaagcggaggaagggtgggcagcaggtaccacgagccctctgtcccacacatctatcaagaagcaagtgtagttcaccggttccaccgaatgctcctatctctcggcaaagatcgtgtgagtgtgcagttatgcttcggatgcttcgccatggaatagatcgactcagttccccttcttttccggtgcactcgctttgtatctccgacacacaaggaaggacgcggtgggaagaaagctgccctagcctctgtccggtcgatcattccgctggcatcttgcattcacgcctccgtttgactgccgctcgggaatgtagttgtagatacgtgagtcttagtgggtcgttggctccacctcttatctccttctacgacatgctgtagtcgtcgccatattcaatatgtcacttagtcatatctgccttgcagcgggtcagcacctccgaaagaaagggagggaggacttcattcagtgactccgcgatcgccctctgaacgatcaaaataaggtaaagcttgaagataagttttgtactcgattaatttctcagtccctctagtcgggtgggcgccggccggccggatccccctgaaaaccgtacgtgcgggtctccccgcatgcggctcacgccatttgaggtggcccagcctagcattcattcgcaaatcctgtagtgaaattgagactgctcgacctcggaagctaattcgcgtgtaggtggcgctgtctgtctaccgttgactgtatctattcattgatacattggctcacccccccccctctttttccaagaatgaatgagccgctcggaccttccatttccgtcaaatgacccggcttcccctggctcttccaccgtccgggctccctttcctccctatgctcccccggcgcaggcccaccacgcttcgcgcctgcggcgttttcgccagacggtctttgccagtagtgccatcctccccgcaggctgtctgtatgggtgggttgtcccttgctgctacgttctgttaggcgctatgaattacaggaaattaagtggttgacttggacagcaggcgggttacacgttccactgtgccgagatgtgaggtgcaggtggtgatgatcaccccggggtatgcgctagcgcccttgacgggcactccaggatccgcctacgctcgtgaaaacccaggttggtcctccgaccagatgtgtggataacgaggccaccttcacaaccttctcccttctatctttatccaaagtcaggtagggcggttcgcttgagtcgctcaaccgtccctttgcccggtgctcatgacgcgctacggaacctccaccgtgctagcggcataggagcctactcagcgtcagcggcttcgtgccgcactggagtgatccaatatgtggttccgcacgttccaccacttctccgttcatttccaatactgatcgtgaaacaccatgagcagcaggatgttgaggtccggaattcgaagtgaaattcttgatttgcccgttcctagtcgtcatgggaaagaaataagaaagaaataagaaagagattattcccctagagcttgtccagtaccaccagtactcaaaatgcatctccgcgcgtctacctggcgcttttattagccgccttgcatgcaagcgaagcgctattggcggcaattaatagctcactgagcgatgattgatgcagtcagtcagtgccctcgattattcctgatagaaggatcatggcgccccggaacggaagcattccatccagcagcagcatctccttcaaccacgcgaggacaaaactgatgttagctacattcgagcgttcaccgcacagaggcgatctcgaacactacctatgataataaatccaaaggaaaggaacaagcaacggattgagcgcactagcgcgaaagaacaagctgcttcttgtttagggtcttgactcttgagtctgagagggagaaggcttcccgcgtgggcggattagcaatccctagtcttccataacgcgtattggacttatgtttcctcctcctcgaagatgatggatctatctggtccggttacgaccattctttatggctctgtaccaatagtacagattcgatttaggctctttaaagaatcacccaactggtttttttgctttttagcagtaatcagaaagttagctctttttccagaccagtggccttggagttcatccccgtcctctgccaggtgagaaggaagatgagagatacgttccttagaagtcgtcttcaactttcttccaggaaagcctttcaccgagcgagcagctaagcgagttcatccgcatctgttgtcgttcaagtagttcaaggttattctagtgcgtacggctgggacttctcttaaaaccaccaatccaaaagatctgtcgaccatctatgactgggaaggaagtcactaacctgagaaccgagaaaactatgtaaaagatctgctctcttgaaatagaaatcctttacggaaaaatcttctgtagcttccatgctcttgaattcgctcgcattctctcgaagattggaatgaaacaatccgctattggaatagaagctcttcgggaagagtagcgggtgccatcaaaccctgcttgtgacatagacttgcttcttttctggtcaatcaagatctccgcccgcccaggaaatgtttctcatacagaagttccttgccttcgctgttgggaacacagcttgctttctttatctttctcaataagaatggctaccacctcctgctggatcttcaccttctggagttctttcaggaacaggatatgtaactaatgaagcaagtccggctctatcaatctagagctactagtttcacaactgctattggtggtcaactagtggtggatgctttagctaacatactggaaacagctaaatcaaatggggtgattcatgggcttgtgccacacctagtgcctgtttccttacctgctctgattctccttggccccgctccgggttgatgacagctacaaccatcctccctgttttttctaaccagctcactatccgaattccgttgcttgttctttcgaatgggagttgactttccttttcttcttaactcctaacaatcatcctagccctagtccatctatctctgaatccgagctcgccttcactcggtcaagggatttacctcgttccgggttgatgaacccaaacctacaacccttgcttttctagatccgggtatctccattttcgtaaccagcttgccttctatctccacccacgaatcgaattaacccgataatccgtagttggcaacccctgtcaatgtatgtttgatttgggaggctaccaattctggaatttcttctcgagacatccccgtcagtcaacttctcttcgggatgggtcgttggtttttgtggagataatgtgtcagccatggtagaagtagctccctgagtaggcatgagcgcccgcctagatgaagggattttctcatcttgaggtgtcgggaggagtaaaggagattgactcttctcagtcattagcctttttattgacactagctctttatatagtaatttattttttgagtatcgtatcggtaggcacagatcattggtattggatatatcgttaggttgtgctgagtcaaatcagctccgctgatttttttccgttgcagaaaagagaccccttaccctttttttagaaaatgatgaatatgaagtccgggaggctgcgggtactatggatcctctgactcccaatcgggttaccttcccgggtctcgccggtgttgcctgtaggtcgtgatgtgcctcgagatggccgtctcctgtctccctgctcgtggggaatccgctcctggggcgtcgctctgctgcgtctggcccgtcctctaggcacctttggggggcagggagtgtgacaacgtacacgcttccctttactccatagggccttttcctcagttgcagggtttggtggcccgaaattgacttggcttcgccaaaaggccccatctccaaagcccggctcgcgaggcgtccctctcgctgtagggcggagccccctcgcctcgctcttgtgacatgctatgtttcccttcttccattctcaagtcaagggtgagtcccatgcgtcagtttgtggatcgcggtctcacgcactaatctctacaggtgcccatagtaggccggccgccctacctaaaccaatcatcatatcggtccctaggccccattgctggaaaggctcggcttcaaaaccgtacgtggagcttccgcctcatacggctcctctagggatgggggtaggcccagcccaggcttgtgcggttaaggttgttgtacacgccctcagttgagcattcagttagagacggcgatcgtaggttcgccggaggagagggtgttgcgagcaagattgcacaaacaaagccctcctgcccgcagccctattctagaaatttggctggctacgttacttataaccgcagaacgagcaatgaatccccaacgacaaacgaacaaggggcggggcattttcggggagtagcccccttcagaagaaacttcctggcacatacattaagggagccatcgaaaggtgactgaaacacctgaaacggggactacccgagctaatgatagaggcaagaacactttccggccaagtcccattaattgatcataacgatatcgtggaaatgctgcacggacccatatatatagaaacagaaaaagaagaaccttgatactaaaccagatcgaacaagggatcttcttggaaatgggaagatctaggataggcggccaacctcctggaaagagcgatgtgcatagaccgggtgagtagggatgcagctccgtggaccgctcgtcgggcctgataggtggtggtatcacacccttctcaaaggaaccgtacgtgagactctcgcctcatacggctccgtcctggaatctgggcccccccctttcctttgaccaacgggtcctcgaacccatgggggttatgaatcattcattcattgattgattcaaggtagctttagccattgtgggtagaagctagtcgccagaagcgaagcgatcttccgggccggaaaggaggcctttttttgacgcgtaagctaccgcaaaatgaatgaaggaaaaaggcctcaggattagaaagactaaagaggcatggagggccgactacaagactacgactacaatacaagccatgagcgatagcgaagcctgaaggctttttttcgaaagccccacaactagctatcttatagcagacaactaaggcaagcctactcaactaatctcatgtaaacgcctgttcgcaaaaatccaaatagaaaaagacaactacttattaaacatgtagttgagtgctccgtcgttgttcggatcttgaccgagcccaagcttcccaagctctatgctgtttgggaactccgcaagggtcttaccaccttcttgattgactatatttgagtctttggggtactttgggattatattccgcgccgaagatttgtgcttgtgggctagggtgaatatagcggaccagcggatctagtagttgacaatcgttcggacttggtaaaggttgtcgcagcacctgtagtaggacagaggacttatcgcgatgcccgcggaccaatttactatgtctctgtcgctgacgttggtcaaagaggccacgtggattggcctgggtcttcttcggctaatgagacctcgatcccgaagccttcggagtatctttttgataggcgcctctatctgtatggggaattcgctgctgaaagatcccgcccagtgcccccttccttcccccgccgccttccgaccaaagggagtatacaattttgtcttcaggacactcatgcccgatcgtgagactgcctgttgaacgcctgatggcaccttgctctgacctgagctatgcaacaacgggatcccccttgatctttgccggatgtgcttgacggtcccccataatacgctaacttggggactttttagtccattttttccaagagtctccgctagttgaaccgcgtccagtagacgacctcttccgctcatccccttcgtcagctctttgatagggatactataacctaggtccctaaacttggaatggatggcggagcgtaggtggcaggcagttatatggatacggtgctttacccgtagacgcttctccagctctcgcaagaattgtatgggagtcgtcctcggggggacttcccgaatgaccgtaccgaggaattctaccgtactccgtgcagctatggttgttgattctgcggagcccacccaaaggttcaggccggattgtaggaagtgggtgatacgtttttgtatttctatgagaagaaatacggcacccacgattcccagtagtaagtcgtcggcatatcgcgcgtaacaaatccttattaataaggaatggcttttaaagggggccagcttacgggccaggcctctctctgacctgataactagtatcgcctccccgcccagctctatcagcaggccccttcttttgcaatacttaagaaggtctctcatggccaaattcttattaaagccttctctaccattgaattcggccctcggggtcaacccagcggcttctatgaggaaggcggcgcaaaggaggctcgagggcttgttaaggaaggcggctagggccgctgaaggggggaaaacaaaaggcgttttctggtctccccttcgcctgggggtgcttgtggggggggtgtgccacgacgaaacaagggaatgaaaggttgctttgcgttggatgctctttaccctccccactatgagggctctgttgtcttggggagcgttgaagcctgcttcttttccatacttttcttggtcatcaatacgacgacctattcttaatagaaccgatctgattttctgtcacgtcctgataaattcatcccaaaattaaaattcattcgctaaaaggaataatagaattaattaaaattcgaaaagaaattggcaaacactaaaatacgtacaagaaaaattccaatgtggcccggagaatttttgttaaattctccttggtctaaaatgagccctcaaattttacttgaattttcagagcaccggaaatatttattaaacaacaacaacaattaacaaagtttattaaaaagaaaatctaaaaataatcctccttttcctttgggccaagtttggcccaaagtctcccctctctctctttcggcccgcggccgaagtctccctctcctccctctctttccctcctctcccgggcctcccctaacccttcccggctactaactcaccgctcctcctctttccccaaactgacttctcctcctcccccgtacctgtttctaatctgaccgtctcaccctccttcctgtcattctctcgcccacccgccctctcctctcttctaaccctctccctcccctcttggtgcttccccctaatagctcggtgagccccatcttccttcctgttcttttaccttaccgtttcctccccccccctcaaaccacataaccttccccccctctaaagtccggtttccctcaccctgtgaacatccctcatacccctcatcgcngtatctcctctcttcaactactcccccctccactgccggacatacctcctccctttcataagcgcatcacgaatctctagtggagtggtgcccctgtaaatcaatcattacacacccatctccggagggccataccatctcccgtgacatactctccgtatcactctntggcgctgaactaataattcgtcttccctagtgacatgaacttctcacgcacgctagctatcatcatctagattcttgcgctcncggtgactccaaatcgtatgactcttcttcgccacaacatcgatcctgtctatccactgctcacgcatgtcttatgtctcaccttatcacatgantcgttaggttccacctctcccactcc

SEQ ID NO: 22028 - DNA, 1740 bp, Oryza sativa
  unsure (1)..(1740): unsure at all n locations
gccgccggccgccattcccgtcgacgttcccgctcctcccgtggccggctcccttccccatcctataaaatgggatcctcatcccccgttctctcgttttagccccatcccgagcctccccgtggtccctagctccctccccaccgtcgccctctctctcccacgttgccggccggtctccagccgcctctcccgcctcgccggagcgtcttccggccgcgccgtcgcctcctccagcatcgcagctgccccctctccctcggcctaccctccgtttcgcgcggtgaccgccggaggcgcgttcccgccgtcgccctcctctttccttcgcgccggccgcctccagccgcctctatctccctgcctgagcgccggtcgacgtcgccaccaccttcctcggctccacgacgccgctctcatccccggcatcacctcctcctcgcccgaacttcgccggaacgccgtcgtctccgcgccggcctctccttcctcctcgtcggctcgtcgccccgctgcaccaccaccttcaccaacgtcgtagcggcgtgttccacgctgtcccctcctcctctcagccgctgctgcctgccttcatcgtcatctccgaccgttctcgtcgtcgacgtcccgtcggtcgcccggctcgtcgtctcgcggcgccgcctccgtcgtcggcatcgtagcggcgtggtcctcgtcgtcctcgtccccgtgcagccgctgccggctgtcctcgtcgcctcctcgccggtcccggtcgtcgtcgtcgccctcgtcctctcgtcgttcccgatcgtcgtggcgttcgtccctccgtcaagccgttctcgtccgtcgtccgcgttcgtcaagcgagtcgctgcagccccgtcctcgtgttcgtcctcggctccgcgtcgtcaagcctcgtgccggccgcagctcgctttcgtccaaggatcgccgccgaagccgtcccctcgccgttcgtctccgttgtgcccgtctgtctccgccgcgcccgttcgtcgttgtcgctcccacgcctcgtcgcgtggtggtaaggttccctctccctcgctgccctgtcctcgtcctttcggtgtcgcccgtgccattgtgcggttgtcggccccggtacccgtgtatcggcgtcggcagacgttcgcttgtgcgcgtggtgaccgtgttagtgtgcccgctcggtagccgcgtggtttccacgtgtgcaggccgtgtggtgtctagtggagtccgtttgttggccactcgcctcggttgacacacggggtccgcttccgtcgacccgtggaccgtctctgtgtatccggtctaccgcggtcctttaggttgacatgtggggtccgcatgtcaacggcgcagccttcctgtcttttccaggctagcgcttacacatgttttataaatgcaaagcttaattataaaaacaggtgtaagcgctagcgcttacacctgttttataattgcaaagcttaattataataattcgcaaatctccatataacagcattaaacttcggatgatcataaactggtcatacgagctctgaatcgacccgttcaagtctcgtaatgtttgttataacttnnananncnnnnngngggnnttncagatggttacctctctttgggggnnggaaaaagatacaggatgctaataccaantncagtgttcacaataccaatcgcggattccgagacacaggatttacgtattcnccacgatggaacgtttgggc

SEQ ID NO: 22029 - DNA, 1514 bp, Oryza sativa
ataggtcgggttgccagttcggtccgaatcatcgtaagccttgggttaaggcaggttcgtgagggttcacggccttgtttaataatactgggtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatcttttcccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcaaaacaaacaacacatcaacaaaaagagttagttcctttaaggtcttgtccctagttctggtctcttctttccttgtatgcttcctctctcaacccctaccttgtgacagatggataacactggtaacaaaggctatgggaatgatggatccgatgactcaagaacccaaaccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgaaaggaagctagggttgattcagtgcaccgaccaggagcgggtaggcttcgcaactcatcagttggttggaccggcttcagagtggtgggataactacgaagcatcacagcc

SEQ ID NO: 22030 - DNA, 2328 bp, Oryza sativa
  unsure (1)..(2328): unsure at all n locations
atagaaaagagaggtatagttctctccagtgggtgtcctcaatgaaacaagttcngtgttccagtgtcaattnacctgcacaaaacccgagagagtttttcttcancctatattcaccccggaagcttcttcaaagagttaatcttccacttccggccaacaaccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatagaatcctttttccatgcccgtgctttgacctctttctacgcataagttaatgtcgatccaaaggaagccatttagatctgagttcaggaaggaagtgaatttaagcaagagagcgataggatagatataaagcttagaccaataggcatcttaggaaagccggtttttaggaaaaaaagtatattagtatactacctcttggagtttcagttgctatccattctgtttgagtgccatatagcttttcctattcagttctagaactagtggttacagcgaatgagcaatcttgtgtatatccaaggtaaagggcaagagactctgtcaattcatccaatgagtaagcaggacagtgaagttagaaatcctttaagtccctcttgaatttaagtaaactccggccctcaaaagtaaacaagttttcaagggtaggggtagcgtttactagccagcaagtaagataacaaagctctttttttcaataagaaaaagtagtagtattccacgggtctcaatggaggagaactttcctgttcatcctactgcataggcaagatctcatccttctttgaatctacgggctcaaaagagagctccccactaccggaaattggggtccaaagactatctattcgaccacctggacacggcgaggcgaccccacaagagagatgccgaagaatatgccctcctcaacgggtcaagccctcgctcagaactaaatcatcctgcggcactcactgcatgagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccggattaaactccactcaaagggcccgtaataccggtcaccccccagaaatccagggcattaccccccgaaaagcacatgtntaacccaaaggcccaccacaaggcccagaaacccgtaaaaaggccgcggcgcgcggcctcttccccaacagctctcccccccccgccgaagcataacaaaaaccaaccctcacgccaaacggggccaaacccccccacggactattcaccgacccaagccgtttccccctctgaaacatcccctcggcgcctctcccggtccccacccttgcccttaccgcgtacccggtcccctttcttcctctcggaacggccggcgcccttcaatacctacacccgaagcaacccacccccggtaataggcggtcctccacatctgagccgtggcccccaacccccccttaagacccccccttgtccttaccggccacttactctcggagcccaccccctaaaaacccatcttcccccccctgtaacgcaccgcgtacacgacttctctacaccccgctcttagccgttccccccacacctttaaagcg

SEQ ID NO: 22031 - DNA, 2073 bp, Oryza sativa
  unsure (1)..(2073): unsure at all n locations
aggtggtcccccccgtacaggggaagcgcctgtatagcgggaggggccccgcggtgaccctcccacaaccgtttttttggggcgggggccctaaagcctttatcggggccctaagggggcccccattttaagtgttcgggggaaccggcgctattgggcggaagaggaggagaaagacccaaggggcggggcctgggtggccggccaagttagcggtcccgtggcggggtaccacccccgcggccggcgcttatgggcccggctcaggggcgggtcccttcggcctgtcggcgcttgccgttttttttcccccgagccaccggtgtatgggcgttttttaggttccttttcgcggggggttgggaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccttcactcggtcaagggatttacctcgttccgggttgatgaacccaaacctacaacccttgcttttctagatccgggtatctccattttcgtaaccagcttgccttctatctccacccacgaatcgaattaacccgataatccgtagttggcaacccctgtcaatgtatgtttgatttgggaggctaccaattctggaatttcttctcgagacatccccgtcagtcaacttctcttcgggatgggtcgttggtttttgtggagataatgtgtcagccatggtagaagtagctccctgagtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagctccttgggggctctttctgtttcgnaccctgtcctttaccgagataacgggcgctcttttttcctttttgagaagagcggggcgtttttaaatattaccacggtggggtgtctcaaaccgcggggtggggccgtcctccaacagtgtgtgtggggcacaacacccccgttatacccccgccgggcgcgctttatgcggaaattatgttggggcgcccccctggaaacagaattttttctccggtagcacacctgtgtacagatatacn

SEQ ID NO: 22032 - DNA, 1821 bp, Oryza sativa
  unsure (1)..(1821): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattacaaaggcacttcaggcctgacaatcaaaaataaacagcagcggactagcgggcctacggctccatcttcacaggcgctcaactggggtataagccaggactccacctaagacatcttctccaaagcttctctttctgaagggggaagaaagatagagcaagattgagtacaaccacagtactcagcaagtcacaccggcagatgcatgattaatgcaaaggagtacaaggggataataatataggggttaagttttgcagtaaacagcctttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggtccaaatcatcgtaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggattacgcggaaagacattgtagcaaaagcccccaaaggcccgaaccgtaaaagcccggtggtgccgttttcataggttccgcccctggcaggttccaaaattgacctcaagtcaagggggaaaacccccgactttaagaatccggcgtttcccctggagatccttgggctctctttccaacctgcctttccggaaaccgtccctttttcctttggaaaagggggcttctataatcacacctcgggatttacatcgggagagctccgccc

SEQ ID NO: 22033 - DNA, 2212 bp, Oryza sativa
  unsure (1)..(2212): unsure at all n locations
aaatcccacgggtaagttccggaacttttattacacaaaggtgcttgccaggggataacaatcttggccaggggtgcaataattcctctggtatccccaacagcataagggtttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaacccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaactatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtccaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactcttcggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagcttagatgaattagttatgaatttttaaagaataaatcggattaaaacacttaaatcggtttaaattgaattatgacgcaataatgaattatttttgaaaaggaaaaggggatttattgcgtcagccggctaaggtttgggtggaccggcgcacgggcggcggttcacacgaacggacggccgagatctacccgattcaagatggacggccgaaaaccgacccggtccaccgcggttcacggcggacggcctttgatgacgccagcgatgaccgcaaccgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaaacaagggcccggaggacgagtcggggggaccgataaaagctccccaaggcgcggaaaacggttttccaaaatcagggcgacacccggaaaacacgcggcccaaggcgccaaagaggcgcaacaccaaagagcgcgcggtgggggtaacaaagggccgcccccctgngcgcatacaaataatcctctaacctggggggcaacacgcccggccttaatcccccg

SEQ ID NO: 22034 - DNA, 4205 bp, Oryza sativa
  unsure (1)..(4205): unsure at all n locations
atttggggagggggaaaacctaagagcccaaaagcccccttttacttctggaaaccccccgttgcgaaagaagaagaaacaagaagggggttagagcgccaaaatagggcccacgggggaacaccccaccaccggtttatagcgctaaaggggggcccttaccttagggcgactatttatctccaaacacaggtgaggggttttatttctttttcgggggtagatcaaccctttttccccaaaacgaaccggcccctggccatttggtgtatctaggccaccttcatccncaaatcaccacgggtaagtcccggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgctgatttccctttctcttgtcaactacgctatttctcaggagtgcctacaaagcataacgaaagatcatgcgttttgattccatttattctcttgatttgatgacaggaatatatatttccatgatagacttgatctagtaggtggagcagcacaaacctgtgatctttcactggattcagcaggagataagtggaatgtgttgctgtgtttcatatagatatagtagagtggcgggaatagtatagtaagctatcctccactatcaaactagggggctatcccttttaggctttggattcttatcttcctacagcaccaacttcctactactatccctttattctgggactcgagggtcttggatggtaagatcactaacccccagcacccttacccttcggcttgtaggattccactacttgacttgagcttgctttccccactagatcagtctactatacggcatgcagatacaggaactggatactagaatcccgcttttcttttccctttgctgctaacttctttgaccttcttgctctgcctgctttgaattacatcttgcttgggtaacacattttaagttaagtaaattctacatgtcaatggtctgaaagagtgttattgtacctactaaagaaatgaaaggccgattacttctccagataccggattctaggaaacaagcaatacttttccagctccgccgaaaaataattcaaatatatagagataggagataggggaaatcttcccttgcgaatctcttcttttagttgatagagtgaggtccacatatggtgcatttgactcccgtgcatgctattttcgtgttcatgatccatcttagccttcttttggattcccctattggtagttcccactagcagatgtgtgtttctatggcataaatagttcctggacttcccttttctttgcacttacttcgacttcgatctgtccctgggtctcaccacttccttcctcaaggcgtatcaatagtagacctagctcgtagtcacttgcatgcttttgacttctcttctctgtgtgatatcgctatttgattttctccatctgcagaaagatgatacgtgacttccattgtctggctttgattgtgtctgcatctgtattcgctgattctttaatattgtaatcagttcagtgtcagtttaccagagcttctgcttccccctgcggcttgagcataagattcgcctttattatttcggctttggctgccttcatccccctttattattgctgctattgctggaagtcctgtttcattttggctgggagttctctgtcagctagtgggagtcctgctattctcattgtaggcgtagttgcttctttcatccagcccagcacgccatagaatcccttttccatgcccgtgctttgacctctttctacgcctaagttaatgtcgatccaaaggaagccatttagatctgagttcaggaaggaagtgaatttaagcaagagagcgataggatagatataaagcttagaccaataggcatcttaggaaagccggtttttaggaaaaaaagtatattagtatactacctcttggagtttcagttgctatccattctgtttgagtgccatatagcttttcctattcagttctagaactagtggttacagcgaatgagcaatcttgtgtatatccaaggtaaagggcaagagactctgtcaattcatccaatgagtaagcaggacagtgaagttagaaatcctttaagtccctcttgaatttaagtaaactccggccctcaaaagtaaacaagttttcaagggtaggggtagcgtttactagccagcaagtaagataacaaagctctttttttcaataagaaaaagtagtagtcttccacgggtctcaatggaggagaactttcctgttcatcctactgcataggcaagatctcatccttcggcgaatctaggggctcagaagagtgctccctacgacgggaaattggggtccaaagactatctcttcgacgacgtggacacggggaggcgatccgacaagagagatgcagaagaatatgccctcctcaacgggtcaagccctcgctcagaactaaatcatcctgcggcactcactgcatgagctcatagggcaagatgaagagaaggagaaaggctaaagagatcgtcaacttcaccttggcatgcttccatcagcgctgaaaagacagcattgaacgagaagagaactaaggcaaggctggtgatgtgccactgtacggggagctctgagaaagtagaagtgctttccttcacgctgagcgtgaactctcgatttcgctatacgaggaagattgcttatgacatcaatcagctaagtccgtctgtcgaagaatttctcattgcattcgatgtttagagtaatagtatagagtgtttggtctcgcttttaagttgtatcggctggcaatatgccatagcggctggttcagaatatccccctcgcgaaccttcacccgcggaccaagactccaaccgaagcacagacctgagaatgggtagtcggagaatcagtagcttgtaaatagaatttctgttatgcgatgctcgaattctcaatagggccccctttctgttaaatgaagtgaggcggggtcgtcgaacgaacgacgttagtttacttgcacgcgattttcgttcagagccaaaacattaacagtctagaatatttttttattttttacgttctgttaagtttttattttagattccgtaatgacggaaccttagactttttttttttttaatttgacaccatttgaaaaattgaattaaatttatattaaaatatatttatttggtaaaggggctatttattttaatttaattataattcttaaagttaattattttttatggggcaataggttggaaaaggggcgcctagcctttttgttttttttgataagtgggaagttcttcaaaaagtatttaaaggttgggaggggtttgtaacaaacaatttttggggaggtttgaattctggggaaaaagacctaggactttttcgcaaaaacttttggaatttttcaatgggtgaaaaagaattgtgggcaaatatctattaaagggaggaaatgccccttttggttttataaggaaccgcaatttttttaaaatattaaaaaggggtaaggcctacggataatttgtaagtaaaagggggcaaaccttaaagcctaaaaaaagcttgtgaaaaagaggaatattattcctctaaaaaattattctaaaaattgttgtggcttaaaatccggaaaaatgtccccaccaatattttttctccctccacgcaaaaaaccggccgaaaagaaaatggcgtcctatttaagatctacatggggagagttggccccctcacaaaatttattattggattttttggggcacaattttttgaaaaaaaccncgctctttttctttttggaaaagaaaaacacctcacaaacaaaaaaggggtgtggttgtttatcaacacttactgg

SEQ ID NO: 22035 - DNA, 4019 bp, Oryza sativa
  unsure (1)..(4019): unsure at all n locations
ccccgcgggaaacgagattcnaacgaaaggcacaacctgaaatttggtagcggaaaaacagaaagcttgaaaaaaatttttgtgtaaaggaaggttggtattccacaaaagggcccctcttcttataaataattaaggcggtgtccccaaccaaacactgttagtttaatgcgcagcatttcctcttccagagccaagacattacaagtctagattccttttttcaattttacacgttctgtaaggttcttaatttaagattccgtcaatgacgaagcctaagacctttttcctccttttacttccacccaataagaaaattggattaaatatatattaaatatattattttataagggcaaatatatataatatataatattattaaatatattattttttatgggcaatagttaggagaggtgcgcctagctttttgtctctttgatagctggaagttctccaaaagtatgaaaggctggagggctttgtaccaaccattctagtgtggttggattctgttcaacagcccaaggactttccgcacatcttttgttctttccactgcttgaagtgattgcgacaactacgaagaaacgacgaatcccaactacggatatataagaaccgaaactgctcagagcattccatccggcgtaagcatctggataatctggaatgcgacgtggcatgcccgaaagccctaagaaatgcatgggaaagaaggtcagattaaccccgaaaaaagtaatccaaaaatggatttggcctaaagtttcaggatatgtccgaccaaagattttacccacccaatagtaaaatccagcaaataaagcaaaaacggctcccatagaaagtacataatggaaatgtgcaaccacataataagtatcatgtagagcaatgtctagcccagagtttgctagaacaattccagtgagccctcctatggtgaacaaaaagatgaaccctacagcaaataacatgggtgttttgtattgtatcgaacctccccacatggtagcaatccaactaaagatttttattccagtgggcacagctatgatcatggtagctgcggtgaagtaggcacgcgtatcaacgtctaagcccacagtaaacatatgatgagcccaaactagaaatccaagaacacctatacttatcatggcataaaccatgcctagatacccgaagaccggttttcttgaaaaggtcgatacgatatgactaataataccgaatccaggcagaatgagaatatacacctctggatgaccggagaaccaaaagagatgctggtataatattgggtctccccctcctgcaggatcaaaaaaggttgtattaaaggttcgatcggttaataacattgtaattgcccctgccagtaccggaagtgataataaaagtaggaatgctgtcactagaacggaccacacaaaaagtggtaatctatgcatagtcattccaggtccacgcatgttgaagatagttgttataaaattgatagaacctaaaattgatgaaacacctgatagatgaagactaaaaattgctaaatcaactgctcctccagaatggctggtaataccacttaagggcggatagaccgtccacccagtgccgctgcccacttctactaaggctgagcttaataggagcaagagacttggtggcaacaaccagaatgatatattatttaatcgtggaaatgccatgtcaggtgcacctatcagaatcggaacaaaccaattaccaaatccacctatcatcgccggcataaccataaaaaagatcattaaaaaagcgtgagccgttattaaaacattataaagttgatgattcccaccaagaatttgatcgccgggtcgggctaattccatacgaatcagtacggagaagcatgtgcccatcactcctgcaatggcaccgaagatgaaatatagagtaccgatatccttgtggttagtggagaagagccatcggaccagatttgtcatttgattttcgttttgaaaactttcaagccttatcagagaggggctcggggctggaagagaagaaccttgatactaaaccaagtttcgataacttcttcagctttcatttcctccgtcttcaaaatcgcagagttaattcaaaagtcctgttaggtcacatatgcttgcttttgaaaaaaaaagtggtatacggcatattattcccccccctctttcgatcttctaattggaagatcagtagagtgtgttggaattcggttctttcgagccttgcttgggctcgttctatctttgaatatagcgaattccgttccacctcaatccacgttcttttcgcgctttgcgcttccaggaaatcacggttgtgggaaaccacatcacggaagaaaaatgatccttcctcatgatcccgcagatcctgataagctgcctggagaatagagaaatcatccgttgctcggatagagtcaagataggaacgaagcgccccctccaaaaggtagggttctaccggaagtacggctccgttcctcgcgtatagagctagaaattcttgaattagatccatcctaacattggatgtcctttcttccattaggaagagcctcagccgcccaggtatgtcctccagaggggtgttgtgattcagctcctgctgaatgaacgcaacccactccggatcctgctcgtaaaggctcagatagaagtttagcccttctaaatgagctagagcctgtgggtcttgaacttctgggggaagagtgataagaaaggagcaacaagttagaagggaaaacatctgtactatggggaggactatccgataaaagactagaaaaactaaaatggaaatcttcaaaaagaagatcaaatatggaatacataacatataaaaataaatagtcgacgaaatttcgctacttatccttttttttcgctcctgtagtgatttaagcactactttaaagataacccccccagccgaacgactactaaatgctcggcaaagcgctctcccctttatgctttgtctcattctatctctcgtcatcactcgatgaaacctctacttcaatgaaagctcctcctactactcccccttatccttctcactcgtcgtttcgttggtcttttatatacccattgattgtcctcggaacaactattgcacgcagcagggagttcactggtcaaactatgtcaattgaaaaggttggatccggtggtctggtctctgtgcttcgctttacctctacccatttccgcaccaataggaatcttgcgattcgaacccttcactcaatctctctcgcctctatccatctcttttggtctatcatccatcagctcttgtcctacaattctctttcacttgcattttctttcgttctgaggtggaatcgaaccactgaaggatttcaagggcaatgccccttgctcttcctactgaaacaagcaaaaaaggatttgcagtcctttgctctaaccagctgagctaccagaaccacttgcctaaagtctcttttcttcatctatgagcatcccagtggaggagtttgctcaagaaccgagagctcgccagggactggacggccctcgtttcgggaggtcttcttcgctatagaccccacaagaacaagaaagggcgctccgctctagtcactaagtagtgctattctgtccgacggcgactccataaatttgaggtctctcttacgtaaattcgcctgcccgtctaaattcgngccgggagaaatgggatccgactcatgatacaaatcttcttgtatgtcgattaagcaaaccaaagccttaagccactcagcataccttccaagtgtgaacgngaaatgaagtgcccgcgtggtggccccaaatccattggtaagcgttaacgccctattttttttattggcgagaaagaatttttcccacttatggattccttggtccaacgggaccattccaaaaacctttatnttttctcagggaattcaccccaaataaaaatctccn

SEQ ID NO: 22036 - DNA, 14758 bp, Oryza sativa
  unsure (1)..(14758): unsure at all n locations
cgacgaagaggtgtaggagatgagatggagagcggcgacagaaggagcgggtgggggntcgtgcaggagtggagacaaaagaggggggaggacagacggactgtattgtccttcgatgaaagaaaggggagaaannagtatggtgtgcggaaggaccagggtatgctccccgagaaaggtcagggaaaagggtgacgcaaagaagggggaagggcgccgaaaaagagtgaaagcgccagcccgagggggagtaacggtggcggtgagattggtatagagaagcccgtggggggggtttttcgaccagactgggggagggtaagcttggacaattttgtggaccgggtggtgacaggggggggggtgaggcttatgagaaagaaggcccggcaacgggggcctatttgtgggggttcgggggccgtgatgggagcctaagtagctcaaatgttatggtcgtgcgttaaggccgtggattgtggggggcgccagtattccccgctaggagtggaggtgaatcccgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatagaaactacactatatatgagttgttgcttgagttgtctgtattggaagtcgtgtaagcggcttcttccgccttccgggtctagtacgtatgaaaagatgtcagcgtcgtggcgattgcctttcctggtggtgaaggattctattcccgagcggctaaggtccaatccggtattctatttcgtctgtgcgagcattaaaaccaaccatttccgacgtcaagatcaataggaagaaaagggagtctttttctgtcttgaaggttttattttaaatccaaatcgaaatgcctaaacttgataaattgacttatttctcacaattcttctgttctgccttctcctagtaagtagctcacgaggaatggggggacagattccctcaatctcgagatacgaacgtatcgtgtcaaaatttattggcaaatttttcttcagtggtttgtggaccgatagaccttaccttatttttatttttatttccctcatttttttgggactttatattgtcagaaggaggagggaggctttttcctctactctaattggatccttctctggtttgttttcgtttttttttgtggaaggcccagaggttgcttccgctatggagaacccaccagggcctgggcctagtgaagcgggtccttccggatccgctgcgggcaagtcagctgaagcctctactccgtcgtcctcttttttcaatgggctttcgggccagatacccgcaccggattcccccggggaagaggtgccgcaaggggaacagccccgttttgacccttattcaattccggaagttcccctggaacacgtattcggggctgttccagatcggggagagccatccacaagccacaccccgccgaaccctgaacctcaacttggagaagaaaatgccgggccatcaaaccaccaaattcaacatgatgttataagaagcagacttgaaacttgaactccccaaagggaagtaagcgacgatgagatagactcaatcatttttattaagaaagatattatcgatcgcatggcccaattagacccggaccgggatggattctggaatgagcaaaaggaccacttagtcgctcatggaatcctcaataagggtaaagagtataccttacagggactgataaacctttctaaaaaattggaaaaatccggtactagctgtaatgtattcaataaaataaagaagaatgaccgtaaatcatttcgaaagaactacgaaagcaaccctgatctttcttctatgaagaaagtacgtaggcactcctcagcgaggacgcgggttttaaagtaggttctacacattcgagaagacccaggcggattggagtggttgtgcgccggggcaatctctgcttgcatttcgcattggaatttcttgactagcccgaatagatggactcgttcgttcggtcgggcggggcaaatctctaaagtggaattcgtgaaaaggtaccacactcaaatcacatatgatattatgtcaaacaaatcaactagctaaaaagctaggaatttatgtagaagtctgggctggtcagagttcaactcactactcgggctccttttcagttaaggatgcaagggagacttccatgtctggggctgacagctttcgtgtactgaatttctatgagattctcttgtccgcgggaacaaaaagctagtaaattcagtacacgaaattaggatattctagacaacgaaaagctaaacaaagaaaggaatgacaatgagtgtggaaaatccatctacacaaatccactcactacgaggaggtaatcaatcttatgctcaggcaattcattcgtataaatcactactcggggtgtagaggaaggaaatcaggggaatccccggtattaaagtagacagatcaagactagtaggaaaggatactccacgcactagagctttgtctggtcaaagtgctcattctaaggttcaatgcgccgcagaacgagtgctattccttttatgaaattacaccgggaaggaattgagcaagccaagtcatttaactcactccacttaagattgaacaaccccagtcagtgttggttttggggtaaagaaaactatgatagctagctaattcaagaaattctattccatgaaattcttcctccggacaagaaagagtgcggcatcaaaatatgaaatgaaaaactaaataaactaaaaatctctcctctcagtaaattcgtctattcgactaggaaattgaagacaaaggaatttggaattacaagacggatatcagcttgctacttctgactttgactttcaatagggaggtcaaaaactagcacttttttcgaggagtgatcatggtttgacttcgatatattccgggaagatggcttgaagctaatagcaaagtctatttcgactagcttgtggtactagctaggaaattccctaacctcgatatgaacaacttactcaactcaacagagtagcaaatgcccaagaaagcccgagtcaatctatttggaaatccaatctattttctcgtatttgtgtgggaaatcaagctattctagttgaaattcaccagaagaaatgcacgcacttcaatatgccaaaattgcaaaggaaaatccttcgattaacagtggaattcaaccaagaaatgaaaaggtatatataggaaatgcactccaaccaccaaccaataagtgattccgggcaatcaattctatccgcgagttgtggaagtgtttcatttgcctccgaactgaagtcaatcttttccaaaaaaggtttagtaaatgcacatcctcgccgctcggctcctccctcattgcccatagtccctaaagtctgtatgtctcttgtctctttgagaccggggatttcccaactgttccttcccttacaccctaatcttaatacccctgttacccgcctgtaggcggatcctaccaaccaaaataaagtgaccgaaagacacaattgcatcggtccaatgagacatggaagcaccagtagatattgaaagaaaaactattgatcggtattattgttgtagttctttgttcctttcgtcgatgaaagtacaaccacccattttccacactttttcatattgacttaagtcagcgaattacccgcggcgaggaggagagattagaactcctggattgaaaaactttttcttctccttgctaattgcctactcaacacttgaacattggtgtgtttcacattcaactctatctagccaaatatcatagctagcccaatgcatttcctcgtcgtagtgaagtgagggaaggaatttactagcttaactaacaataccaggcttgtccgccgtacttcctatatatagtattgaatttactagagcatattttactaagtggtgtgtgtagtttttacatttcctacgcttttcgtatcaattcctccctctttcctctttcaacactttggcccttttatcatataattgaattgaattgtcttggcatttagcatttgctctcttctgggacctaaagaaagtgagtgcctgtagcgatgagtgccagctttttcatagattgacttgggtgttgcatctctttttccaactcggatttaccattggcttgtcgtcctctcttacctgaccctgtcctatagaaagtagtgtgtagtgtgcttaaaaaaaagcaagtttaaatataacccgcaaaaatgaaagctcgctttgattgagtactcttcttggcttgttcagttcttctcatctgcctcggtaactaggtgcttttaagctactcttgttggcaatttcctttggtttgatagtcggatcttatcttttttttaagaaatcaagccttcctccttagccttgaacagccaccgcccctggcatctcctctgtaaactggatctcttctcttaggttaaacaaccgaatctcctagctctcgatcaaacccttatcccaatcgacatccggaaaggtcgaaatcgtccgattttagcatgaaaggcgatattaatcgttcaatttcattcactcgcagatcagcttccaggtctgcttcggccaatggtgctgtttgaagctttctttctaaggaaccaaaagaggtgggtaagacaagctatagagatgttccacaaacatcttacttgaagctctgtttcgagtgcactaagcgaagaggcaagtgatgagtacaaaacatggaaaggtcagtatagcttgaatgaactacgtagtaaggtttagtactaagcatgattaagtcacggtaactaagtaccggtaacgtttaatagatagaagtaagtaacaagtaccggtttagcacatatgggtcacataggcataccgataggataataggcttgtacgcaaggtcaagtataggctagagagaaagaccggtatatgtttatgttgagaagaaatgcattgtttgatttccgaagcaaataaaggcgcgcagcgaaaggcatgcatgtttcatttgcaggtgctgccggtccagggctcttcggctgagcttactaaataaaagaaagcacggcctggtttatgggaatcgtaaatagacgaagtggtgttttttcctttccttgaggatctatgcttttcatggctctctttctaacgtggatgacaggtttcaaatagtggatcagtttcttaatagccttttctaagtgcttttcgttgccttcttcttatctttatgtacccaggaaaaagagaagaatcttcaccattaccatcaccagtatcacctccaatggttggcgtccctttaattgtcatttagtagtagataggtttgttgaggacataatctcccggccttattcatgcatgataaaggtagcctttcatagtccaaagcctttgtgtgcttttgtattgaactcttttctacaacgttgaaggattgccttacgggattagcaatggcttaataaaaggattaaaaaagggcttctcttaggtcccatactagatgaccacccggaactggatgtactcgtactagaacatttggtgattacccaccgggacttcctactaagtatttgacacttccatcaagaagaaaactataaagtactcaatcaatgcgaatagcaggaatggtacttgcaaaaaaaacatataggaccagagaaatgggaacgaggctgacctatccaggtagtgaagtctacctatgctaaagagcaagttcaatatttggttcgagtagccagcctattttcaggagtggcttattatagtattattaaaaatcatacgaacaaagaaagcctattttaggagtccaccatatcaagggaaagggagatcaggcttggccttcgctttgcttattcatctttctttctttgcttttgaatgacttgatgggtctggataataacaagaagagtcaaggtagcgaaagtagctatactctagtagctggcggggctagtggtgaaggaaatcaaatggcagagaagacacggattcagacttcttttttcaaatagcccttggtggtatgcagattcattgaacgaagaaggcagtcttgcttcctcacgaacaagatcggagcacccaaggttaggcactcgattggatgttcccgtacgtactctagaagcaagatcgcgggacgtccctataacacatcgctgacgtcctcaaggctttcgttgtcgaagagtgaaagatctcacaagtcctccatacgtcagtttctattccagcccagcaacgaagtgcccgtcggtctgcaacattccctggtacaatgctaggaatatgcagtcacagataagtcaagaataagtgagtatgtacgagtcaactcataggtttagtagggctactagaaagaggagcttgggacagagctatacaggactgcttcttgctactccaagagataacaccgctaccaagccaaaatgcgtatcccgatgtcgacttgcgttcatctggacccaaaataaccaaaaagttccagaggcatcttccattcatttcgattttggtctttctgcaccatatttagatcttccctttctacgatccggaattcccagtaaatccttgactcctcgaatacgatgggatttcacacctggcgaatctttcactctacctcctctgactaagactatagaatgttcctgcgaattatgaccttcgcctggaatgtgagcaaatatatcatgtcgattgctcaaccgtacttttgctatcttacgtagagctgaattaggttttttcggtgttctcgtcgaaacacgcaggcatactccttgcttttggggacattgatccgaagctcgagtacggtccgtgcgctgtttttcttctctaccatgacgaatcaattgattttttgtaggcatccctctttcctatgtccttcccccctttgccctttcactagtggttactcccgatccgaagcaccccttttccattcatagagaaatccaatcgtcaaaatcaataaaaaggccatcatggaccaagatccaaacagatcaatcttgttaggaggtactgcccaaggaaaaaaaaaggtgacttccagatcagggataataaataaaataggaaccggataaaatcgtatatcgaaacgacttctggcatcaccggagggatcgaaaccacattcgtaggccgacaatttttctggataggtcgaactattggaagcaaatggaaaaggaacaccgagtggaatcaaagaaactagcggactgatcactaaatagatacaaataggtgcaaattccgacaaaaatgcactttcataagccgttatcgctaaatctatccgtattccctgaagaactgtggcgctttcatagccgtttctcgcgttgtaaacaccaaaaaaaatgttgtccatgaattcactttttttattcaattgagctataaaatctttccataaccttttgcgggattggccccccaaaaaaagtgataagcgcgactcaatcttgtcctttgggcccgggggaacggcagcacttaatgcacaaatagatggaataacagcaaatagcatatttcttctatccttcttatccgtggaactaatcttcatcatagggtaactatatctttttaaagctctgctcccaaaacaaacgggagactttttcgttttgtggccgtggcgttgggttttccaacgaaaaacaagaacattctttcacgaactttcatgacactttatcattcggaaccctctccgtattagtaagcccacaccttcgtaacccaaggaccgacgaacagaaattgaaacaacgcaaccgtactatctatttacgataatttgattgctgacaacatcacgcttctctttcttattcttatttatataactgtcactttaccgggccggaaaagtgacaccgtcacgtctcagagtcgtatgcctggaacaagaagggtcgtcgtacaatttcggcgattcaaaaaaaggaggcgagctccctatccctctttgtctttccacttccctcgttcaacgaatcaatcgacattttgtacaaattttacgaacagaagctcttattttcatatttccgtattcctttcttaaactatgaatttactcttttggaaaaaataagtctctttgtttgaattttagaactttgaattttttaccctagaaaaaaaaagaaaaacctaaccctttgaatctttggtatccttcaaatctcaaccgggactaaagttaagatctttagtcccggttggtgctaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgagtaactagaaaaaatgcccgtatcgttggacgggtgaagtctattttaattttattattgttatatggtttagttaagatgaaatttattgtaggagttcgcttggatatatatgtaattttataaaattataagctgcagttaggagtccgatcatcttaagttagcatgcgagtttttttaaacaaatactccgattcaaatacggatatatatttctaaaagcaaataaacttaaaaactgactcatacaagaatgacgtaccaaaatacaggcaaaaacatcttcaacttttataatagtagagatagagaatagaagagatagagatagagaagagaattgatatagattaaaaccaaagcataaaattaaaaccgactcaaacacgaatgacgaaccgtggaaacatcttcaatttttataaccgactcaaacatggatgatggaccgcagaaatatcttttatttttataatagtaatagacttgtaaaattttaattttggtttacatgtttatagagtaaacagatgtatatgcatgtatatacgtgaggcagaatatagcggtaatagatcagaagcagctttgcatgatatacggctgtactctttccttgtgtgacgtgggcagttggaaacgtgggcttgactacaacatgtaccggcttaatatatactgggctgtgatttttggaaagaatacagataataaggatcggactgatgaagagatacacgagcgattagcggcttaaaacacgttgcgcggaaggaaataactacaaacacgcttaggactctgaacggatgacggatttgcgacgtacgaagatgatggcaaaaacattttaaacttttataataggtagagatacacggaaggtggaattatgcacggcatacgtggttgaatgaatatattcgacaatatactattttcagtcgtattttggttgattacgactgccttgttttggtttgctttttgaatgtatgatgaattcgaatccaaatacacaatttatacgcgtacgtcggtacgtgtactttatcagcaacacacaaggatacatgcgcagatattgtatactattctctcattttttttaatatagacgacgttgacttttgaacatatactagtattatttaatcatttattttatttaaaaattattgtacaaatgcatataatatataaattacgcttaaataattttagtgataaaacaactgacacaaaataaatgataattacgcaaattttttgaataagacgaatggtgtcaaatgtgtgttcaaatgttaacgacgctatcttaaaaaaaatgatgcagtcaatttatctgcaccaaataaatgcgccagaagataaatcacacccacttctcataccactgatccaatttgaacttcccaaaacactcaattacaaaatgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcatattccgttagggatatagattatcttttgtaacacggactccttcccatatataaggggggtccgggtgcctctaggggcagttgttgattttctccaaatcatataatcaataagacactcggcggattcatccccggacaggagtagggtattacttcttcgataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaatgggttccgtctccggcatcgacgacctcgtcttcccacccgggcagacgtttcggttcggcagcctcgacttcgtcaccaacaacttcggcaatgtcacaccctgaaaattcaaaatatataaattgttgtttaaatggaatttctagaatttattttaaaagtcttgaaaagaaaatctaagtttaattaataaattccaatataaaattgggccagataaaatttcattaaatactttgcttaattctttaattcctagatttttctgggatttatttgagctaaggaagtatttttaataaatggaattgcatttaagaaataatttaaattgaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcgccgccgccgagccgccgccgctgtttccttccaatccggccgctcctttccttctccggccgaatcaatagaggggaaatgatctccgggatctcctctaccttttctcctttggaatcttcggctaaatcggtttggaaatcgatggattcgagttcgaatcggatcggctttcctctctccaagccgcgagtttccttcgccgttgccgtcgccgtgggccttcgccgccgcctccgagcccctttaaaaggacccccggtgtctcctctacccgtcgcagctctcgccttcgcctctcgtcgccggaagagctctagcgccgtgtgccctagcttcgccgtcgccgccgccgcttcagccgtgctccgccgtcgctccagctgtcgccgtcgctcgggaagaccgccgccgtcatcgccaagtcgccgccgtcctcgtccgccccttcgcagccgtcggaacccgccggagcttcgtcgccgtcgacaacccgaaggtagccgccgcttccttctcgtcgccgtcgccgtccgttgcttctccgccgtcgttttggtcgtcggtgagttcgccgtgccgtccgctacccgttggtgtcctccgttcgtgccgtagcgccgccgttcgccggtgagcgtgcgccgcccgagccgtctgcctcgccgagccgccgccgccgtcggtgacgtcatcgctggcgtcatcaaggccgtccgccgtgaaccgccgtggacccgatcgatctcggccgtccgttcgtgtgaaccgccgcccgtgcgccggtccacccaaaccctagcccgctgacgcaataaatccccttttcttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaattggactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaagaaggtgcgctgcagtgggttgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcatagtaaaagatgcttaaactggtaataatctgattagctcctggtttggaatggtacattcctagtttggagatagaactgtgcagccggggtggttgttcagaatggttgggcctatacaacagggtatgttgtatagcgttggcttaatattgtttaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtttgcgccgtttatttaatttccgctgctagaactttattgattgagaggaactatctacctctgtaatgacattttattcgcttattaatcagagtaatatttgtactctattatcaatttgttattgtgtgcctcggctgattcctggacgagggttcacacacatgtaagcgtttggaattttggatagaaattccgggcgtgacaggcaagatctctctccttgactcggtgtcagaccagtcgggagagaaccggatttcagccccgtttggactcccaaacgcggctgaaagttacttcaagaccatctcaatcgagttggcttcaaaccactcgggtgagatcgcatcttctccaacatcaccagatcaagatgatggggcttacccaccgatcctgatgaagctccccgacgatttggcggccgtctccatcacgacagcgtctccatcccgtaggcctaggcggaagtcggcttcaacaccgacttcgcctagcttcagggaagtcggcgtcattcttcaaccactcggacggtttcgacggatcagctggattgctactacagattttccaacgttgaatcgcgccccaaccacattgtggagtccgacgagtttagctcttgctatcacgacccgggttcttgacgactttgacgggaagctatattgacactacacccctctctacttcgntgtcttcatggctgataacgagacagaggagcactgtccaagcccggnagaccgaagcacgttctgagacttgacgttcccccctggaggaggagcttctagcccaagaacaagaaccggntctggcgtgagcacacagagcgtgaacgcgacccgaaggaggttaagaatcaacgccacaactttggagacagtcgcccagccgctaacctcattggccaaaaatgtttaaggggaccggtttctcgacccttaaagaagggggtgccggacaccctctctgaccttctctagggaaaagacttattaatttgtccttgtgaaattttaaacaaaaaaaactatttgggttggct

SEQ ID NO: 22037 - DNA, 13161 bp, Oryza sativa
  unsure (1)..(13161): unsure at all n locations
gaagcgccgagagatggagtgacctaagaggaaggagtgccaaataaaacgcctccccaggggttgggttttcttaaagcgtggccccggttttcctatgaagagggcaatgggcccacccaatataggggtgagccccccttgggcccccagctttcccatttatgctccggcctttttattggtgaaattggaacgaaaaacatttccacacagaaacagactatgcccttgttggcgccaagctattgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggagagcctaaattgccaactacaccgcctctatactagggtgtcttcatgggcggataacggagacggaggagcaatgccaagcccgggagaccgaagcacgtcgcgagactgaacgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttaaaccagacgaagaccatgattgcggcttcggtcccagttaactccgaaagcgtccacacgccgactggcagccgagtcccccactcccgatctcatgactaccgtcatctaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcatgcgccggaccgccacgacgacgacctcgacggagtagcagccttcaccgacgacctgcgtcgagtggattggccagccggcttcaagccgactggaatagagaagtatgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaactttcaaggcaccttcgagcgtcccggcacacaatacgacctctacaacgttattcagaaggccggagaaacccttcgagaatacatccgacgatttccgaacaacgtaacaagatctccgacatcaccgacgacgttatcatcgccgcattcaccaaagggattcgccacgaagaattggtcggcaagttcgggcgtaagcctcccaagacagtcaagcttatgttcgaaaaagccaacgagtacgccaaggccgaagacgcccgcaccgcatcaaagcagtcaggtcccagttggaagccaaacaagggtacgccggctaagggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactccgacgaagaacaaagtacgtcgaggaagaaggacgacggtgacaccccggcaggatttcaagaccaccgcaaggagctcaaccatatcttcagcggcccctggcttatgagtctaaaaggaagcaaaagttgactgaacgggagatcatgctggtcagcccgacacaccccagtatcttcgatggtcagaaattgcaatcaagtttgaccgctcggatcatcctgaccgagtggtccacccggggcggtaccccctggtactagacccagtggtccgtaatgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacaacataccatgccatactcggacgcccggcgttagccaagtttatggccgtcccgcactacacttacatgatgacgaagatgcctggtccccgaggagtcctatccctacggagcgacatcaagcaagccgtcacatgcgacaaggagagttgcgacatggcccaaacccgcgagatggcgtcagcccgagaggatatccgactggctgcagccacggcgagcgaaggagaagtgcccgctaccaagatttcaaaaagtggagaaagcgaagccaagactaaaaagattcccttagatccttctgattctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttatatgtcaaagaagatgccaagcctatcaaacaacgactccgccgattcgcacaagacagaaaagacgcgatcaaggaggaattaaccaagctgttagcagcaggcttcattaaagaagtccttcatcccgactggctagcaaacccggttctagttcggaagaaaacggggcaatggcgcatgtgtgttgattatactgacctcaacaaatcttgccctaaagatccttttgggttgcctcgcattgaccaggtagtcgactcgaccgccggctgtgagcttctcagttttttggactgctactcggggtatcatcagatccgactgaaggaatccgactgcttgaagacttcattcatcacgccctttggagcatactgctatgtcaccatgccgtttggactaaaaaacgcaggagcaacttatcaacgtatgatccagagatgcttctcaacgcagatcggtcgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtactgtcagggaagctgcttggttttatggtgtctcataggggcatccaagccaacccggagaaaattactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgatgcacagaaggccttcgaagatttcaagaaactcctcaccgagccaccggtcttagcctcaccacacccgcaggagccgttgttgttgtatatagcagccgcctcccaggttgtgagcacagtcttggtcgttgagcgcgaggaagaaggccatgtccagaaagtccaacgatcgatttactttgtcagcgaagtcctagccgactccaaaacgaggtaccctcaggttcagaagctgttatatggtattctaattactaccaggaagctatctcactactttcaaagtcactcggtaacggtggtcacatcatttccactcggtgatatactgcacaaccacgaagcaaacgggcggattgctaagtgggctttggagttgatgtctttggacatatcattcaagccccgaatttcaattaagtcccaagcgttagctgattttgtcgccgaatggaccgagtgccaggaggatacccccgcggagaagatggagcactggaccatgcattttgacggatcaaaacgactttcgggcactggagcaggagtggttttgatttccccaactggagaaagattaagctatgtgctttggatacatttttcggcatcccacaacgtcgccgagtatgaggcgctccttcatggactgcggattgcaatttccctaggaataaagcgtctaatagttcgaggcgattcacagctggttgtcaaccaggttatgaaagagtggtcctgccttgacgacaatatgatggcatatcgacaagaggtacgcaaattggaagacaagttcgatggactcgagcttagtcatgttcttcgacacaacaatgaagccgccgacagacttgccaactttggatccaagcgcgaggtggcgccctctgatgttttcgtcgaacacctttatacgccgaccgtacctcacaaggatactacccaaattgcgggcactcatgacgtagctctggttgaagccgattggcgagagcccctcatacgatttttgacttctcaagaactcccacaagacaaagatgaagccgagcggatttcaaggcggagcaaactttacgttatgcatgaagctgagttgtacaagaaaagcccttcagggattctgcaacgctgcgtatctttagaggaagggaggcaattgctgaaagacatacattctgggatatgcggaaaccatgctgccgcacgcaccattgtcggcaaagcttaccggcagggttttttctggcccactgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctttttgtggccattgacaaattctccaagtggattgaagctaagccggttgtcacaatcacagcagataacgctcgagacttcttcatcaacattgtgcatagatttggagtgcccaatcggatcatcactgacaatggcagacaattcaccggcggagtttttaaagacttttgtgaagactttggaatcaagatttgctatgcctcagtggcacatcccatgagcaatggacaggtggaacgagccaatggcatgatacttcaagggattaaagcgcgtgtttttgaccggctaaaaccctatgccggcaaatgggtgaaacagctgccatcagtactttggtctttgcgaactacacccagtcgggccacaggccagtcaccttttttccttgtctatggggcagaagcaatgttgccgagtgaagttatattcgagtctttgcgctttcgaaatttccgtgaagaacgctacgaagaggaccgagtggatgacttgcaccgattggaagaagtccgcgaagcagctttgattcagtcggctcgatacttacaagggctgcgacgttatcataatcgcaatgttcgatcccgtgcctttctagtcggcgacctagttttgaggaaaattcaaactacacgagatcggcacaagttatctcctctatgggaagggccatttatcatctctgaagtcacccgaccaggttcctatcgactcaagcgcgaagacggtacactcgttgacaactcttggaacattgaacatcttcgtcgtttctacgcttaagcttatcattgtacttccctatcttgactgtcaacatcaagttttcttcttgacgttgtcagtcgggggctatcatcataataatggagtgtgattttttatcaatttaatttgcttacttggtctatcattgccttgtttggtttttctacttcgtctgcgaggactgaaagtttttaatagcttctttgggttttaggctcaacaaagcttgataaaagcttttaagaaatcaaagacttggctagaattatcaaacacagcataaatacaccagtattgtacaagttgaacctccatttgttacattcatagtcagtcagaatcagttttttcatcatcagagttattactactcggctgaaggtcggtattgcggaattgctctacaacgtcatttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatctggagcaactctcagcttgtcgaagatttcggttgcgtcgagtgcactcggaccactgttattgaggaacatagcttggacaagtggtgtagcgacattagcgacttcatctcttgctccttcaagcattttgatcttaccaaccaggacgtcaaattgagcttgagatttaattttgcggtctacaaaacacatttatgatcaaaatctactgccttaaaaagagagaagttcagattgtcagctggcggtaccttcaacctccttcaaggccgagtccctttgcgcagccagttctactttgtctcttttcaagacttcaatttgtttctccatctgagccatcctggtggcttgcgctgtttgaaatccaaatgtttgaggatacagttatgacagcataaattaatgggacagatctagaagattaccttttgatgaaccactcagctcgaagtttgaatcctggagcagggcaattcggtcccttaattccttctctgtctttttggcaagctccttggcctcgtgtagctggtccctgactgcttcaagagttcccaaatgaggaaccagcttttctaaagttgctgtcttggcttcattgcgaagatggattctctgcatgatggttcatggtttagttctgctaaagagaaaacaaagtcatcaaaggcagtcacccagaggatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcgtcagccgcctttatgcgagggatttcttcttcgtcatcgcctggtggtcctgatgtatttccaagatattagacgaataagctggagttattcaaatcggcatcacttgagaagatgagttacctgaggatgttcctagctgagcgtgaggcgattcttgttctttatttgaagacccaatcatagcgtcgttaccagcctctggtccttgagaagtcgtcgtctgcgcttcaacttcgggaatttcttggtctggacctacgtccgactggtttccagtcgggggctcttgggttgttgtagtttcagttgctgccgactggtctccagtcggaggctggtcactcggatcggctgtatcacctgaagtatgagcgccagtcggctggttctcggcagtcggctcagaatccttggatgaacttggctctgtcacagccggatcaggatcttttccagttggatctatgtcggatggtttcctgcaaagtgtcctttcaatattcagtattattttcatgagagaagcataccggagcgaaatggtaccaagaggtttatgcctggaagatgttttgatctttggcgttggacggccagccagttttttcttgggagtggtatgctttgggagtttattgggtaggcctttgttcccagatttgtagccgtcgtcgctttcgtcgtcgttaagcaccagctttctcttgcgagaaccttgtttgccccagtcggattgaaggtttgaggttgcaagtccgatctgattgtcggccctccacctcccttaacggtgtgctggcgaggagaccggcgctgagtaattggggggtcagatttcatcaatacatattcctgaatgagatgcctccatggttagttaactcaacatgaagacaagattatgttttggtcatgggttgaaggtttcagatacatacctgcggaggcggattgaatgcattatatggcacaactggcagctgatgtgagtagccgacgacaatagcatttgagaagattttatacattctctccttcatgattttaaaatccagagagtctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcaattccaaggcttgggctgcttcatccccaataggaagagagttccaggtatcttggtacaccggaggaagacaagagtactcaggaagagcgggctcaggattctgaatataaaaccagttcgcatgccaccctttgtttgaagtcttgaagggcatcgagaagtacttctggctcagagttcccctcagctgaaatccggcccctccgactacacatggcttactcttgttcggttggggtttgagaaagaagattcggcgaaacagagcgaagtggggtttaattcccaagaaggcttcacaaacatggacgaaattggcgatgtggactatggaatttgggtttaggtgatgcaagctgattccatagaagcttaatatcccgcggaaaaatttcgaggtcggaagagcgaagccgccatagaagaaatgagagaagaccacaacctcgtgtgtatcgggggacggaaaagcctcaccgcacgctggccgccacccgatgatctccttggcaggaagaacgccgtgcgccaccatctccttcaggttctcctctgtcacgtcggatggcgcccattggccttcaaagctttctttctcttccgccatcgattttacccgaatgcgctgatttgattcgagggatggctagggagaggtgagggattgaggcggtggatcacgggaaggattttgatgaactttttgaaggtggattcgagtggaatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagcccagtacttttgacagcgtggcccattgtgctccttagggacttaggcattttttgctttggcaatctatgcgcataatagtgttgcccaatgctgataaaatcctttttacgtggtcatataattctttggaattattgcaatgcaaattaaaaggtgcccgacagaaaggtgttatgctgtttttgtaagcttttttaggctacaaaagctgtctgggttaacttggaatgacttgtttttaccatagtcgtttctttggtatgttatatgcctgttctcattatggtaaatagtcatagcctaggctattagacttatttattaccataatttttataatttttggtgggtaatcttagagttttctattcggatgcccgtcaagtgtgttcattcgtgaaccttttagagtgttaaccactcggattctttttattatggctaaaaagcagtcggctagaatgcctctttgggcgtcgcgtatgcttttgtcatatgatgcatgattgtgctattattttgttctcaactatatgtttagtttgttaactaatcacatagttgggggctacacctaattaggtgcatctattcgatgcaccatattctttatcttttcgccctttacagtctttgtcttcgctactcggcagatcttggcatgaaaggtttgaagcactcggatcattatctttgagaaggctatgatggttgactgcaaaggtcgtgagggctactgtggagattatggatatcccatatctacacggcgatggtatttggactgaatacaggataccaaatatagatagaatattttatttgtgtctcgggtttgtttctcaacttgtacatcaaggaaataccttgagacttagtcggctacgactgtattttatctgtatatgcatattccgttagggatatagataaatttcatgtttcctcttttggcttctctcttgtccactcgtatatcgtggcatcactacatccatggcattcttcccaagcacaatggacccaaaacccgccataatgaggtatgtaaaaaaccacttgtatgccatctttttggctcttatttacgtgcctactgtcaagctctatggtcatcctttcaagagctagcgagtttggttcattgtaaaacccccgaatacaatctacttgaatcgtccttttactattttttttattttaccctagttttagtccatctttgtcagtttgcgccgtaaaccgtccgtcgccgctgcgagagtgcgacacctctttgtaggtttgtcctgaaaaccttccgttttgcccacgagacgggtagttatcctcatatcaatctaaatcggcctagaggctgattttgatctctaaatcggctccgctagccggtttagcttttctttttgcaaaacccatcttgatttggctctttggctagatcgaggtggttggcgactctaaatcactgcaaggcgtttagttgttgcgatcgtgcttgtcgacctatcaaaaaagttgccaacacgatttttggcgactccactggggaatgatctaatcggccatattacggccaaatttcgtttaatctagtagctaccgtttcgtcaaatcaagtttcggctaaacggccgaaattaatctattatcgctggattaatataatcggcggcgagggtatttggtcatcaccgaatccatctgaacacttgccgtgtgtactgaagatcatcgtcaggggcagcagccggctcagcaacgctgtttcttttgtttcgcactgcaacagagaaaaagatcaggctactagagccgatctactgagagacaagcagcaggaatattgtttctttttattgctgcacactgttaccgagaaggatcaaaagaaaaaatcaaagccggttcaatttgcatcggctatcaccaggaagtttcagtttttgtaaatttttgctacgtacacacacagtaacataccgacggaaatcaagaccgtatattaatctattcggtcaaatatttcggctatgagctatatggccggatttaatcaaggaatttcttcatcaactaagacgagcgggaacgggtccatcaatattgctacccaatacattagatccgatcaaggcgtcatgagaggaaatgtcctgctacctcaagttgtaatttcaccaaaggtaaccttcgattcgcccaacccgtcctttgctattcaaaacgttaataatcattgtgtagatgcatatgctacttctagttttgctcctatacaatatgcttataatactatgggagggtcaacgggtgtttatacggccgattacacgggaatcggctatatgcaaaacctagctaacggtatgtcacaccctgaagttctcctcccaagcctaaaattaaatttataaatcaccctaagaaaatgccggtgcaaatcgagagaaaaccctaagaaagtaatacaaataataatcgaatctggcatgtggaatttttcttgagttctacatgtcgaaattcactaacaggatttttagtggaatttttagagctctcaaaataattttaaccaattaaaattgagcaagcaatattttaattccagggaaaatccttttcttccttttctttttctttttcccccttttcttttcgagtgggccgccggcccattctccttcctcctctcccctccgctgggccggccgaaggccaaggcctagctaggccggccgcctccctcctcccacccgggacgccgataggtgggccccacctgtcgggcccgtctcctacctcgcgcccgcgccgccgcgcccgcaaccgccgccgcgcccacgcctccgcctcctccgggccacgtcggtcacgcccgcgcatgcgccgcacctcccgcgcccactctcctctctctcccgcccgcgcccgcgcccgagatggccgggattcgatattcgaattccgcctctgtctctcctctcccactcccccatgttggccggcggaatcccgcccctaccggccacgtccgagacttccctcccctatttaagctccgccgtcgccccctctctctttttccccatttcgccgaactccctcgtgctccccatcgctcccgcgccgtgcacccacccgccgccgccttttctgctgctccggccgccgctagcagccgctagactcgctgccgcaccgcgccggcgccgccgttgggttcgcaaggacgaactccaccctgtccgcccttcctccgtcgggattcgtcgccggaattcgcatcccctntgcgctccgtgagttctacctctaccgccgcctttcgccatggatgccggncgccgtgggtcatctccctctctctaatctctctcttctccttccttaggcaccccgaagcccgttccgcgttgcncgtcgtctcccgtgctttgccgcgccgttcgccgtcgtcttcctccgggccgccacttgtgcgaccgggaaaattgcctttcccgaacgctagtgtattaatccccgtccaagaaaaacccgggtacaccacaccaacctgattaaaagaaccatcttttatattcggataaattacattatacaaaggaccttaggcctgacaataaaataaacagagcgacttaggggctaacggtcatttaaagcgctcaatgggtataagcggactcacctagaacttctcaagtttcttn

SEQ ID NO: 22038 - DNA, 2495 bp, Oryza sativa
  unsure (1)..(2495): unsure at all n locations
ggggaaaaagctttttccaaaagaagccgcccggccaatggtggtttagggcagtttatcccaatagcccccggaaagtcccgaaatctttttacacaaacgtcctggccgggggtcacatcctcgcccgggtgcaataattcatttgacatcacaacaaagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttttcatctgtattcaggngatcacatgttccctcaggaatgatcacactaagaaaacgagcgtttcgctacctgaagcaaggggatttgaccgtcacagagtacctgcacgagttctatcgtttggctcgctatgcaccagaagatgtggaaacggatgaagaaaaacaagagaagtttctccaggggttaaaagatgagcttgcagtgcaactactcctagaggattatgaaaattttgagaaacttgtggacaaagccatgcaacttgaaagtgagcataatcggatgacgaactgcaagagaaggattgtcaacatcctagtatttccaggtggtaaccaaagacagcgcactgagccacttccgatcatcggatcttctgttgggtatcacgagttcctgccccaagaagatgaacgcaatgtagacaacaacaacatcattcaccaagatatcgacgatagtatcaatgaaggcacccagaatggcaaccctagcaattttgactctgagaaagactccaagggtgatagcaataatggtaccactgatgccgatgttagcaaggatttccaaccaccaattccaactcctagtcaggacgatcgttcccaggcggacaactcagcaaagaagacgttgatttgttacaactgcaaagaaccaggtcatttctcgagagattgtccacagccgaagcgtaacctgcgtcatcactccggccattatgcaagaagaagacaggtcactcgccttgtggtcactggagcaaacgccgtacctgtgaggcctcatgttaattctaacccatagtagaaacaatgtaccgatgttaagcaccttccctttttgtttaagacagtgcctcgtattcatgtaatatgggaaaaattggtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacatttgtttggactaagagtttcagatgtgtcttttccggatcaaaggcaatgacagttagtatagcttttggcgaaacacttcaaggtttcactgaaaggcagcaagccaaaggacctcatcgtcaccagaagcatccacaactctcggagtgaagagtacctggtggacaaagtttaagaggtgattgatagaagataccagcaaaggtgttgattatcgaaccaagaagtaggtcgaaaggtgattgataagagaaatctaaaaagaatacgtcagggctgaatgtgtaaaggaatactttgaatgctaaatgatgacaagcatggtatcttagtaatgacgagctgatctcgacgcatgacatgaagtgggtaacttgtatgaggttgactccaaagatatgaactatgcaaagttctggaactgaagccccatcttcaagtgccgcaacccagtcgaagtcagctaaaggttcaaccagggacaggtcaggtgaagagaagattcaatctgcaacaggagatcgagccaagcagtccagagtgaagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaacattaaaatacgtataagaaaaattcgaatgtggcccggagaatttttgttaaattctccttggtctaaaatgagccctcaaattttacttgaattttcagagcaccggaaatatttattaaacaacaacaccattattcaaagttcaaataaaaggaaacctaaaaatccctcctcttcctctttgggccaagcccagtgggaagtcctacangggnttaagggggcg

SEQ ID NO: 22039 - DNA, 7595 bp, Oryza sativa
  unsure (1)..(7595): unsure at all n locations
ggggagcacctctatatagaaaagatgagtgagtgtgggtgtccaatgatacaagagcgctcattatggggtggcgctcggaggaggggaatcacttataaagggaagcgcgccagggaacaacaccaatatatatttttggggtggaggacgatgtctactatagtctcccacaaggggcaccctttgagactagtcaggagacacgtccccctggtcaaaaaagaagaaaaaagagaaaggggggggactgtagtcttacaatatagaggtccattggggcaacaccaccccctcgtgtttaaaggcccataaagggaggtcacttcccattgggggtgaatattatttcccacagaacacggtgaaggggttttttactctattcggggggggaagagcggccttttttcccaagaacggagccggcccctgcacaaattggtgtgtcaaagggccatttttcccccaatacgccccccgggaaatgtcagggaaacttttattacgcaagagggcacagcacgggggtttccccccggccgccgggaggtcaatattcattttggaaccccgaacaaaggataaaggttttttttttagaggtggaacctttaccccccgaaggaatggctgccttcttttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttggagatagaactgtgcagccggggtggttgttcagaatggttgggcctatacaacagggtatgttgtatagcgttggcttaatattgtttaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaatcagagtaatatttgtactctattatcaatttgttattgtgtgcctcggctgattcctggacgagggttcacacacatgtaagcgtttggaattttggatagaaattccgggcgtgacaagttggtatcagagcccctttaaccctaggttatgccaaatggttacccatagaagccctctgaaaaatattgaaaaagtagaactgttctcctccctttctcttttaattaaccaaactaatggcacatgcacttcataatttttttttaatggttctcattcaaaatttattccagtgttattagtactgtacatctattactgtactaatggctcatttaccagcaaaagttttacaatactgttttatttaatcttgctgcaataaaataaatttagcatgttgattttataatttcctttcatttcttttgaaaccagttattcaaaattacaaaatttgtgacctcgtttccaactgttttaatttatttcgcaaagcttggtttactttatttacttccctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagcaatagtgaagaggtcccctcagtgatgtttgaagctggaggaagaaactacatccatgcatgtcaggaggtggcaaggattgccataggagagctccgtgatcgctacagtgatcaattggccgacactgagtatcgctaccatcctcgccaacctcagggaagtgaccgtggtagttaccttgagactgaaggaattgagaatgatgttaccacgaaacatttggttgagatgttgtgggctatggatgaaagtcgtgcagagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgctccagctcaagcggatcctccggtcatcatcataagtagtgatgaagaagatgaatccaagcgcaaccattccaagattgagtgggtagcaactcaagatgatgaagacgagccttcaatcgacctccgatgcttggaagaactagagtgacttgctaagtcgttgttttagatcgttgtgttagtttgcttgctttaagtttgcttgtgtgtggctcgcatgtgatttacatcagtggtgggatgtaattgcatgtgtttgtttgcttttgagtgttagaaagttggtgagtttagtggtgtgagagtcttcagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacacaatggagagaatcccactctggcccaagttcttgctcaacagacacagcttatgaacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcatttccgccttaacaggactactgctgaacctatcacttggcttgaattcaccgctgctttccggaagaaacatataccatcgggagtagtgtctctcaagaagaaggagttcaggtcgctttcccagggatctcgctctgttacggagtatctgcacgagttcaatcgtcttgctcgttatgctcggaaagatgtgcgcaatgatgaagagcgccagaagaagtttttgagagaacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtctctgctcaaagtaactctgctgtaccagcatcaaaggcccgtgtcaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtactccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatacccagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacttcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcatgatattaccggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcatacagaagtgtacaccgatcacaagagtttaaagtatatctttactcagccggatctgaacataaaacaacggagatggttggaattaattaaggattatgacatgggaattcattatcatccgggtaaaggctaatgttgtagcagacgctcttagcagaaaaggccattgcaatgctacagaaggacgacagttgccattggaattatgtaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcagtggaagttgggataagaatctaccctatgcagaattttcatacaacaacagttatcaagctagtctacagatggctccgtacgaagcactgtatggtcgaaagtgccgcactccgcttttgtgggatcaaacgggagaacgtcaggttttcggaacggatatcctaagggaagcagaagaaaaggtaaagatcattcaagaaagattgcgagtggctcagtctcgacataagagttatgccgacaatcgccgtaaagatttgagttttgaagaaggagactatgtgtatcttcgagatgggacctgttatagtttaaagggagcagatgcaagctttttctttccatagccggccaaatgactacccggatcatcggtctactctacctcaatcaaccatttcaactttatacaaaaagtttttccgtaccagctccttctacctataccggaattgaaacacctaaagggaatttggtgtctttcttgtcataatgggaagaaatcgccctacccgttgtaaaataaggagcacctggttttgcccatatcccaagacctcaattttatgtccaaaacatacattcccaccagaagtagtcaccattattaggtcctaaagataatgtgtttggcagaggtacataaatgggactgttctttggtttaacaggacctttttttattggcgacccaaaccccccttaaaaaaccaagttgtccatttaaacccctccctgaattcacaccttcagggaataaaaggggccatccctttaaatttgccctcctttttagcttttttttaaagagcgggaatgcgcaaaaaaaaaatcacctggtaaaaaaatcccggtgtgaaatcccacaccctttttgggggtttttaacagcaattttatataatctccaaaactttcttaaacacgaaaatccctctgtaaaaggaac

SEQ ID NO: 22040 - DNA, 1993 bp, Oryza sativa
  unsure (1)..(1993): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtcacaccctgaaaattcaaaatatataaattgttgtttaaatggaatttctagaatttattttaaaagtcttgaaaagaaaatctaagtttaattaataaattccaatataaaattgggccagataaaatttcattaaatactttgcttaattctttaattcctagatttttctgggatttatttgagctaaggaagtatttttaataaatggaattgcatttaagaaataatttaaattgaaaaggttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggatattaagaaacagcgttacccctggaagttcttggcgctatctggtcgacctgcggttacgggtacttccgctttctcctttggagagtgcgcttttcattagtagctgggggttttcaactggggagtcgtcgtccaattggttgggacgaaccccgttagcccgccgtgggcttattgggactattgttggtccaccggtggaccactatgccttgcaacaccttgtcaagattcaaccaggttttggcgcgtcacatccttaagggcccctacggtcccc

SEQ ID NO: 22041 - DNA, 7051 bp, Oryza sativa
  unsure (1)..(7051): unsure at all n locations
cctgaaagacctttacggtgtggacccaaaggtaattaaaaagcgcaccttcccaagaaaaagggactgttccggtacgacatgtggtcaataagcactatgatttccagggtaacgctgtgtcttatatacttcggtttcccacttgagttaacggaatatttttattctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctagtgggcaaagcaagctcaagtcaagtagtggaatcctacaagccgaagggtaagggtgctgggggttagtgatcttaccatccaagaccctcgagtcccagaataaagggatagtagtagaaagttggtgctgtaggaagataagaatccaaagcctaaaagggatagccccctagtttgatagtgaaggatagcttactatactattcccgccactctactatatctatatgaaacacagcaacacattccacttatctcctgctgaatccagtgaaagatcacaggtttgtgctgctccacctactagatcaagtctatcatggaaatatatattcctgtcatcaaatcaagagaataaatggaatcaaaacgcatgatctttcgttatgctttgtaggcactcctgagaaatagcgtagttgacaagagaaagggaaatcagcaaagtcaaagaaaaaaacaatcaagaaatgcgtcgagtagtgatgtgaagtccattcgattgatcaataaggtggcggagccaatgtagtccacaataaatagtaaagtatagcgatccgttaagactgggttgcttttagttgtaagattgaaatgaaaaaggtgagtcttgattaagaatgatatgcctcttcggcgaactacctacacggaacttgtgtattaagtatcaattgaaatggtttactccttaaggagatgtacgaaccatgaaagaagagtgggtatgagggcttctttcatttgcattttgatctttagtagaatcgaatagaatagtaggcattgtcaaatctcaataaagtagcttgtgctactttctctttcattcctatgtgattgtttattgagtcgaggatagatatggcaaattctctggcaaattctctggttctctgctttcttcctctgatttatcagataaataggaaacttaagattcatatgctaggaatcattctttcctcgatctcgatggccaatctgcgtaagtaacggactatcctctttctccttcttgctccatgcataactcactgcttactaggtttaaggtacagctatcctcgttcgtcgtctggaactgttctattgtttatatcgatcgctcttatccccgttcttaatccccggggcaggctccctcatcactcaatcgctgcgctgattcgacatctgccgctttcttcccttcgttctttctcgcattaagggaaatgctggctttgcggaagtccagggttatcgggcttgagtggaatctttctcactggctttaacccgttcagtcgggactcggcgtcgagcacctgtttgatccgttttattgctccctatagattgtttcggacaggacctaggtctatgcgccgaccaaggaagggattgatcaactagatcgataatagggactcgcacccacatctggatttccgtccgctagagcagttgcgcgaaccgttgttggaatgatatgagaaaagaagggtgatgatccgcatagtagactaagaaatatgaaacatcccactacattcccttactagttagagaaagattagcttttcaggagttcgtgtcgtctaccactagaggagcacaagttggaattgagttcgtgataggaagggcaattgggaggtaaagatctgggaaagagttatttgacatgtgcctaggctagttgtcctaagaaggatcacccgtcgagagggcagcgaagagtaagtagagaattactttgagcttgtaccttcaattttcaatgaaagatttagtacttcttggatagcccttgagtagtgctaggaaacgaatcctgtagtttacgtacgttatcagtagtttctttcctttgattgacaagaaggaaaagaagctttgcgcgaggagcggcggggacagagagagtaggcaccgaagaagcttacccgagcaccgaactaaccaaaacctatccttttgctcttggaattgacaccggaaactactgactgaaagtactagctttcccctgtagaaaagaaagcataagcaactagtagtatctaaaggaagaagagtataaataagcatcttactctttaagggcaagctaagcaaggagaagttttcctttaaatctctagtttcaagcggttaggtcagttcgaagcttagagaaaagtggagttgaagttgggcatttaggaagttatgttgcggtatcagaccactctgtcgaatgagttgaatacacttattcaaaggggagaagcttcagttcaagtttccgtttttgttggaaatccagaaaccatatcagtcgaggtatttactttgttagtttccgttgctagagtaagttcaaccccgcggagtggagatctttttttcaagactgaagtgaaagttgggaatgaatagtatcttcaatagtgaagtccagttgttatagttcctaaaagtaaaccattggctggctcacgtactggcctggctgcttagctttcttaaacacagaattcctggtagatcgattggctttcttatccttactcagctgctcttcaagtgcttttaccaaagcaggtatttaggcaagtaaagacaaatccaaatcttacttatgaattgaaaagggcagatactagccaagttctccttctgttaacagctcagttcttacaatctatgatatcaattggcattgcagctttttgttatgctaagtattcttcaatgcaagttggtgatatcactcattcaggacatggctatgggctgaagggcaggccaaagaaatgctcgccgggagggctgcctagggccttgttttgtattctgaaagtagtttttcaggtatatttagcccatgaggattactaatattagtagttagtagctatttgaaggtcagagtgaagtaaagcagcccatttgggcattgtcccccgctcttcttgcatagaaacacaagctagccagtgaccttctagctaaagtagtagcagttgcagccattacagaacaccttcaacttttccttgaacatatattgagagaaatctatccatgagttcatcatggacgacgaagcagaacaagctgttcgagagggcgctggcgacatacgacaaagacacgccgggccgctggcagaacgtggcgcgggcagtgggtggtggaaagacggccgaggaggtgaagaggcactacgacaagctgcttcaagacctgcaccacattgagtcggcaggccgtcagggttcccaatacggcggcagcagcagcagcaaatccaaaggtggcagcagcagcggggagcagaggtagttaagtaatacgaatccatactaggaaaatgtgagtcctaggcactggaattggttctcttctccctaatccctataagccagaaagggtaataggcttcagtgtaagcatttcctcacacttgtcttcgtgggccactttatgttgagcaggaggcgctcactgttctcgttgaagctgtttatacaggttttggtggcaatccgagtgagattgaacctgctttttagcttcttcttcgctcttctctttccaaaattcactacgaattttgactacctccttagtcaccctatccactctcgtcctgttttcgggttccctttcaggggatgaggatatttcgatgatttatccccccgtaggtggaaaacgcgtgggtgagtagagtctgtgctttgctttggggggcaccggcaagaagcttctcggccaccctactctgacttgattagctacttactagtaactaggatcgttcaaacagtcagtcagcaatgcgtacttctttcctagttgagtggatctgcgtagcagagcccaatcttctaccacaagctctgacctgacttgttgtacttgattcacccacgtaaatagacaactgggataagggcttgaatcccataaaagagaagtgagtccgcatgtcggcaaatgatttggaattgaaactggccacagaggaaaccgaagccctaactccccattctttctatcttacatcgccatcgagccctggctgtagagtcacaggtttataatcgcaatggatttctgttttctttggcttttccattcgcttcgttcaaccctgatctggatagatagctcggcttctattagctgagaatggttttgtcaaggaaaggtttcgctatacaacaacaatgaactcacttctgatcaaattggatgaatcggtaatctttctctgtcttgtgagagagagtcacttgctgtattgagagcgggtgggtgactagtcaaaagcaagagatttcacaacttctctgttgagcttacccaactactttatccttaccgaataaccagttctatctgaataatgcctttcctttctattggaatggaacacactgactatctattgaatcgacttgagaattctcgtaatataatcgcttttcctatctattggaactgcacacactcccattgctagcaaagctcaggagatagaatttgagatgaaggaatagcagagttgacttctttcccgggcatcactcactctcgcaacaattcggacagggaagggatataatccattcaattcttctgcctagcttttggcaatcaattccagatatcggaacagagactggaagcagcaaccagggctccatagtggtgccgtgaaaagagcctctcagtattagatagaaaaggctttccttgcctgcggatctttgtgcccttcaagtgccccttgctgctgtgggtaagaacgaacatcgttctagccagctagtgagagtttccccattgatctttgatctggctaatcaattttcaggttttttatttccttcaatgccgctggtgcatagtcagacttgcaggggcagctcaatcaagtagagacaagaccagctgttgaagcttggcagtggaatccaagagataagaagtagtatagagataagagaacgggattcaaagtagtagtagttgaaataagatagagcaagcaagagtagtagtattagcaaagaagattagaattattgtatccgctaatgggtagttgatacatacggacttagaagggcgaccctcacttccgtcaatcggctactggttctcggctgctaccatgctacctttttacaatcaatgaaatggcgctcacgaatagataggagtccgtccttcgaaaagaagatgctcgagcgtaagttatcgttcgtaacatgcctacgttagtcaccaaaagcaggtacggtttggttaccggaagaaaccctgaactcggaaagatatgctaactgggtgattagaaaaaagtaaggacacattgggttcgccgaacccttcaatcactcatccctcctgagatggaccacgagctggtggcaaaaaggataaccctctgactaggattgatagcgattctcttaataaaggaatatgcctcgtccgaggaagaatggcaagataggcggatgacgaaggagcagggtgaatagaaacacaatctggttgaagaaaaggaactacccccggggggccccggatagctacgaactggaatggaaggttatccagatccactagccacttctgttggtccgtcctttacagcaagaaagagatcatcgaggcggaagaaagatgaggtatcgatctcaaagaaaagaagaacttgaaagaatcagagattcaagtcagaagtgagggataaggagtcactctcagaacgataagtagatctcgcatcttcgttcctagtcaagagatggggaaagtaggcatatgaacggtaggaaggctcctgcttctttgccaaggactattaccgcgatgccgggccaaggagcggatctcggaataaagacatatccgtcactagcaatggttatcgaaaccttgaagggaatagacaagtacagtagggaaggaggtactccagggttaggtaaatatctgggttcgagctaggggttatattggttacgaggaagaccagaaggaaataaagcaggttagcaagcaggaggcaggaaagcaagatagttagcaagccggatcgaaagatagggcctttcgcactaagcaaaactgggtggatactttattttattgacctgttgaaaggaaagaaaacacctcgctgtgatcatataacctttatcgtaggatggtttgaggaaaacctaccggccacaatgattggtgtaaaatagggttaaattattcccaaatccaaaacgaatggggtatggtgtgcataaggaaccccttttctgcaagggagggacataaaccgatctcttttccn

SEQ ID NO: 22042 - DNA, 2235 bp, Oryza sativa
  unsure (1)..(2235): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacgatacgattaatctgatggcgcagcacgaacaggaaatagataacctagccctgggaaggaaagggaacagtttagtccctccaatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacactccctgtggtgctttcagcgggggattcgttatggaaagcgggaaactcaagtaagtacggcttttcgatagctaatacgagttgggatgacttgttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttcccgagagaagcaaaaattactttcgagggtttagttatggaagccctacccaacggaatgttccgcgttcgcctagagaatgacaccatcatcctgggctatatttcaggaaagatccggtctagttctatacgaatactgatgggggatagggtcaaaattgaagtaagtcgttatgattcaagacattatcacttatttattctcattataacgtatgcctttcgctgcgcgcctttatttgcttcggaaatcaaacaatgcatttcttctcaacataaacatataccggtctttctctctagcctatacttgaccttgcgtacaagcctattatcctatcggtatgcctatgtgacccatatgtgctaaaccggtacttgttacttacttctatctattaaacgttaccggtacttagttaccgtgacttaatcatgcttagtactaaaccttactacgtagttcaatccagctatactgagttctccatgttttgtaccatcactttgctctttgcttaaggcactcgaaacaaagcttcaagtaggaagtttgtgggacaattcttataggtggtcttaccaactccttttggntncttagaanggaagtttnaacagcaccattgcccgaananaacctggaacttganctgcaagtgattgaattggaacgattatatttcgcttcattgctaaaatnggccgaattcaaacttttcgnatgtcaagtggtatagaggttgacccgacctagagatatcgttgttatacctcaagaagaatccgttcaccggggaaggacgggccggggtg

SEQ ID NO: 22043 - DNA, 1722 bp, Oryza sativa
  unsure (1)..(1722): unsure at all n locations
ggaaaagagggcagagttttcggggaaccgggtttttaaacccgggggttcccccctgatttgaggcattttttaattctcaagggggagacttattaaacccacaaagggccttttggggttcgcgccttggggcctttgctcaaagtttttccgggttccccgtattggggaaaacggtatccgccttaagtaagttaaacgctcccgcaccggacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagaatccaaancgaaaagaaaaaagagaacatgttgattatagaaaaattaggaggaacctagaattagagtcttatggccaaggacactattgctgatttactaccctctataagaaacgcgaacatgaataaaaaaggaacaagtcatcccaactcgtattagctatcgaaaagccgtacttacttgagtttcccgctttccataacgaatcccccgctgaaagcaccacagggagtgtaaccggaggaggatgttgtcttttctcactcacccagtagtcgagggtgtattattacccgtttcactgacatctgccttcccttctctggagcagttatgtagataggagtggtaggaatcagcgagcatgttgccattcgaggtagtccaaccttcctattaattagaattctgggtaaccctatcgttgattgacggattggagggactaaactgttccctttccttcccagggctaggttatctatttcctgttcgtgctgcgccatcagattaatcgtatcgtgatcctggtatcgctcgagcatctctttctgatgaaacctttgcccttgctttctccactacacctggtaacgcacagtgcttctttcttcgatctatccaagggaggcttattgctttaagcagagtatccagttctgcatccgttaatgatttctgaacatagagaaaagaattgatagctaaagtttgcttttagtagtttagtcaccaatcaaaaaagtagctaggctgaagccgaagcacattccctagcgtactagcgtacgagagaagcacattccctagcgtacgagatatgccttttaggaaagagatcccttttatgagcaatggtttttgataatgctaacccctgttcaaagcaaaggtcgaagctggccaccctttactcggcatccgttctcatatgcatagatgctccaataagcttcttttagttagccaagcgggtcatgtggatgggtcaagagatgcgtacaatccgtcacaacgaagcgctcacccttccgctggggtggtttggtgaatgaattacanacatgtattagaaaaaatttacttttgggggaaagaggataacctccattgaaagagagcggtattattgttaggggg

SEQ ID NO: 22044 - DNA, 1199 bp, Oryza sativa
gggttactttattcccggccatttggggaatttggaggaaactttccacaggaacagtgttcccttttcgccaggcttttggtaccttaaaattccaattattctaaagttggtccaactcgtgttcattataaggcccgcagggtgttgaattccgcgaatatcccgaagtagaggccccctaggtggggtttattattatagggtgacagggttatattattcccattccattattatttgttcatacaaaggttaaaaggcaggttaaataaagcagtgccacggcgggattttaattaagcgataatgcaattttttaatcaacaatattttaccaactgggattccaatatgttcaagatatatgtgacttgccttgctcaagaagaacgggcttcgggaactttgggcagcgaccgcaaaacacggcttcgggaacctcgggaacgacgaaaggttcgcgaagcacacaaacaaagctacaagcgtataaagaagcaataacatcacataaaaccaaagcacagggttctttaggttataacaaacattaggagacttgaacgggtcgattcggagctcgtatgcccagaatatgatcatccgaagtttaatgctgttatatggagatttgcgaattattataattaagctttgctattataaaacaggtgtaagcgctagcctggaaaagacaggaaggctgcgctgttgacatgcggaccccacatgtcaacctaaaggaccgcggtagaccgaatacacagagacggtccacgggtcgacggaagcggaccccgtgtgtcaaccgaggcgagtggccaacaaacggactccactagacaccacacggcctgcacacgtggaaaccacgcggctaccgagcgggcacactaacacggtcaccacgcgcacaagcgaacgtctgccgacgccgatacacgggtaccggggccgacaaccgcacaatggcacgggcgacaccgaaaggacgaggacagggcagcgagggagagggaaccttaccaccacgcgacgaggcgtgggagcgacaacgacgaacgggcgcggcggagacagacgggcacaacggagacgaacggcgaggggacggcttcggcggcgatccttggacgaaagcgagctgcggccggcacgaggcttgacgacgcggagccgaggacgaacacgaggac

SEQ ID NO: 22045 - DNA, 2129 bp, Oryza sativa
  unsure (1)..(2129): unsure at all n locations
cgctcctgtttcagacaggttaaatttataattccatgggtgcggcaacttttgattccccattaaagagggactaaaacccaaacatggtggtccatttgattttgagagaaaaaactgcactgttttagggacngaaccctaattgggttctggaatatgggcaaggactgcaaaatgcttccatcccaggaaaagcttccttctattgtgtgttaaaacggaatacggttcttatgcttggaatcgccctccgaaggtttatttcccttggctcggcctggagtaggtcggggaaaaaacacaactttttcattaacgacaattcttttttgaggctgtcaatgaagagaatggttgctataatttattgcccagtcagggtgcagcaggaggagcattggtgcattgtttctgctatgggttctgattaacacgaggcttacggggtcgggcgtttgctccagtgaccacaatacgatggaaatgtctgcttcgtggtagatggcggtaatgtgaggtcgatttgctttggttggggacagttttggaagtaatgcccttcttcactgcagttgtaacaaacaataactttcttacactcgggttcttcatcttgaacttgatttctcagctgctgtattggaacttctaaagggacaacgcagatactggcctctgtcttgtcagctggtggctggggctgaaattgagcattgacaccttgtggtagtgcactcattgaagttggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttctttgtcagcagaaaactgaattgacaatcttttggtacatgatcagttccttcacaaaagaaacaagtgatcctgctcgttggacacctgtcgggcggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcacctcgggaggaatttcttctccgatgttttgtcattcctggtggaggccattctgtgctggtaatgatcatcttacggacttcatcttcggttcgcattggtgtttttcttttctgctgaggacgctcccttgcatagtgcacttgctcatcacacgtaaagcaaatgttacttgcttcttttgggccaacaggtggcacgtcatcatgggtccttcgggatgctgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggnggtggaaccgaggtcaaaaaggctgggngnnnnggggggnnagtagtaacagaaacataaaacgttgaaannnngagcgttatataaaagagaaggaaagtcgggagtctaagaacagatcagataaagggggggg

SEQ ID NO: 22046 - DNA, 3064 bp, Oryza sativa
  unsure (1)..(3064): unsure at all n locations
ccacgagtgaaaccctgagagcgctttgaganggcaatgnngagagcttgtgctctagatttcagtggaagttgggataagaatctaccctatgcagattttttatacaacaacagggatcaagctagtctacagatggctccgtacgaagcactgcttggtcgaaagtgccccactgcggtcttgtgggatcaaacgggagaacgtcaggttttcggaacggatatcctaagggaagcagaagaaaaggttaagatcattcaagaaagattgcgagtggctcaatctcgacataagagttatgcccgacaatcgccgtagagatttgagttttgaagaaggagactatgtgtatcttcgtgtcacgccttttcgaggagttcattctttttcataccaaagaaaaaattggcaccgcgttttggtgggaccttataagattgtcagtaaaagaggagaggttgcttatcagttggagttacctcaatctttgcaggaatccataatgtgtccatgtgtcacaattgaaaaagtgtttaagggtacctaccaaagaagctaatattgagcagatagaagtccaagaggatttgacttatgttgagaaaccaatccgtatcctggaaacaagtgagagaagaaccaggaatcgagttatccgtttttgcaaagtcccgtggagtaatcactcggaagaagaatcaacttgggaacgagaagatgaattgaagttagctcatccgcacctgtttgccagttcttccgaatctcgaggacgagattctgtttaaggggggtaggtttgtcacaccctgaaaattcaaaatatataaattgttgtttaaatggaatttctagaatttattttaaaagtcttgaaaagaaaatctaagtttaattaataaattccaatataaaattgggccagataaaatttcattaaatactttgcttaattctttaattcctagatttttctgggatttatttgagctaaggaagtatttttaataaatggaattgcatttaagaaataatttaaattgaaaaggttttaaaaagtcttcttttggctttgggccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcgccgccgccgagccgccgccgctgtttccttccaatccggccgctcctttccttctccggccgaatcaatagaggggaaatgatctccgggatctcctctaccttttctcctttggaatcttcggctaaatcggtttggaaatcgatggattcgagttcgaatcggatcggctttcctctctccaagccgcgagtttccttcgccgttgccgtcgccgtgggccttcgccgccgcctccgagcccctttaaaaggacccccggtgtctcctctacccgtcgcagctctcgccttcgcctctcgtcgccggaagagctctagcgccgtgtgccctagcttcgccgtcgccgccgccgcttcagccgtgctccgccgtcgctccagctgtcgccgtcgctcgggaagaccgccgccgtcatcgccaagtcgccgccgtcctcgtccgccccttcgcagccgtcggaacccgccggagcttcgtcgccgtcgacaacccgaaggtagccgccgcttccttctcgtcgccgtcgccgtccgttgcttctccgccgtcgttttggtcgtcggtgagttcgccgtgccgtccgctacccgttggtgtcctccgttcgtgccgtagcgccgccgttcgccggtgagcgtgcgccgcccgagccgtctgcctcgccgagccgccgccgccgtcggtgacgtcatcgctggcgtcatcaaggccgtccgccgtgaaccgccgtggacccgatcgatctcggccgtccatcttgaatcgggtagatctcgggcgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaatccgatttaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttacgccgatctttcgtttatttccttcttttttgcacagttgccggtttcccgttaaattttaataggggttcccttagggttcgattagggtttacggccctcatcccaaaaatctataggtgatggcacctatgggccctcccctataacggtttttgctcttggggggaaccattttttataaggactttgttcaatggacaaacaccccttattgggtattttttgttaaaggatttgcccttccgctatgggtaaaaaagtcgttttaaaat

SEQ ID NO: 22047 - DNA, 845 bp, Oryza sativa
acagatacagattaaatacagtcgtgaccgactaagtttcaaggtgtttccttgatatacaagttaggaaacaaacccaggatacacataagatattctatctatattcggtatcctatattcagtccaaatatcatcgccgtgtagatatgggatatccataatctccacagtagcccccgagacctttgcagtcaaccatcatagccttctcaaagacaataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcacaatcatgcatcatatgacaaaagcatacgcggcacccaaagaggcattctagccgactgctttttagtcacaataaaaggaatccgagtggttaacactctaaaaagttcacgaatgaacacacttgacaggcatccgaatataagactctaaagattacccaccaaatatcataaaaatcatggtaatgaataagtctaatagcctaggctatgactatttaccataatgaaaacaggcatataacataccgaggaaatgactatgataaaaacaagtcatttcaagttaacccagacagcttttgtagctaaaaaagcgtacaaaaacagcataacgccttttgtcgggcaccttttaatttgcatcgcaataattcaaagaattatatgaccgcgtaaaaaggattttatcagcattgggcaacactattgtgtacataaa

SEQ ID NO: 22048 - DNA, 613 bp, Oryza sativa
atcaaatctcaagctcagtttgacgtcctggttggtaagatcaagaagcttgaaggagcaagagacgaagtcgccaatgtcgctacaccactcgtccaagctatgtttcttaataacagtggtccgagtgcacttgacgcaaccgagatctttgacaagctaagagttgcaccggatgtgtacttcaagaacatcaagaaagctggaagtatgggagctagcatggcattggcaatgaccaaatccttgtacccgagaattgaaattgacaccattgatggctttgcagacgggacaagcgaggaggctgcccttgatcttatcagcaatgctcaaatgcggctgacaaaattgcaagtgacattgtagagcaattccgtaacaacgaccttcagccgagtagtaataactctgatgatgaaaggactgattctgactgagtatgaatgtagcaaatggaggctcaatttgtacaatactggtgtatttatgctgtgcttgatagttctagccaagtctttgatttcttaaaagtttttatcaaagctttgtgagcctaaaacccaaaggagctattaaaaactttcagtcctcgcagactaagtagaaaaaa

SEQ ID NO: 22049 - DNA, 3914 bp, Oryza sativa
  unsure (1)..(3914): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagtaatattcctagcaggatcaaggggactgccatgattatcccaaattgtttgcaccaagtcaaaaaggccctcatgctccacccagtaactctcaaatctaaaggtatgtgctttaggtatatttatcacaatatgcaccacacaagggatatgatccgaaaaactattcttgacaatggctttaccattgtgttagggtaggaaagagtccaattcatgggagagttcaatagatacaacaaaggttgatgttgcatgtaacttcaggtgtaagccatacctttaattggaagttcaaaaaacccaaagagctaatgacctcattaaaaggaaaaatatcattcatgtcagctctaggtctatttctgttcagaacagaacaataaaagatgatctaagtctccaagaagaagttgtacaatcttgtcacattggtaaaataatgtgattcagccaaagcaatgcgagcaacctcttgagcttgatgattagtttattttgagtaaatttcactttaggttacattttattactattttttcattttggactaccctttaaaattatttattgaaagatcttgtttttttaaaaaaaagtattaaaagagttgaataatttagtaatttcttgtccaccacatgcatcaagcaaaaacaagcccagatccatgcatcttctccttgacgatggtgtcaaaacactccaccatttccggcgtcatgtggattttccagtctccggccttccctttccggaagtatgacgcattcgggaaggcgaacgatgcctctcccatcttattcacctccaagctcttcaggttctcgaagctgcacagcctcacaatatctgtcaccagtccagcttcttcctcggtcgatgagaacggctggccaagaaagtcggcgagcttcctgacgatgtttgccggatctcgcagaaggtcctcatagaccagaaacaggaccttctctgggttcgccttgcaagcattccagtagccaataatgtgatcccagatagcgccggtcaagaacttgccatcgcaggcagcctcgaacacttcttgaaatgaaagatcaggctctataattctgaagaagtgccaggctgagaccaggatatccttcggctccctgcaatttgctaatttgttagcaattttagaagagtaaaacccaacgaaaaatatgagaatcatgagacagaggttcgaattgtcaatgataatctggtgcctggtatcagtactgatatatcatccaataaaaaattgtttgccagcagcgaagcttgaatgttgaaatgctaaaagggcatgtttgatcgggccaatagcgttatttttttttttttgaaaatttgctaaagctaaagtaaatttagtgtaaaattttgatgacatgggaaggcatagcccctatcgcctcccctctgtctccgtcattgttgtttgcactatgccggtcatcaatcatccatgttgaactggctagaagcatgcccagatcgatacaaaagaaccagatataagagaaatattctgaaagagggtaccaactagatataagaaatttacctgcaaatataaacaaccttgcagccaggttcatctgcaatggacttgggtagagcagcgtgctgcatgtgggtggacatgagcctcggcgacggcagctcatcaatcttaccaccccatccttcagagatcgccccctccatgaacgggacgcagtcgtgcgggttaagacggaggagcggatgccggtcactggcaggggagtaggcgccgcgcgccaagacggcgaaggcgagcgccttgagccaggtggtgccgcacttaccggggctcgcgaggacgacgtcgccatggcggcgcggcacgaagctccgctggatggccatgatccctggaagggtgtactccatcagccacatgccctggtagtgccgcaggcgcagcttgggatagctcgggaggctggacacgacgccggcatactcctcctccggtgaggatcgctgtgccattgcgtctccgatgacgtccttgaacggcacggggccaatggcgccatgttgtggcttgctgggggctgccattctgcctgcatcaactggcaagggaatggaccaataaatatagaggagacgatggagagtaccaaacaagatactgaagatagacttatcaacttgacattggcattgatcggtttctgaaaatcttatgcacccatgtcaaatgtcggatgacacagctagcttaattaggctgtgtttggaaaatgtggttaggaactaatcccctgtgcacgtaaaatagagcaatcgttagcatatgattaattaagtattagcttgaaaaacttgaaaaaaaaaattagtacgattttttcaaacaactttcatataaaattctttttttttttgcaaaagaacacaccatttagctatttaggaaacgagggagtagtagttgagaaacctagattaccaaactcagccatatagtgaccacctctgtcacaaaattaatcaattactactatagtttaaagttagtctcaaaataaatcccttttacattttttatcctctcaactatcctcaattcagcaattaactgttttatctcttcaaagctactcacccaccaatactacttcttattaacaatgggcagggtaatatttttttttaccactagagttttcatcggatacaagactagctatgatttattatggacagagggagtagttaggacattttggctgtgttctttctagtgagttcccaacatcaactgcaccatgtggcttgctggggctgccatactgcctacatcaactgacacgggaatggaccaataaatacagtcccataatataagggattttaacttttttgtttacactgtttgaccattcgtcttattcgaaaagtttatgcaaatataaaaaacgaaaagttatgcttaaaatactttgaataataaagtaagtcacaaataaatgaaataaataataatccaaaattttttgaataagataaatggtcaaacagtgtaagagaaagtcaaaatctcttatattagtggatgaagggagtagtagtagagaaaacggagagtaccaaattaaagatagacttatcaacatgacattggcattaattgatcggtttccaaaaatcttgtgcggccatgacagatgacagctaacttagccactgccaccgtcagaaacacgggtggaaaaaccatctttcgtcggtccggcaaaattcacaatagtcccggatccaaaaagaatcgggactaaagattgtttttagtcccggttataaaaattttgatctaccaaccaggactaaagacgatctttagtcctggtttatcccttgtcagatgtatgtcagggggtcgaggatctttagtcccggttggtgtcaataaccgggactaaagatcaccactttagtcacggttggtactaccaaccgggactaaagataaagatgatctttagtcccggttggtactaacaacctctactaaa

SEQ ID NO: 22050 - DNA, 44923 bp, Oryza sativa
agagttttatctcttcaatcctcttaatccacccagccactaatactacttcctattaacaagggacatcgtaattttttttctcactacaaaagttttcgaagctttcatttattagtctagaggagtagttagggcatctcgagttgcttctatatatggaaagagaattcatgcgctattgaacttttgaattaaagagcaaacaaagaaatgcatgtattgcaggtgcactaagtacctataaatcaattaatttagaaacatgcaaaatagcatcagggactaaaggtagtactacggaaattatttttttagatgactgataaccgaaatgcagtgaaccacatgtgatttaggccctgtacagatcagtgattttcatatataggtgcctatgataaaatttgcagtgtttttatttatgtaggcgccaaaaaaatcaaaatattccacattttactatgtatctatacacggccgtgtgtctcaacttataagtcacgcaatttttcgtgtaaaatattcacgtgcggaatatataatttgaacccaagagctctcattccatgcatatgctccccttgacatcttacctgtcaaaactttcatgactataaagcatattatgaagtttttaacttgacctctataaaaactacttgtaatacatatttggtacttgaaatatcatcaaatgagaaaagtaatcaactaaaaggttctctatccaaggttgtctgaaaaagtaaccaacgaaaagtaatctcgttgagctctacaactttaagtagagcatgtctccattcgaggtgttgtgaaaaatgaaaaaatatggtttataaaaaagatccaagagcttttgatgaatatttaggcctacactaattaattaggtagtatatataggctgttttctccgttcgctaatcggtttttacaggtggcacttgaaaaacttcctctacatattaccctttttaaaaatatatcttaaaaagtatgatcgatatttggccccaaaacgatctgaaatgaaaaagaaaatttaactaaaatgttgtatatctcaggagctccagttttcatgtggaagttgtcatcaatatcgtgaatttcttcaataaaaaaagtgacttcacaaacaatttcataggaaaaccatttgtggaaatagacctatttcataagcacattatctctttgaatttgtatttcgcaggcagcctcagccatcttcataaaagcgtctagaaatttaatcgtatgctcccataaaaaaatcattttcaaggatgaacttggacaagcatatgttcaaaagtttatccctagaagcatatataaaaactatatattttgtatgtataaatggtgtctatatctatatttatatatacactaaaataaaaaacgggaggttcactttttattagagtaaattgcataggcgctaaatttgtacacctatgttgtctacataccaaaactctcgaaatgcatatttatattcagaaatttatcccggacgtcatcatagatctcctctgaacttatcccagacttgtatgtcccaatgagggtcgggcccatatgtcagctgtggagattatggataccccatatctatatgacagttataatttagtcggatatacggtaccaaatatagatagaatatctttacgaggactcgggttagtttctaacttgtatgtcaaagaaatacccgagatcttagtcggttacgattgtattttacctgtaatcgcatattccgttagggatatggactgtattttgtaatatggatcccttcccctatataaggaggggtccgggttcctctcgggacgatttttttccctagatcatacaatcaataatctactcggcggaatcatccccggacaggagtagggtattacttcttgaataagaaggcctgaacctgtataaaattccttgtctccaaacctatccacttttctagcttgatagctaccccttttagtattgccgaaatcttgtttcgacagttggcgcaccaggtgtcacgcccggaatttctatccaaaattccaaacgcttacatgtgtgtgaaccctcgtccaggaatcagccgaggcacacaataacaaattgataatagagtacaattattactcaaactattaagcatataaaatatcattacagaggtagatagttcctctcaatcaataaagatctaagcagcggaaaaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaggataacaaaggatggcatagtggggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattatagcatcatttaccatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggctggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaaaagtgagctaatgtttctaagcagggctaagcaattatatctaatatctagttgaaccaatatataaagctcaactagtcaagttataattacccaaggtatcaagaaataaagtaaacaagaacaaaaggggctataacaaagaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttatatcgatttaaattgaattatgacgcaataatgaattatttttgaaaaggaaaagaaggtttattgcgtcagcgggctagggtttcggtggaccgggcgcacgggcggcggttcacgcgaacggacggccgagatcgaaccaatccaagatggacggccgagatcgatcgggtccacggcggctcacggcggacgaccccgatgacgtcagcggtgacgtcaccgacagccgcggcggctcggcggagcggacggctcgggcggcgcacgctcgccggcgaacggcggcactccggcacaaacggaggacaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgcgacggcgaacacgacggcggccttcccgagcgacggcgacggctgaagcgacggcggcgcacggctggagcgacggcgacgacggcggcgctagggcacacggtgctagagcttttccggcgacgagaggcgaaggcgaaggtggcggcgggtagaggagaccacggggagccttttaaagggactcggaggtggcggcgaaggcccacggcgacggcaacggcgaaggaaagctcggcttggagagagagagagcccgatctgattcgaactcgaatcccttgatttccaaaccgatttagccgatgattccaaaggagaaaaggtagaggagatcccgaggatcatttcccctctattgattcggccggagaaggaaagggacggccgaatttggaaaggaacggcggcggcggctcggcggcggcgcgctagggtttcggcccgaggaagacgacgggcctgacaggtgggacccacctgtcagcgaccgaacgcacgcgcgcggcgcgggcggctgcggactaggccggactgggccgaggagagagagaaggcggattttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattattttctagaaattccatttaaacaacaatttatataatttgaatttttagggtgtgacaccaggtaggggcagcgtcaagtttttgccgacaaagtgcgatgggttccgtctccggcgtcgacgacctcgccttccctcctgggcaggcgttccggttcagcagcctcaacttcatcacgaacgaattcggcaagatctctctccttgactcggattcgaaccagtcggggagagatcaagtccccacgccgttcggtattctgaactcggccgagaactacttcaagatcatctctcccaagtcggctttaaaccactcggacgagatccaatctactcctcagcgaccagatcaagatgacgggtcctatccctcaatcctgatgagacttcctaatgatttggccgctgtcttcacagccaagacatctcccactcaaagatctaggcgagctccggcttcggccccgatccaatctagatccagagaggttggcgttatactccaacctcttgggacagtcttgacggaagagttggacggctaccttagctcccctggcgtaagttctcgaccaaccgaaatcctcgactacgacgacttcggctaccaccacgaccacgacgacttcgacgatagctataaggatagctacacgcctctctttttcggcgtattcatggctgacaacgaaacggaggaacagcaccgagctcgagaagtggaggaagagcgcgcacgacaagaaactgaacgtcgccgacaggaggaagaacgacaacgacaagagcgagaacgactacagcgtgagcaacaagatcgcgagcgagttgcaaaggaggctgaagatcgacggtagcgcgccttggaatccgggcgacgagcgagagagctcatcgggcaacaagacgtcgatggaacaacggtttttcgcaccccccagcagaacgcggttgcagcaatcactctcctcgacaccctccccaaggaagacgcactcaatcaagttgatcatgttgtcaacatcttgaaccagacgaagaccatgatcgctgcttcggttctagccaactccgcaagcactcgcacgccgactggtagccgggttccccatctccgatctcatgattatcatcagccaagcctcagcatcatcggtacaggatccgtcgcaggagcagggaccacgacgaatgatattttcactcgcctcccgaacgtcacggggaacgccgagtcgaacggcttcgctctccacctcgccaacgccccgtcgatctttgcgacacgatcaactagcgccatgcagcacgaggtcaccgtcattcaccagatcgctacgacgacgacgtggatggagtagctgccttcactaatgacctgcgtcgagtggattggccagccggcttcaagccgactggaatcgagaagtatgacggcaccactaatccggagtcttggctcactgtctacggactcacaatccgcgcagcaggaggagacagcaaggccatggcaaactatctacctgtggccctagcggattccgcccgatcctggctccatggactaccccgtggcacgatcggatcatgggcggaacttcgtgatcacttcatcgccaacttccaaggcacctttgaacgccccggcacacagtttgatctctacaacgtcattcagaagtctggagaatcccttcgagattacatccgacgcttctccgagcaacgcaacaagatctccgacatcaccgacgacgtcatcatcgccgcctttactaaaagcattcgccacgaggacctagtcggcaagttcggacgcaaacctcccaagacggttaagcagatgtttgaaaaagccaacgagtatgccaaagccgaagatgctattaccgcgtccaaacagtcgggcaccacttggaaaccgaagaaagacacgccggctgcaggagggagtggaagtaacaaccacaaggatcgcaagcgtaagcccggagaacttgtggcaacagcctctccatcttcccgacaacgttcccgcgtcaacaccttcgacaagataataaactcccaatgtccgcatcatcccaactccaaccatgcggccaaagattgcttcgtctacaagcaatttgcggaacaatatgccaagaacgcgcgtaagccttcagacagagatcaaggcacatcaaagaagaaagatgacgaagacgatgccccgactggttttcaggactctcgcaaagaactcaatcacatcttcggcggacccctggcttatgaatctaagagaaagcagaagctaacagaacgggagatcaatgcggtttagcctaacacaccccaataccttcggtggtcagagatagcaatcaagttcgactgctcggatcatcccgaccgagtggtccacccggggcggtaccccctggtactagacccagtggttcgcaatgtcaagctccgaagaactctcatcgatggtggtagcgcactcaacatccttttcgctaagaccctggacgatatgcagattcctcacatggaattaaagccgagtaatgcacccttccacggtgttatcccaggattgtcagctacaccactcggccagatcactcttccggttacctttggcacttgggagaattttcgcaccgaaaatgtttgtttcgaagtcgcttatttcgagacagcgtaccatgctatactcggatgaccggctctagccaaattcatggccgtcccacactacacctacatgatgattgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaatagcggaagactagggcgacgaccacaggcgcttgacgacaggcacgagctagacaccaaagccttcatcttccaggggctcctcttctgggtttgggcaaaattgagcaagactgagtacaaccaccgtactcaacaagacacacccacaagtgcagaataaatgcaagggagtacaagggggttaaaatataaagggttagggtttgcagtaaacagcattaaaagacagttagttgctcaaagctattttgtaaacacgatcctagagctatacaatattattaatcaaggccgtgaacccacacgaacctgccttaacccaaggcctacgatgattcagaccgaactggcaacccgaccctaggtcccagctcgtcccaagccaacccaggccaaccattctacattttggttgttaagcaggttttaagaattaaaaatactaacttgggtacattgctcggcttgcccataaccgagggcgcggctattcgaatagattatactctgatcagaggtgtacatctttacccacaagacacatcttcctcatatgtaaccacatgccacataccaccacggtatacggacggaagacgtgacatagtttccaacccatcctagccatagataagagtaccgacccaaccccacctacggccggaacctccgggacaggtaggcaggactgagcccctagcagcaggacaccggccctgtgccatgacatctcgactactgagccgcagctcgtgtagccttcatttgttctagagatgtccatcgacccccgacttcgtccatctccatccgtgtacttttgtttataaccagactgagccacaaactaagccttacccactagacatgtggaagtacggtagtgctttgcaacagaggcctgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaactagcgaagcatctacctaaaatcatactagtggtaccatgagtagataacaataataatatcaataacaataataataaggtcataacaaaggtaaataggtatggctaaataaaacagtgataacgcgggaatttaagtaaagcgataatgcaatattttaaatcaaaataattttataaactgggattcaatatgctcaaggatgatgtgacttgccttgctcgctttcccaaacgtcggcttcaacctccacgaagagcggatcttccgaagctgcagcgtctacacgaccaacggaaaagaaatggcttttactctaataaactccatataaccagcaggaacaaagcacaaaaatgggttattgacttcataaggaaaaattagagacttgaacggtccaattccgagttcaaatggccaagttatggccatttgaagtttatatgctctttaaatgaatatttgcaaatttcttcatttaaattttaattaaaaaaaggtttattgcgtcagccgaggggaggggcgcgcggaccgggtccacgggagtggggcccacgcagcagccgcacccgagggcatgggcggctgacggccgggccccacgcggcagccgctcggtgcgcccggaggcggccacgccggcgcagcggcgtgaggctgcgcgcccgcgcccctatggtcgccggcggcggccataggcacggcggagcggcggccgagagaggggagggaaagggggaaacgaagcgacggtccacggctcaccccgggtcgacggcggcgacggaaacggcagtcggagtggaggaaggcggcggcgcggctcgggtggacagggtcgacggtgctccggcggtcggcgaccgaaacggagagctggacgaggtcggcgaggatgcggcgaaggcgaaggaggcggcgccgaggtgggaggtggtccggggcgacgacggcggcggaccggagctcggcggtgacggcggagagagagagcgatgtcgcgagctcgattccggcggggagagagggcggtgagtggcggaaacggtggtaggaagctcggggagggtttaaattgggttggaagggggagagagcgcccggaggggaaggaacccggtgcgggaggtccggccgccatcaatggcgctggcgagatttgaacgcgagagagagagggaaaaatatggggaaagggagaggggatcacggggagtaattccccccactttattgcacgtggggacggcgggaggcggcgggattcgcggctgcggcggcactagggcgcgggggaggcggcgggagcggcgggaggaaggggatgacgggtgggccccacccgtcagcgagggtggcgggcgggcccgcccgtcagcggcgcgctcgcggggagagggcggatgggccgcggggagaggagagagagagagagagcgggggggagagatgggccgggccggcccaagggagggaagggggactttttagggtttttctttttataaaacctttttaactttgtttatttcttaacaattattatttgtgctctgaaaattccactaaaatttagttacgtattttaggcttctaggaaatatacaaaaatcctctaagcattatttgacttttaactttgcacattttatttgttggagactttcacatggattttaattattctaggcataatttagaggatatattttagggtcgttttaggacgtgacaatgatgaagatgcctgctcctcgaggagtcatatcactatggagcgacatcaagcaagccgtcacatgtgacaaagaaagttgcgagatggcccaaacccgcgagatcacccttgctcgtgaagagatccgactgactacgactatggcaagtgaaggagaagtgcctgcgaccaagctgtcaaagaccaaagaaggcaacgacaaaactaagaagattccactagatccctccgatcctaccaaaactgttgtaataggagctgagttagattgtaaataggaaagcgcgctcattacctttcttcagaataataaagatatttttgcgtggaaatcatccgatatgcctggtattcctagagaggtgattgagcactccttatatgtcaaggaagatgccaaacctatcaaacaacgactccgccattttgcacaagataggaaagatgcgatcaaagaggaattaaccaagctgttagcagcaggcttcatcaaagaggtcctccatcccgactggctggctaatccagtcctagttcggaagaagatcgggcagtggcgcatgtgtgtcgattacaccaacctcaacaagtcttgccctaaagatcctttcgggttacctcgcattgaccaggtggttgactcaacggccggctgtgagttactcagtttcttggactgctactcggggtatcatcagatctgactgaaagaatccgactgcttgaaaacctcgtttattacgccctttggggcctactgctacatcaccatgccctttggattgaagaacgcaggagcaacctatcaacgcatgattcaaatatatttttcaactcagatcggccgcaatgttgaagcttacgttgatgatgtagttgtcaagaccaagcagaaggatgacttgattgcagatttagaagaaacttttgcaagcatccatgttttcaggatgaaactaaaccctgaaaagtgcatcttcggagtaacgtcagggaagttgctcggatttatggtatctcaaagaggcatacaggccaacccggagaaaatcaacgccatcctcaacatgaaaccgccgagctcccagaaagatgtccaaaatctgactggttgcatggcggcgctcagccggttcgtctcacgactcggcgagcgggggatgccctttttcaagctgctgaagaaaaccgacaatttctagtggggacccgaagcacaaaaagccttagaagacttcaagaaacttctcactactccacaagttttggcctcgccacatccacaagagccgctactgttatatgtgtcggcgacctcccaggttgtgagcacggtcctagttgtcgagcgtgaagaggaaggccatattcaacaagttcaacgaccaatttatttcgttagcgaggttttggcctactccaagacaagatatcctcaggttcaaaagttattgtatggtgtcttaattaccgtcaggaaattatctcactactttcaaagtcactcggtcatggtggtcacatcgtttccactcggggatatacttcataaccacgaagcaaacggacggattgcgaagtgggccttagaattgatgtctttggacatatctttcaagccacgaacttcgatcaagtcacaagctttagctgattttctcgccgagtggaccgagtgccaagaagacatgccagaggaaaagatggaatattggactatgcattttgatgggtcgaagaggcttacaggcactggagctggggttgttctaatttccccgaccggagaaagattgagctacgtattgtggatacatttttctgcgtcccataacatggcggaatatgaggcgctgctccatcgattaaggattgcaatctctctaggcattcgccgactaatcatccgtggagattctcagttggttattaatcaagtcatgaaagagtggtcttgtctaaatgataatatgaccgcttatcgacaagaggtacgtaagttggaagataaattcgatggacttgagctcacccatgtcctcggacataataatgaagcagcaaacagactgtccaattttggttcaaaacgggaagcagccccttcagatgtgttcgtcgaacatctttacgaaccgaccgtgcccagaaaagaaacaattgaagccatggatactcaaggcgtaagcatgattgaagccgactggagagaacctctcataagatttttgactaaacaagaactccctcaagacaaaaatgaagccgagcagatttccaggcgcagcagactctacgtcatgcacgagaccgagttgtacaagaaatgtccttcaggaattttgcagcgctgtgtatctttggaagagggaagacaattgctgaaagatattcattcaggcatctgtggtaatcatgctgctgcatgaaccattgttggcaaagcctatcggcagggtttcttctggcccacagctgtttccgacgccgacaaaattgtgcgaacatgtgagggttgtcaattctttgcccgacaagctcatttaccagctcaggagttgcaaaccatcctgctgtcttagctgttcgcagtttgggggcttgatatggtcggtccatttaaaaagcagtcggtggttacactcatctctttgaaatattgaacaccttcgtcaattttgtgcttaggcatttcgtttgtatctttcctctttgactgctaacttcaagtttttccttgaagttttcagtcggggggctactataataataatggaacatgatttttatcaattcaatttgcttacttgatttatcattgccatgcttgattttttggcttacacaatgaggactgaaagttttttaagaacttttgcgagttttagactcaataaggtttgacaaaagcttttaagaaatcagaggctaagtttgaaatatctagcacagcataaattcatcagtattgtacaaattgatcttccatcatcatcagaatcactactactaatcagtgtcagtcttttcatcgtcagaattatcagacccagtcggccgaaggtcgacatcttggaatctctcaactacgtcagcagcaatcgtgtcagcggctttttgtgcatcattgatgaggttgagggctgtttcttcgcttgtcccgtctgcaaacccgtcaacggcgtcaatatcgattttggggtataaagatttggtcatagctaatgccatgcttgctcccatacttccagcctccctgatattcttgaagtaagtatccggagcgactctcagcttgtcgaagatctcggaagcatcaagtgtactcggaccggcgttattgaagaacatggcttggatgagtggggtagcggcattagcgactttatccctagccccttcaagcctattgatcttgttgactaagacatcaaactgcgcctgggacttgatcttgcggtctgcatcaacagattcacattaatgagtcagcatatagaagataatggcttttgaggtattgattattggtaccttcaacctcctttaatgccgagtccctctgtcttgccagttctgccttgtcattttccagagtttgaatctgcttctccagttgagatatcttggcagcttgcactacattgactctggttaatcaagattacaaagataacagcacaagttagttgggcagagtttgtgcgtatcttttgatgagccactcagttcaaaattggattccttgagctcagcaatccgatccctcagatcatgttcattcttcctggcaagttcttttgtctcgtgcagttgattcccggtggcttcgagggttccgagatggggggctaacctctctaaggttgccgttttagctttgttcctaagatgaatcctctgcaagacagtttaattagcgcttgaactaaatggcaaacgagatggttgagatcaggcgccaaagagcttacatttacaatgcgggtggcctggctgagtgccttcttcagcaagcatacttcttcatcttctttttgtttgtttattacgattccttgaggttgcctatcatcgtcccaccacttgactaggatgggagggcgcgagtcttcagctacttgtatacggggaatttcttcttcgtcaccaatcattggtcctaatgaatccactgacaaaggttagacaattgattagaatcatttggataaacacggttccaggcaaggtgtttacctgtaatgatttccggacggggacgagtcgactcttgcgtcttaacgggagatcctggtgtcgggtcactgctggtgtcttgtttacgagggttgtctgcctgagctccaacttctggaatttcttggcttgacccagtgcccgactggttttcagtcgagggctcctgattaactccggctccagcttcggccgactcgtttctggttgagggttaatcaccagatcctacattatcggttgttggctggttatcactcggatgatcctcagcagttggctcggtttcttttaagttcgttcccgtgctggtcggatcagagtcctttccagaaggatctatgttagatggtttcctacaagttttgccatcagtgttattttcacgatgggagaatattaatacaaggaagattgttatatgatttatacctggaagactttctgatttttggttcaggacgactggaggttttcttcttcaaattagttggcttcggaggtcttccagttgctcctttatctctgagctttccggtatcatcgccttcgtcgtcacttggaactagcttcctcttgcgagaatctgactggccgactggatcagaagcatttggttgggtttcagaccgaattcttggtcctccacttccctgaccagtttggcggcgaggtgattggtgctgggcgattggaggatctgacttcaacaaagcaaattcctgggcgtaatatccttcattgttaatggattcaacaaaaagacaagaccatattttgtgaaaggttgaagtgtttgattacataccggtggaggaggattgaaggcattgaatggcacgactggcagcaagtgcgaatagctgacgacgatagcatttgagaagatcttgtacatcctttccttcatgaccttaaagtcaagagagtctgaatcttaacgatttggatcatgtttgccgtcaaactcaaaagctgtgcgggatctttctttgattggagctaaccggctttttatgaagtgccgagtgatttgttctccctgcaaaccctgctcctttagctttatcatgcgctccatcagttccactgcttgcgcagcttcatctcccattggcagtgagttccaagtatcccgataaactgaaggaagacaggagtactcggggagagcaggctcagggttttgaacataaaaccattgcgtgccagcctttatttgaggtcttgaagggcatgaagaagtatttttggcttagtgttcccctgagttggaaaccagcgcccccaacaacacatggtttgcccttgtttggctgaggcttaaggaaaaagatacggcggaacaaggcgaaatgtggcctaatacctaaaaaggcttcgcaggcatgaataaaattggcgatgtgaactatggagttcgggttcagatgatgcaggctgattccatagaaattcagaattccccgaaaaaatcttgaggttggaagggagaaaccgccatagaagaaatgagcaaataccacgatttcatgcgtatcaggggtcgggaatgcttcgccgaatgctggtcgccatccgatgatctcctttgccggaagaacgccgtgcgccaccatctccttcagattatcttccgtcacatcggagggcgcccactgactctcgaagctttctctttcttccgccatgaatgtgaactggatggtttaatttggtccgagatatggctggaaggggatggggaatcggagcggtggatgcggggagaaatttcgtgaagtttttgaggatggattggagcggattgatgaaccctagttttgctggcgcagctttgtactgtagcaggaaatggggaaaatggcgagagtctcggcggggaagacgaagagacgttttatttcacttcggcgttattagggtatcgggagtgctaacaggcctgggcctgtacagtgcttcagcccaatattattaccagcgtggcccattgtgatctttagggacttaggcgctttttgctttgccaatttgtgctcacaatgatgtgacccgatgctgctaaaatcctttttaatgcgattagataattctttggaattactacgatgcaaataaaaggtacccaacagaaaagtgttatattatttttgtaagcttttttaggctacaaaagctgtttgggttaatttgagatgactggtttattagtagtcattctcttagcatgttatatgcttattttgattatggtaaggattatagcctaggctattaaacttcttaattaccatgatctttatcatgtttggtggatcattttaagagtttcttgctcggattcctatcaaatatgtctatttttggaccttttgagtgtttatcactcgacccttttcgtattttttatccttgatatgttcaagatgagaagcagtcggctgggtattttactgagtaccatgcatgcttcgctataaaaccactcggctcttaactacatgtttagttcttcaactaatcacatagtcgggggctatatctaattaggtgcatctactcgatgcaccatgttttatttttgcccttcacagtctttgattttagcactcggcaagctggagcaggttgaattgaagtgctcggattactgttttttgtttcgagaaggctattatgtcaactgcgaaggtctcgggggctactgtggagattatggataccccatatctacatgacagttataatttagtcggatatacggtaccaaatatagatagaatatctttatgaggactcgagttagtttctaacttgtatgtcaaggaaatacccgagatcttagtcggttacgattgtattttacctgtaatcgcatattccgttagggatatggactgtattttgtaatacggatctcttcccctatataaggaggggtccgggttcctctcgggacgattttttttccctagatcatacaatcaataatctactcggcggaatcatccctggacaggagtagggtattacttcttgaataagaagccctgaacctgtataaaatttcttgtctctaaacccatctacttttctagcttgatagctaccccttttagtattgccgaaatcttatttcgacatcaaccctctagtttaaccctaagtccacctaagtccacctgtcagcagacatgtgtcaacaccggccagcacagacacaaaggtggaggtgcatggaagagctcatggaccaaacccgaggactcagtggtggcactgctactggagctgtgtctacaggacgggctgctcttcccgctgctcgaatcgtcaccgccgacatcatgtgtaaggccatagcgccatcgtcgccgcagatgtcggcatgtccgctgtcctctcgcttccctcctactttgggcgatgccaggaatgtgttcctcgacagcaaggaaagtattttgactcgttaaccatactgtattcaccaccagatctctttggccatccttctctctccgatgggctaagatcttgtcacccgtgtcctgtttgtccacatcatattctgcaatgccagtgacctccctggtgtgtgccaccctgttggacgcatcacgccaccggatcaccggcgctcgacctcttgaatgcgcgggtatatgtcgtatgcttagtttgagatatttataagagcaaaatattaaccggagaacatctgccatgatttcggcattaattacttttataatttttttaacctgttagttatatattctatcatatttaagtaatatctataaataattatttataatcttcttcatcatttgaaaagaaggtagagttattttatttagaaaacatgtcaacgaaagtaaaaaataagtgtaaaataaaagtaagattttttttctttttaattgcataatattatcatggtttattagaagatgatttgggacatcaagctccactaaattttatatagcctaatatgattgacatatacttgtgatataatacttattttcacttttttataatattgtgttctttttgctatttggttaccacgcacaggataggtgtctatgttcaaatggctcttttttaacttaaaatttataattgtggagattatggatatcccatatctacacggcgatgatatttggactgaatataggataccgaatatagatagaatatcttatgtgtatcctgggtttgtttcctaacttgtatatcaaggaaacaccttgaaacttagtcggtcacgactgtatttaatctgtatctgtgtattccgttagggatataggttatcttttgtaacccggactccttcccatatataaggggggtctgggcgcctctaggggcagaggttgatcttctccaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggttgcgtcaagcttttctccgatcagtgcaatgggttccgtctccggcatcgacgacctcgtcttccctcccgggcagacgtttcggttcggcagcctcgacttcatcaccaacaacttcggcaagatttctctcctcgactcggaatcagaccagtcgggagagaaccggatttcggtcctgtttggattcccgaacgcggctgaaagctacctcaagaccatcttaaccgagtcggcttcaaaccactcggccgagatcgcatcttcttcaacgacaccagatcaagatgatggggcttacccaccagtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcctaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggatcgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgattgcggcttcggtcccagttaactccgaaagcgtccacacgccgactggcagccgagtcccccacttccgatctcatgactactgtcatccaagcctcagcatcaccggcgccggatccaaccgcaggagcaggggacacgacgagcggtctgttcactcacctcccgaccttcatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcatcgacgatctgcgtcgagtggattggccagccggcttcaagccgactggaatagagaagtacgacggtaccactaatccagaatcgtggcttaccgtctacggtctcgcaatccgcgcagcaggaggagacaacaaagccatggcgaattatttaccagtggctttagcagattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaatgcaacaagatctccgacatcaccgacgacgttatcatcgccgcattcaccaaagggattcgccacgaagaattggtcggcaagttcgggcgtaagccccccaggacagtcaagcttatgtttgaaaaagccaacgagtacgccaaagctgaagacgccgtcaccgcatcaaagcagtcgggtcccagttggaagcaaaacaagggtacgccggctacgggaggcggtggaagtaacaatcataaggaccgcaagcgtaagcctgcggaacttgttgcagccgccagtcactcttctcgacagcgttcgcgcgtcaacacgttcgacaagatcatgaactcccaatgcccgcatcatcctaactccaaccacgtggccaaagattgtttcgtctacaagcaattcgcggatcaatacaccaagactgcacggaagaactctgacgaagaacaaagcacgtcaaggaagaaagacgacggcgacaccccggcaggctttcaagatcaccgcaaggagctcaaccatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcgctccgagttaaaaccaagcaatgcgccttttcacggagtgattccaggattatccgcatctccactcggccagatcaccctcccggtcacttttggcacgcgggaaaactttcgcacagagaatatcagctttgaagtcgccgatttcgagacagcataccatgccatactcggacgcccggcgctagccaagttcatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtctgcccgagaggatatccgactggctgcagccacggcgagcgaaggagaaatacccgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgatttgcacaagacaggaaagatgcgatcaaggaggaattaaccaagctgttagcagcaggcttcatcaaagaagtccttcatcccgactggctggcaaacccggttctagttcggaagaaaacagggcaatggcgcatgtgtgtcgactatactgacctcaacaaatcttgccctaaagatccttttgggttgcctcgcattgaccaggtagtcgactcgaccgccggctgtgagcttctcagttttttggattgttactcggggtatcatcagatccgactgaaagaatccgactgcttgaagacttcattcatcacgccctttggggcatactgctatatcaccatgccgttcgggctaaaaaacgcaggagcaacctatcaacgcatgatccagagatgcttctcaacgcagatcggccgcaacgttgaagcctatgtggatgatgtagtcgtcaagaccaagcaaaaggatgatttgatctcggatctggaagaaaccttcgcgagcatccgtgctttcaggatgaaattaaaccctgaaaaatacaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatgcccttctttaagctgctgaagaaaacagatgatttccagtggggacccgaagcacagaaggccttcgaagatttcaagaaactcctcaccgagccaccagtcttagcctcaccacacccgcaggagccgttgttgctgtatgtatcagccacctcccaggttgtgagcacagtcttggtcgttgagcgcgaggaagaaggccatgtccaaaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgccaagtgggctttggagttgatgtctttggacatatcattcaagccccgaatttcaatcaagtcccaagcgttagctgattttgtcgccgaatggaccgagtgccaggaggatacccccgcggaaaacatggagcactggaccatgcattttgacggatccaaacgactttcgggcattggagcaggagtggttttgatttccccaactggagaaagattgagctatgtgctttggatacatttttcggcgtcccacaacgtcgccgagtatgaggcccttcttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttctttgacacaacaatgaagccgccgacagacttgccaattttggatccaagcgcgagacggcgccctcagatgttttcgtcgaacacctttatacaccgaccgtacctcatagagatactactcaaaatgcggacactcataacgtagctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaatcctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaagattgtacgcacgtgcgaaggttgccagtttttcgccagacaaattcatctaccagctcaagagttgcagactatcccgctgtcttggccgtttgcggtttgggggctcgacatggttggcccatttaaaaaggcagtcggcggttacacgcatctctttgtggccattgacaaattctccaagtggattgaagctaaaccggttgtcacaatcacagccgataacgctcgagacttcttcatcaacattgtgcatagatttggagtgcccaatcggatcattactgataatggcacacaattcaccggtggagtttttaaagacttttgtgaagactttggaattaagatttgctatgcctcagtggcgcatcctatgagcaatggacaggtggagcgagccaatggtatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagatcgctacgacgaggaccgagtggatgacttgaaccgattggaagaagttcgtgaagcagctttgattcggtcggctcgatacttacaagggttgcggcgttatcataatcgcaatgttcgatcccgtgcctttttagtcggcgacctggttttgaggaaaattcaaaccacacgagatcggcataagttatctcctttatgggaggggccatttatcatctctgaagtcacccggccaggttcctatcgactcaagcgcgaagacggtactctcgtcgacaactcttggaacattgaacatcttcgtcgttctatgcttaagctttatcattgtatttccctatcttgactgtcaacatcaagttttcttcttgccgtgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttactcagtcagaatcagtcctttcatcatcagagttattattgctcggctgaaggtcgttgttgcggaattgctctacaacatcacttgcaatcttgtcagccgcactttgagcattgctgataagatcaagagcagcttcttcacttgtcccgtctgcaaagccatcaatggtatcaatttcaatcctcgggtacaaggatttggtcatcgccaatgccatactagctcccatacttccagctttcttgatattcttgaaatatacatccggtgcaactctcagcttgtcaaagatttcggttgcgtcaagtgcactcggaccactgttattaaggaacatagcttggacgagtggtgtagcgacattggcgacttcgtctcttgctccttcaagcttcttgatcttaccaaccaggacatcaaactgagcttgagatttgattttacggtctgcaaaacacatttataataagaatctgctgcattaaagagaggacagttcaaattgtcagctggcaataccttcaacctccttcaaggctgagtccctttccgcagccagttctaccttgtctcttttcaaggcttcaatttgtttctccatctgagccatcctggtggcttgcgctgtttgaaatccaaatgtttgaggatacagttatgacagcataaatccatggagcagatctggaagattaccttttgatgaaccactcagctcgaagtttgaatcctggagctgagcaattcgctcccttaattccttctccgttttcttggcatgctccttggcctcgtgtagctgttccctaacggcttcaagagttcccaaatgtggaaccagcttttctaaggttgcagtcttggcttcattacgaagatggattctctgcacggtggttcatggattagtcttgctaacgagaaaacaaagtcatcaaaggcagtcacctagaagacttacattcacaatgcgagtggcttctccaagtactttcttcagctggcacacttcctcatcttctttttggcgatttataacaatgccggaaacttgagagttctcgtcccaccatttgagtaagataggaggacgagagtcattagctgcctttatgcggagaatttcttcttcgtcgccgcttagtggacctgatgtattcccaagatattagacgaacaagctggagttattcagaacggcatcacttgagaagatgagattacctgaggatgtgcctggcggaacgcgaggtgatccttgctctttatctggagacccaatcactgagtcattaccaacttctggtccttgagaagttgtctgcgcttcagcttcaggaatctcttgatttagatctacatccgactggtttccagtcgggggctctctggttgttgcagtttcagttgttgccgactggtttccagtcggcggctggtcactcggattggccttgtcatccgaagcatgggcgccagtcggctgactttcggcagtcggctggctttcagcagtcggctcagcatccttggatatatttggttctgtcacagccggatcaggatcttttccggttggatctatatcggacggtttcctgcaaagtgccctttcgatatttagcataattcctatgagagaagcatgccgaaataaaatggtaccgagaggtttatacctggaagatgttctaatctttggcatttgacggccagccagttttttcctgggcatggtatgctttgggagtttgttgggcgtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctggcgaggagatcggcgctgagcaattgggggatcagatttcatcaatacgtattcctgaacgagatgcttccacagttagctaactcaacatgaagatgaaattatgttttgaccttgggttgaagatttcagatacatacctgcggaggcggattgaatgcgttgtatggtacaactggcagttgatgtgaatagctgacgacaatagcgttcgagaatatcctgtacatcctctccttcaggatcttaaaatccagagaatctgggtcttcacagtttggatcatgcttgccgtcaaactcaaatgctgtgcgagatctttctttgattggagctaatcggcacttaatgaaatgccgagtgatttgctctccttgcaagccttgttctttgagttttaacatgcgttccatcaactccaaggcttggactgcttcatctccgattggaagagagttccaggtatcttggtacaccggaggaagacaagagtacccgggaagagcaggttcaggattctgaacatagaaccagtttgcatgccaccctttgtttgaagtcttgaagggcatagagaaatacttttggctcagagttcccctcagctggaatcctgcccccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccgtagaagaaatgcgagaagaccacaatctcgtgtgtatcgggggtcggaaaaatctcaccgcacgctggccgccacccgatgatctccttagcagggagaacgccgtgcgccaccatctccttcaggttctcttccgttacgtcggacggcgcccattggccttcaaagctttctttctcctccgtcatcgattttacccgaatgcgctgatttgattcgagggatggccggggagaagtgagggattgaggcggtggatcacgggaaggattttgatgcacttttcgaaggtggatttgagtggagtagtgaaccctagttcgccggcgcagttctgcactgtagcaaggagtggggaaaatggcgagagttccggcggggaagacgaagcgtcgcttggatctcgggatttcttgttaagggtatcggaggtgcgaatgggcctaggcctgaacagtacttcagcccaatacttttaacagcgtggcccattgtattccttagggacttaggcatattttgctttggcaatattatgcgcacaatagtgttgcccaatgctgataaaatcctttttatgcggtcatataattctttggaattattgcaatgcaaattaaaaggtgcccgacagaaaggcgttatgctgtttttgtaagcttttttaggctacaaaagctgtctgtgttaacttggagtggcttgtttttaccatagtcatttccctggtatgttatatgcctgttttcattatggtaaatagtcatagcctaggctattagacttatttattgccataatttttataatacttggtgggtaatctttagagtttttattcggatgcctgtcaagtgggttcattcgtgaaccttttagagtgttaaccactcggatttcttttgttatggctaaaaagcagtcggctagaatgcctctttaggcgccgcatatgcttttgtcatatgatgcatgattgtgctattattttgtctcaactatatgtttagtttgttaactaatcacatagttgggggctacacctaattaggtgcatctattcgatgcaccatattctttatcttttcgccctttacagtcttcgtcttcgctactcggcaggccttggcatgaaaagtttgaagcactcggattattatctttgagaaggctacgatggttgactgcaaaggtctcgggggctactgtggagattatggatatcccatatctacacggcgatgatatttggactgaatataggataccgaatatagatagaatatcttatgtgtatcctgggtttgtttcctaacttgtatatcaaggaaacaccttgaaacttagtcggtcacgactgtatttaatctgtatctgtgtattccgttagggatataggttatcttttgtaacccggactccttcccatatataaggggggtctgggcgcctctaggggcagaggttgatcttctccaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacaataatcattttgctttctacttattgatcatttttagtaattagttaaaaaaataagacatcaaaggaattaaattagacatgagaggaggagagagtagaaggggagagtgtagcgtgcttataattatcattttttagggttgtagtgttttagttgctattactttatcaaataaaaaagaataaaatatttattgattgattaaaatctatcttttttttactaaaactatgaacgctaccaatctaataatgttaaaattgggggaataattttgtagaatattgcttagagttaggttcattttacttttatcactatagatctagtttaattattgtgaagttgtataggatgataaaatatatatcattattttttaataattttattagttatttgaatagcatgaaaaagttggaaaaatataccccgaaagtgatatatttctttttaaatttgaattagagtggatatgagtctttatatataaaataatctaaagatataagtggatcaaatattagttattatagtatgatttagatattatatttgcttattttttagcataacttttactttatgaataatatatttggggaacattactcatagttttcattttacttttatggttttagatctaatttgcttgaatggcacgcaaaaatcagaaactataacccataatgatatttcttttcaaagttaaattatagtaaaatttggtcttcaactctaaatttagtcatatataatttaaagatataaccggataaaaattagttgatttggttgttatagttgcttaattatttaagagatttttttttgctcttttatatttaagtaataaagcacaaaaatataaaaaagaataggtggaaaagaactgatcaatgaattgaggaggggagaggggcgcacggacatgagtacgtacgcacgttctctaataaattaacgtgtacaggcccaggtgggtccggtttgggagatgaattttttttattgaagataaatctaatgattgtaaataatgggtccaccaaatttaatgaaaatcaacggctagattttttttccttttttctcatatttttttaggaatttatctaatttgttagagtgccacatggcggtttatgagcgttttcaggatgccacatggcggtttaggagcgtttataggaagtttaatggtgggcatgtattgtacacaatgttaaactttttggttcagccaatttgatcgggcatcaccgaaatttttgtgtgaaattttgaacaaatattaccaaaattcatgaaaaataaaaaaatttggccggaataatattgtatcgaaagggtctgaaatgaccgaaatttctaaccctgattgtacattgcgtttgaaatatatatataaacagaatatcaatcggctggcacctcccatgtttaaaagtacttttttttatttgaataagacacatcaggggtattttgctttgataattttttcaaagatatttattaggtttaaaaatatatcatatttaatacatctgtataaataattatctatgatctctttattatatagaaggaagttcgatttagtttgtttggaaaacatgtctaacaaatcaagtgtaaattagaagtaaggtgtttggcctttttttaatagaatgtttacttgctttttttacaaattctaaagaactatattgttaataaatatattttatttgtaccatcaagtagtttttcttctagtaggtttaagttgatgcaagttgttacatacttacatataaattaataaagacatgtcatatacctcgcttccttctgatttatgcgatctatactatctttttcaaaagaatatacctagttaacatgaatccaaaattttaaatttaatagtaacaaatataacttttcaaagaactatatactgcgaaccttagtgtggcttatatatgtaataatatgtagagaaactcataatgctatgatataggatagacgtaaggccattaatgtctaagcattttaaaattgttatgaaaatggaacatgcaatggttggtctaattttagtgaaatgtaagaaccctttttttacgaacttattacattttctattacatgctttattttatattttaaaccagttcaaaatataggctttttggatctttaaattattcttttaattataaatacaacaatatttagattagaaatcagatgcatagcttgaaatttatgcatgttttaatatttttattacttttggctatataaacagtaaggggtagagtagagagctcaagcctagaagggatgggacgagtaatgccatgttgtacgtatgattggggggggggcgaagtggaggggtgtttttttctatgttatgtaaaagatttaagtaaaaccatgatctatttttttctcaatttttttgttattttttctaatttttaagacgtaacacattgtggcttaagatgttctaaaaagtacatctgttggttgaaaatagtggatctacctatttaagtggaaactgatgatcggatgatttttcttccaatttgtaaagttttatttttatttaaggtgtaacacgtgacgccttaagtgcgctcagaggatgtacaatgatttacgataatataatacttattttcattttgtattatggtctgtcttttttctatttggttaccatgcaaaggaacgatgtctatgtttaaatcacgtattttcatttttgtagagtgaaatatgggtataatggatcttaaattatctatttaattataaataaagcaaaaattcaaataagttaacattatgatttaacctaagaattataattatttggctttctaattattgatttttttcacatagttaaaaattaggagacaaagaagttaaatgagtgaggagaggaagagagagttgaagggaagagattacgcgtgcatataattgtaataattatttttaccgggttgtagtgttttagttgcaattattttttaactaaaaattgaaaaacgatttattgattgattaaaatctatcctttttacttgtcttttccagtatattcatagtagatattaaaaatacgaacactacaatctaataatgttattttgacttattctaatgttataatgggggagtagctttttaaagcattcctcagagttaggttcattttatttttatccatatagatctaatttaattattccaaagtcatatatggtgataaaatctataccattatctttctataattttataattgttcaaatgacacataaaaatcagaaaatatagctccaaagtgacatatttcttctcaaagtcaatattacaatggatatgagtctttacatgtaaaatagtctaaagagataagttcatgaaatattagttgtgtgagttagatgttatagttgcttattttttgcataagttttgctttcgaactaacatattttggaaacattgctcatagtatattcattttacttttatgattgtagacctaatttaattattatgaagttatgtatgatgataaaatctatattattatcgttatttcatatgtttttataattgcttgaatggcatgcaaaagtcaagaaatctaaaccaaaatggcattttttttcaaagctaaattgtagtgaaatatggacttcaactgtaaatttagttatgtcttcaactgtaaatttagttataaataatataaagattttcgtggatcagaaattagttgtatgattttgaagcttaattgtttaacacaaaattattgcttatctaactaataaggcatgaaaatagaagaaggaataggtgaaaagtggacaaatgaattgaaggaagaggaggcgtacaaacgtacgttcgtttttgtaaaaaaaaaaagtaacttatacatacaggcttaggtgggcccgggtttaggagatgaattttttcttgaaaattaatctaatggttgaaaataatgcatccaccaattttaatgaaaatatgttttgttattttagaatttttgagaatttcactaatttattagaacatcacatggcaacttaggagcatttgtaggatgtcatatggcgaattaggagcatttttgaaaagtttaatggacttttagacatgtaatctaatgttctgaaacattagtcgggtccaccaatttaaataaaaattaacggtgatatttatgtaaatttatagagtaataagatttatcattaaataatagtaaatcctgtttgaaatatcatcaattttttccaatggtaattttatggtaattttgtgcgtatttttttcttctgacacgaccagtaggtaagctttcattggtttcttcagttgtaagtacgtaagtttttcctatatacataaatacgtaatattacgtaatattcaggatgattttttaagattttgacctttctcttaaaagtttttatttaggactttttttttaagttgattgtatatatttgtgtgtaaagacctttagaacaaataaattctaaactcaaaccattcaaaaccatgaaatcaagtagatatatggattaaaaattatagccattaacttgaacttatctgactgttgattccttttatgagaaattgattacttaataatagaaatagagaataggtgaggagggtatatatatggggtggacggacagacgtacgtacgtacgtacggtaggaggtggtggagtaggggtggggtgggatttaaatttaatctaatggtctaaaatattaggtccaccaatttaagtgaaaatagacggttagatttaatagagccacgtggtggcctagaagcatttgtaggagcaccaagtggtggcttgagagtatttctaggaagtttaatggacttttagtatatctcatagattatataatgtatattattcatttatttagatattttatgaatatttcgatgacgtgcgtataatacaatacaactcaaaataacttatatttgtacaactatgggttggaattattaacgtggtttttatctcacgtgcgtataatacaagacaagaaaagtgggacgtggggccctacatgcaagtacatactccgaatcatatggcctggaatatgaattttgttttttcttcatgtgttagtgaaaaagaaaaaagaaaagggggagtggggcccacatacaaaatatgtaacatacatgcacgtacacgtacggggcatgtgtggatttttaaagataataataaatctaattgatatttttttatgctatatctaacggttaaaaatagtgggtccaccagattaaatgaaaaaccaacggctagatgctttgcttaattcttctaatttattagagtgccacgtggcggcgtaggagcgtttgtaggggggcacgtggcggtttaggagcgtttgtaggaagtttaatggacttttagtatataataatagatagatagactagaaaaaatgcccgtgcgttgcaacgggtgaagtctattttaattttattattgctatacggtttagttaagatgaaattcactctgtagttcgcttgcatatatataattttagaaaatcatgagctacggttaggagtccgatcgtctcaagctagcatgcgagtttttttaaatagatttcttatatgattgcttctgtattaccaaaagtgaacgatcttaaaaaccgatccgaatatgaatatgtatttcccaaagcaaacgaacttaaaaaaaatatcggcaaaaacatattcaatttttataatagtagagatatgataaaaaaattaatgaagtaaaaaataaaacaagtttcatgtagatgaaaccatgtctacacctttttcattacaacttgtctattatgtattgcatatgaaaaaaaataaaagtaaaacaatgcattctatgagttatttcaatcatcagttaaatgcatttttgcagtgcttcagattttctttagaagtttaccagaaaatgtttcgatatgcctttatatctgtggagaatattatggatgaaaagttgagtgtgggattgctcagtgaatcttttatgttaatgcatgaaatacaggattcaaccgagcatcgtcaccatctttagaccattatattgtccctctccaaagaggatatgcatcgatatcgttggacccttaggctaaatattgatgttgttagttttgtgctaatgaagtaaatcaattaataactccaaacctattttactgaaagtaatgcaatgatacgcctataggatattcattttttttcttttaatctattcataataacatttaatggtaaatttagaaacacgggccgggcctgtttctttcagtttgagattattataatctagattattgagtcagattactgtaagctagattgttataatctgtagtaaaataatctgtagtaaaataagcggttagttgtttctttcctagattattagagcctagattattgggtttgtaagtctaaagagggagtggggtggcatggtgggtaatttttcacccaataatctgtaaaaagctcagctaaataagcttatcagattataataagctacatcaataagttgtctttttctttcagcttactcccaataatctggattataataatcctaagctaaaagaaacagatagacatgatgtatggcacttagcaaataaatatattattattgatcaagtacagttataccttctactttaagaagcaggcccaatcattaaatgaacaatatataatcatatagtgttgaccctattgtttgtattagcgatcttatacaatatttaagaaaatatttactactactgcatagtcgatttttacgtgcggtcaaaatcgattttcagaagcggctgggcttcccacctgtaccctatgaaatgaatattttggcatgcaggtagtgcaaccgctttcgaaaatacaacttttggaagtgggcccttaagccgtccatttgcaaaacaaaaaaggcaaaataataaaaaatatgaatatcaaaatccaaattccagaaaccctagaatctgtcacgaccgtcatgcttgaatccactgcaaacatcaccgttgttggttcctcccttccagtcgcatatactagaaaaacgattttttatgcgtggcgaaaaaataccaaaaccaccagcaatatcgtaatgagggggtggggggcactgaccgccagcgaaaatggattttcgctggcgtccacgttataccggccgccagcgaagatatgttcatttttgctggcggtcacttagatgcgccgccagcaaagatggataattttcgctggcggttaggttatatagcccgatagcgaagatccaattctttttactggcggctcacttaagcaaccacaggtgaaaattgatttccgctggcgctcttaaaaaaattcgcacataaacaaatcactgcgcgcccatacaggcatacccttatccacccaccaccgcataataaaaatatctccacttctccctctccagatccagatccacttcctctcctccaaatccctgcaccctcctctcctcctcccctccagatccacatcctctcctcctcccaggcggcgacggcggggttctcgggtggtggcggcggctccggcagctgtgtgtggtggcgaaggcaacgggaggtgggcgcacagctgcgacgggaggcggtcgtcgggggggtgcggcgacggcaacaggaggagccatcgaggggctcgacggcaacgggacgcgcagcgactgcgacgggaggtgggggcatggcgacgacgatgggaggagccgtcggggggctcgacggcgacagggggcgcggcgagctcctcctcctcctcgtcctccccctcccacgtggcttggtgctgcaacggtcgcggcgacgactcattgctgcggggcgcgacgagctcctccccctccccctcccacgggtgtggcgacggctcggtgctgcggggcgtgacggcttggtgcttgctgctcggtcggtgagacgacgacctggtcagcgacggcttggtgcttgctgcggggcttgctcgatttttttgtcagttttttttttcatgttctaaatgtttgtaagcccgtgttcactcgtatgattattgaaaggtgaatacccaatatgatccttaaacttttgcttaaggatcaatctagtccctgacatttcgtattgtgcaaacaagtaccttgagtttactgtgtgattcaatatagtcttttgaccctctaaacatgccatgtgtacatgccacatcatctatgcatgcaaattaaatatttaaatgtcctttacacccttatctgttcatacgaaataatgaaaaactattgagaaaacacacaaaaaaaagcttttgaccattggcaaaaaaagcttttgaccattggcaaaaatatgtagcattgatagataaaaataattgacatttttctttgttttatgattgcttcttcttgtttttcttttctttatttgatagaaaattaaaggttaaaatggacatttaaatgttatcttatatgcacaaatgacgtggcatatccacgtggcgttttaagttggtctaaggactatattaagccgcatgataatctttaggtcttgtttggatattataaaacatgaaggactaattcgacccctgagcaaaagttgaaggactgaattggctattcacccattattgaatctaatgaactctggatgtggatttgaatatatactcaaaaatttggatgtggatttgaatatgtacatgctgcgaaaatctgatttatttattttttttggcgaaaagagattttggggattacttttttttatagaaaatcatttttactggtggatcgcgtaagaagccgctagcaaaaactattttagctggcggagcacataaggtagccgtcagcgaagactatttttgctagcggcccacatacgacagccgcaagcaaaaatgattgtcactagcggttgtctttagccgtccgcaagcgaaaagttattttctttagcggtttagagccgccaacgaagatgctatgttttcattggcctttttttttgtggcggcgctaaataccgtcagcgaaaacccaaaatgactgccacaaaagatggttttcgtagtagtatcatcgtcgctcgaaaccgccaccgctgccgccttcgtcatcattatcgcttgaagccgtaggatctgcccgtctcctcggtggatctgcacacgtggagggcagagaggcggtgagatccacgcaggagggggagtagccgttggatccgctcctcttgtggccaccaccgtcgcccgagctcgcccccgctcttgtcgacactgttgcggccccgctcgctgttgccaggagtgggagggaaagaggctagacgggacaagggggagaagtgagagagagaggaggggagagaaatgagtggggacatagaggaggcggagaaaaaaaataggggaggaaggtgattttgacaaacacactttgcattcgaaactttacatctgactgcaaaactcattttcacctgcgggcctcttaaaatgccaatatgcgaaaatgactttccgtaagctggccttgatccaccctatttatttttgcatgcgaacgccattacagtctgcttggagcttccaagaggtctcgtccgtgaaaatctaatagtgattctcacatgccatattaaataaaatatcaacaaactgcatgcactaactatttattgcaggcagattataaagagaaccttgcgtaaaaatcaacctattttcagaacaagaaaaacattttaatgaacatttgggcccctaatatgatgtcaactgagaaaactttcaagtaaaacgtgtgatctcaattgagaaaactttcaagtaaaatgttgtatatctagtcgagagttccggttttgatacaaaatttgtcatcattcgttcttgatatattaaagttatgacttttttttaaaaaaaatagtattatttatgttttcaatgttagttcgttatataacgccggtaaaaatcatttttatatgtctttagagagaggaggggagagaaatgagaagtgagtttccacgtgcagttcgttagaaaaacctccttagttgcctttatgcttatgcagagaaaaaggacaacatgccactccgaatcgggttttgacaaaatgccaccccctacaatacaaaggataaaatgccactttaataggttactttcaggatattttgtcactttggaagattttaagaccaaaatacccttggatgtggataaattggaagagggaggagcggggaaggttgagatcgacggtactcatgcttcccggcggtgggcgtggggcgttggctgcgacgggcggacggggagaggaagacgttgacactgatgggaggaggaagacgacggcgctgatggggagacggcggtggcgatggtggagaagggtggtgactgggggaggaggagggtggcgccgatgagagggaggaggaggcggcgacgatccggagggctctccagcactacccacccacgcgcttgtagcttgccgccttcggcgccgcccgtgcgcgcgctccatgctcgtcgcttctggcgccacccgcgcatgcgctcaccgctcaccttcttcggcgtcacccgctgctcgcggcaccaccgtccccctcccccatagtcgttcgtccccacgccctcaccaccggccgctgacgagcacagacgccgccgtctcgatgttccccggtgctcccctcacctctctctttctctctccaatgtattttggtcttaaaatttttcagtggcaaaatatcccgaaaataactcagtgagtggtatttcatcctttacattaggtggcatttcatcgaaacccaccgaatggagtggcatattatcctttttctctgcttatgcatggttggttttcttaaataaccacgtgttgaaataggattttttggcagtataagaccttgagaaaggacagacaattttgaaaaagcagtgtctgtgtggcctagaaatttgggacgccctgtgaatatgaacgcctggatcctgaataaggctgcgttcgttgggtggagaaagagagagagtttgtttggttttccgcgcgcacgcttcccaaactactaaacggtgcgttttttgtaaaaaatttctatagaaaagttgctttaaaaaatcatattaatccatttttaaaatttaaaatagttaatactcaattaatcatgagctaatggcttacctcgttttgcgtatcttcccaatctcctcgatccccttctcctcaaacactccctaaatcgttttagcagtggtgagccggtgagtgcccgttacacaaagtatatgggcgaataatagcaaatgtaattgaataattgatggagggataaagaaacttcttgttgcatggttgtaccccacctgcaaaaatgtacagattgtgtctatatatctctatatctacttctacttctacttatatatatactacttaaaaaataaaacaaaatttccgtcgtccgtccggtgagaaaaaaaagaacagagaaaaaacttcaatcggcaaaaaaggaaaaaaaagtccgactcctccggtggaaaagaaaaaggagagaaaaaaaagaagagaaaaaaatctatcccaaaacaaaaagaaaaataaaagggcgtccgactccctggtggagaaaaaaaagacgagaaaaaaaaagaaaaaaaaaacttctacctaaaaaaaagtccctaaaaaaggttcgactccctaaaaaagatttttcgtccgtaatctacttcaaaaaatgtccgactccttacaaaaggttcgactacttttattcaaaaaaatataaaaattaaagatgtttttgtcagtactttggtacgtctaggtcggtttttaaatgttcgcttttgaaaatacacaagaaatctctttaaaaaaactcgcatgctaatttgagacgatcggactcctaattgcagctcatgattttctaacaaaatatggccgtgtttagttccaaattttttcttcaaacttctaacttttccattacatcaaaacttttctacacacacaaacttccaacttttccgtcacatcgttccaatttcaaccaaacttccaattttggcgtgaactaaacacaccctatatatccaagcaaatttaacatagtgaatttcatcttaactaaaccatataacaataataagattaaaatagtcttcacccgatgcaacgcacgggcactttttctagtagatatatagaaatacaactattccttttttactagaaagatctaacatactccctccgtcccacgatataagcacttttggcatagtgacaagtcaaatatttataactttaactattaatagcaaaaaaataaaaaagatcaatcatgtaaaattgatattgctagatttatcactaaacaaactatcataatttacaactctttttatttaaaacatattacttttataaatattattggtcaaagtagcatcacgaagaccatgtcaaagtccaaatatgcttatattttgggacggagggagaattttacatacgattatctgatctgcatcagccggatcatcttgatggaacgatatatctactttattgtgaggaggaagtcaatttttatttatgtcactttaatttttcatgagtaaatttcacagaacaacatatacataggccaaataatcacagaactatagatttaaaagtaatgtataacaaaactacagatttaacaataaatttatcccaaaactacatgttaaaggccaagtagcagaaaattataaatttaataataatattatcacaaaactacaaatttgagtttaaatcattggcaataatattatgtttgagttataaatgtccaaattttgagatcaaattgatataaaatctatagttttgtgataactttattactaaatatgtagttttgcgatattccatcttaaatatgtaattctataagaaatttaatgttaaatatgtagttttgtgataatttgactaatgcaactatagttttgtaaaatttactcatttttcattgattttcctcacccgtagtgactttaatgttaaatttaaggggcaattttgttcttgcccctacttctatgtccagtattgattttgctcctgttttttttagggtttttattttttgccctcacttttttgaaacgaataagcagtttgcccctgttccgttaatttttgctaacggtgttaaatgtggggtaaaaaggacaattatacccttagatattttccggtactttcatacaaactttcaaatttgacccaaattttggcaaacttttacaaaattttgacaaataaaattactgctataaaatggcatcaataggtctgtattttgattatgtcaaaagtacggaaaaatatttaagggtttacttatctttttatccctcacatttaacaccgttagcaagaattaacggaacaaaagtaaacgattgattcgtttaaaaaaagtaaggtaaaaacgaaaacctaaaaaatatgggcaaaattaatattagacatgaaagtaggggtaagaacgaaattatccctaaatttaatgtttctttttactggaagtttgccaattgtgccattttagaaaaaagtttcgacctgcccttatttccatacggaatattatctacaagataagattgtgatggaaatagcagacggtatcttttatgataatgcaatcaattcaggtttcaagtttcaacaaagcacggtgaccatcattatttcgatgagagggacaatggttggtatgcatctggaccctaaggccaaatatcgcttttgcaataaaactatgttagctgtgttctaaaataactaccctcttaggatcttcaactatactctcttcatcctgttttgatcattctctaggttattaagttattcccaaataatcatctaaccagtatacactggtggagaaaccatctttggtcggtcggccaaaatccataatagtcccggttgcaaaaaaaaacaccacagctattttatgatctacaccaaccgggactaaaaatcatatttactcccggttcattccgtgtcagtagtctgtcagggggccgaggatctttagtcccgatcggtgacatcaaccgggactaaagatcatctttatagtcccggttgg

SEQ ID NO: 22051 - DNA, 11408 bp, Oryza sativa
ccggcctcttttcttttctttttttttgataatttgtgattgactgagatgtgtaattttgtgattcattgcatggttataagatgtataatatgtgcatgtatttaatttgtgtgtattttttaggatttgtgatgtatttgatttaagtgtatttttttaggatttgtgatgtatttgatttatgtttataagtaacttaggatgttactttgaattgtggatttggggattgatttagggatatacatggcactagattcgggagaaaatatagagattaaatctagcaaaagaaaaaaaaacgctactctctctttagtcccggttggtgttatcaacagggactaaagattcctctcttttttcccggttggtaacatcaaccggcactaaagatcgatctttagtcctaggtatttgaaccgggattaaagatagcgatctttagtcccggattcgtactctttattggaaaactgggactatagggggttaccaaccgggagtaaaaagactttctccaccagtgatatctctttgtatatttatgtaaaaagtaaaatatgcatcattaagtatgttgcatacaaccaatcaagattaatttctgttggtgcaatgatatatagtaatatttaaaacatgagcaatctacaggacacgaagcgatagagcaccttaaccaataagaattaatttgagaatgatgaatattttggtgtcctttgctcggaggatgagctaacttggacggggagtattcttttaaagattttagatggtatgctttaatggcaaattttgaaatgatgtcctcttatagacacgtgctaaatagggctggcatgatactatatgttgtaccaaaacaaatatcttaagcacgtacagttgtaccttctactttaatgagcaggccgaattaaatgaacaataatcaggtggtgttgaccctattgttttctagcttaatttgggcaactacacatgcgtgttcattgaactaatggaaagaatggttgaatggttatggtccgctatatatctccattgaattgaactggatggtaccccatgccttgttattggatttaattgttaggtttttcgccgtaccaaaattaaagttaactaaaacatttttcttatgaaacacgatacaaatgtatgagctcataacacgtgaaaactcactcttataaacgcacacacgcgtatagtccattccttccgaaaggctaggctggcacatcttgaaattgatgaagttgcctcgctatcatgaggtacaccacctatagcattaaaaaaaattaattagttgtaaattccaggacccaagttaattatatgacttcaacttaggtgaggcagtttcatcacaaggaactaaataagttgagctacactcgcttcgcgttaaaacattatgtttatacctgcatgataatgtagcttcatgtattgcctcccactacttaaaataattttcggtccacaagaatgcacatgcatgtaaaaatacaatgggaggtattaaaaacagtcttcacatgtgctggtattaaaaacaacgcttgtaaaaattgagctatataggaaccgcatcgtaaaagttgaacgccctgtaaatcactatttttacaagtggaccctaagaggaaccaccaagatgcctctcttatccatgaagtgacaacaacctgatttagcatagtcggacgataaaacggtgcaactgattcttgagtatgaagaatctcttcagttcgtttacgcaacgacaatgatagggtacgctgtgatggtgcatggttatttggccttgctgctgtggtggtattggttgagtaacaaaattgaaaatcagcacacctcttggtgcacctgcaagctcccatacaatgcgatatctcaatctctattttttgtgtgatagatagtagatgtagtatttatgtgaagatttatatgagagctagctattggcatagtcgcctggcctcaattaatatcataggttcaataataaccattctttttttattcctaagctaatcttctgactttatgtaaaaatacacaaatatgtataataataaataaatacactactaagacatattttatgatgaatctaattaaattaatttggtgttatgaatttaatttttttataaagtcaaccaaagttagagaagtttaactcaacacaaatttaaatagtttaaatagttgcaaccaaacttttactcggttaaccaaaatttgtgaggatttaaatagtttaactgagtaaaccaaaatttgtcaaatagcaaaattcgtctgaaatttaattagttaaaaacacgaagtcgcaaaagcaacgaaagtagtaaataatcatagtttgatagtggtatttttattttctcaaatatctatttttatgatgtcttaaaactaaatataaattcgtgatatctatagtagcaaaatttgctaatatttatttattatcagacggtacagattaagtacaatactcaatcagcccttctagcaatcaaccgatggttaggatggcctttgctactaattagcttggaaatacatatttttacattctttttaaaagaaatagagcacatcaacgtgatcgagttgcttagaatttaacatgaatctcctatttcactcttgcagcgggtgttgtagacgtgcggtgtggttgtttttttccctgactatagtttttcaggactatagacttgtatttttcgcttgttatatcaatacattaaactcgcgttgtcttgtgcggctcgtatttttttagaaaaaacatgattgttctgcttttaatttgtctccctcgacgttgcctaagtgagttgttatttatcgatcaggtacgatcattattttcattataatttaggaaaacacgagccctgttaacgattgggttatataacacgtgcatgtaaaagttcagaagacccataaatcaaatgcattttagtcttcttctttttccagcccctctgtaggttacctatatttgttgaaaatcttgataaaaaatctagttagagataaaagaacgggggccatagtagtactactagctatatccagcccacaaaccaatctgtacctcactttggtcattttggtccggaataagttcatatgagatcctttaacttgtcatggagtccgatttgtgcttcaaccaggaatcagatacaacgggtccctcaactgttaaaaccgatccaatacaggtcccatggtggtttgaacagcggttttagctgacggcctacgtggctaatttgattctatcttcatctaacatggtgcttacggtgcaattcaacatggaaaaataataaaatcatgggacccacatgtgagcatcatacatataataataaaaaaatggttgggctcatgtgggccccacctgtcattctcaatcccctcctcttcttcctcctctctctccccatctcccatctctctcccctctgctccctccactcccgcccccatgggcctaacgtcggcggccgccgcccctattccctttcttccccaagacagacatcaccgcggctcgcggcacccgcatccgcatcgtctccatcggaccgcagcacaacaacgaggtgcgccacgttctcccggtcgatccacgcatggatatcgctggcgacactgctagcccgcacgcgcgacctcgaccctgatccggacaggtccggtggcggctctgtcgacgtcacagagcttcgacggcgtcgtgttctggctgcggctgtggctgtgtcggcctcgcccgcggccggggcaccagaggaagatcccgtgaatctccgcgtcgctggacgatgccctagccgccgcggatgcctccacctccgaatccctcgcggcgctcgatgcccgcgaggctgccgtccccgcgttcctcgccgaggccgaggcggcgctgtccgcggctgtcgcggactcgcggaggctgagtgcacggagtccccgcccgccgaccagtggcgaagctaggatttaaggttaggggggtgtggtggggatgaaacaagccataagactaaataaccaatgtcgacaataaaacaacgtattatatgttttgccatacaatcattgtgatttttcatcttcacaaattgagtactaagttagactacaatctctaggtcagggatagaaaacggtcaaatatttaggtattgttgtattgggagagagatcagagaaataactccccagtaggccacaaccatcggtacgtgggaggatggagaggtgcgcacatcatgcaaagctgaagcgatgaagacaagaccttaatctgtgttgtctctctaatatctttctcgttaattaattttctagaccatgtttagtgataatgggtaattaacatgctaatgggctcacgtttgctgcctacctagccttgttacgtaaagcaccaggggagggggagtgtcggataggggggtgttggccccctccggcacccccgacagcttcgccactgccgccgacgtccggagcgcactctggtggatgtgcggccacatggacgccgccgcactctggtgcttcatggcggcgcgctggcggcgttttgctgtccatccgatggtccggccactatgccgggcaacggcgccactgcatcttaccacacgaacctgaacatgccactgcagagaagtcctccatgcgacactccggttgcacttgagttccgtcgctgagcccctagtaacctgtagcactatcgcttcaagttcagaaactgaagaaccgagccttggtttcttttcatgaatcacgagaaaaaaaaaaccacttttgattgcgtgtgcttatgatattactgtgttaaaaaatataatgaagtaacgaacattccaattttggatcctgtgaggtctcgagattgttgagagatggtcatcaatcaatttcatctatatactgcaagcggttctgaaagtttgacgacagcacacgaaaccaccactgcaacgttcggtttggcagcggcgatgccaccgtctagcaagcaccgtggccggaggcaacatgaacaggcaagggctagcaggattgctggtgatgctcctccgtgagctgagctctcgtgtgcccagccggcgcattggccaccgccttgccagccgcggaggtcgcaggtgtggccgtttccttgctggccacggaggtcgccggtgtggccgcctgcttgccaacggccgaggtcaacaccagagtccgcgtccttgacggcggccgaggtcgccgtctgcttgcagccggaagagggaaggagcgaggagtgaggatgaaatgtgcggtccacgtgggagccaccaattttaaattatttggtgtgtagctgacatgtgggctgacagtttttattcttttccagggttaaattaccatgtaaacactacgtcaatgtcacgtgagacgaaagacctagtcaaaccaaccatgtgcccaccacgtcaaccaaaaccaccttccaaactgctgagggacctcatttgcaccggttttgatagttcagggaccaattgtatctggtttttaggttaaggacgaaaatcgaatttggtgtaaagttaagggacctccgatgaacttattccttttggtccgttccctcgccgtcaccgggcagaggcacgtagtaatggattttcttttgttgccaaagggagcagatagttggaagtattggaaatgtgttgctttttatttcattgtttgtccttccctcgttttatgctgcaattttgatccccggtatagaaagctgatataatgaagtcaagcaatatgcaaagtgtctacgtttgatgtcgcgattatagtatttgcatagtatggagatcgttggtactaggatatatgcgagattgtaataaaagagatggagatagggatttttatacacgttcgggctcctgcattgtcaagtaatgaccctactgttggccgaagccggttgttactcttattcaccataatcacaccagtataatatttggggtagcctatctaactgttgtcgacttgatggtctgaagtgttgactcgtagtcgacaatagggtagcattcctcctcgaatccgcatcctgcgagatcaaagacagcactatgtctctcctgacaatatccgtagacaccgtaggggactagtcatacttatctctgaagtcgatattcggcgtcttgtcttggcgcatgttggcttgtatgttgatcttgtgtcttgatctattgttccgtgtcccctctcctcctagggggccttgtatttatacccataggtgtccccttatccaagtagaactagggaaaccattatggatacaatccgagtagtacttgtcgtttccatgtagaactctattcatccttccttatgcggaactcctcctatatccgaagattgtttccgtataagacatggtatgtggtatccataaccctgacacaaagaactttgtgttcaatttattctcccaattgcttttgccgtgtttttttttcatcatctttgattttcaatgctcttttttttcacatcacctgatttatatcgatcttgtttatagcggtgcgaggatctcgatccgttgtaggagggggaacgactgaagatagcactggtggagaaaccatctttcgtcggtcagccaaattccacaatagtcccggttgcaataaaaaccggggctaaagatgatctttagtcccggttaaaaagggtaacgggcatatttgatctttagtcccggttggtaacaccaaccgggactaaagcccacccctatatatatgtcttcttcctcctctagctgcccgagcaagcttcaaaatttcttcaaaaaagaggggaggtcatgccaaaatttctagtgaatttattttggtgattatatacaaaatcggaggtgcctaaaaggttagcaacttcatcctccaatgtttttttgtcatattacatttagagctatgttttgcacacttttttatctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaacaaaaatgaaaattaaaagaagtacaacacattaatattagtttaaaactttagaaatagtacacaagaattagttggtgtaatattttataatttttgtatgaataatgatatgtcattattgtatgactgttgaaagagtttgtaattattttataattattgtatgattgtcattattgtaaaaataattatttgtgtacgattttttttcatgtcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattttgcatccaggactattcatttccacttgtttgagtcggggttcatgccaagctataattgttggacatcccacggagagcgaggtgttgaaatggaagaagatgaagtggaagacgacaatattccggactttgctcagtatgttggatttgaaggaaatcaaacggacgaggaggaaagggatgctgatggtaacaacgttgcggatgatcttggttagatgttgcaggacgccaaggaggactgcgaaagtgaaaagggggcccataaattggacaagatgttagaggaccacagaacgtcgttgtacccaggttgcgagcaggggcacaaaaagttcgataccactctggagttattgcaatggaaggcaaaaaatgatgttagtgacaaggcatttggcgatttattgaaactcgtcaagaacattcttccggagggaaacaaattgcccgagacaacgtacgagactaagaagatagtctgccctctaggactggaagttcagaagattcacgcatgtccgaatgattgtatcctatatcgcggtgaggagtacgagaacctagaagcatgccctatttgcaaagcactacgatacaagattagacgagatgatccaggagaagttgacaggcagctaacaaagaagagaattcctgctaaggtgatgtggtatttccctataataccacggctaaggcgtttgttcaggaacaaggggaatgctagaatgatgcgatggcatgctgaagagtgtcaacaggacgggatgctgagacaccccgccgatggttcgcagtggcgaaacatcgacagaaaatttaaagactttggaaaagacgcacgaaacatagggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaaactgttgtggaagaaggaaggtgtccctgtgtaggacgaggacaaacagcaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtgtacatgggtcatcgtcgattccttgcagcaaaccacccggtacagaagaaaggcaagcactttgaacataaggcggaccaccgtacgaagcctaaacatcgcagcgggaaaacagtgtttgctatggttaaagatcttaaagtagtgttcggaaaagggcctggaagccagcctatagagagcgaagatggtcacacggcaatgtggaaaaagaactctatattttgggagttaccctattgggaattcttggacgtccgccacgcaatcgacgtgaagcacctcactaagaacctttgcgtaaaccttcttggcttcctaggtgtatatggaaagtcgaaagatacactggaagcacgtaatgatctgaagcatatggaacaacgcggcgaccttcacccggaaccaaaggacaaaggaagccattacttgagtccagccagctacactcttagcaaggcagagaaggaaagtatgtttgaatgcttggagagcataaagtaccatctggatactccacaaatatcaagcgaataataagcacgaaggagaagaagttcacgaacctaaagtctcatgactgtcacgtgttgatgacacaactgctactagttgtaataaggggtatccttccagacaatgtccgggcaataataacaaaactatgtgcattcatgaacgcaatttcgcagaaggttgtcacgaccggaaataacccaacgggcgttccttacgtgtgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaatacggtcctagagctatacaatattattaaacaaggccgtgaacccacacgagcctggcaacccgaccctgggtcccagctcgtcccaagccaacccaggccaaccattccacattttagttgttaaacaggttttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgaccaaatcccacctacggccggaacccccgggacaggtaggtaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccaggctgagccacaaactaagccttacccactagacatgtggaagtacggtagtgctttgcaacagaggcccgaagaccggtccttatatggccgaggtgctactatcaaaaccaggcaccccgagcccagcctaaaaccattttggggattttgaatagagggggcggtgtgaatccaattccacaataatcaaaccattccatagtgtccaggtgatgagaaaattcccaaagtctagagttgtaaaaccacctaatgttgcttaattaaccagcgaagcatctacctaaaatcatactagtggtaccatgagtagagtgtccactagttggggttttgtttattctagggtgaacaaggaaataataccaataccaataataaggtcataacaaaggtaaataggcatggctagataaaacagtgataacgtgggaatttaaataaagcgataatgcaataatttaaatcaaaataattttataaactgggattcaatatgttcaaggatgatgtgacttgccttgctcgctttcccaaacgtcggctttaacttccacgaagagcggatcttccgaagctgcagcgtctacacgaccaacggaaaagaaaaggcttttactctaataaactccatataacaagctgaaacaaagcacaaaaatgggttcttgacttcttaaggaaaaattagagacttgaacggtccaattccgagttcaaatggccaagttatggccatttgaagtttatatgctctttaaatgaatatttgcaaatttcttcatttaaattttaattaaaaaaaaggtttattgcgtcagccgaggggaggggcgcgcggaccgggtccacgggagtggg

SEQ ID NO: 22052 - DNA, 3084 bp, Oryza sativa
gggtgggccccacccgtcagcgagggtggtggacgggcccgcccgtcagcggcgcgcgcgcggggaggaggccgaatgggccgcggggagaggaaagggagggggaaggagatgggccgagccggcccaagggggagaggggggaaaaggacttttttagagcttttctttttataaaaccattttaactttgtttatttcttaatatttattatttgtgctctgaaaattccactaaaatttatttacacattttagacttttaggaaatatacaaaaatcctccaagccttatttgacttttaactttgcacattttaattgttggaggctttcacacggattttaattattctaggcataatttagaggatgtattttagagttgttttgggacgtgacaaaggtcatcgatccggatagattagaagcccttcagaataatgtggtgcaatgtcttgtcagtcttgagttgatattttcactttcatttttcaatataatgatgcatctgctttgtcaccttgtcaaagagatcagtattctcgggcctgtgtacctacacaacatgtttcctttcaagaggtacatgggcgttctgaagaagtatgttcgtaatcgtgctcgtccagaggcaagcatcgccaaggggtatggaacagaggaggtcatcgaattttgcgtagaatttattgaagaccttcgcccaatcggggtacctgaatcacgccatgaagggagactacggggaaagggaactctcggaaggaaagcaataatgacggtagacaacaatttattccataaagcccatttcacggttctgcaacaatcttcattggtagctccttacatcgaggagcacttggctctagttcgcgccagaaacattggtaagtccgatgcatggattacacggcatcacattgatactttccccgcgtggctacgacaacatctcatgggtaacgagacgatcaaccaacaactggccttcctggcgaggggaccatctgggtcgatcgtgacactctagggatatgagatcaatgggtacacattctacacgagagcccaagacatgaagagcacaaaccaaaacaatgttgttcgtatcgatgccatgggacacaatggaacaactggcacgtattacggtgccatcgaggacatatgggaacttgactatggttctctcaaggtccctctgtttcggtgccaatgggttaggttgactggtggagccgaaatgattgatgacagtgggatgacaacggttgaccttaacaaggttggatactcggacgaaccttttgtccttgccaatgatgtaatgcaagtcttttacgtgaaggacttgtctagcaaaggaaagaagggcagagggcctgacgagccgaagcgtcacgtggttctcccaggcaaaagaaaaatcgtcggagttgaggacaagactgacgaggattacgatcagtttgatgggcaaccccctttcatggtgacgattgaccctagcatcctcctatcaaataaagacaccccttactcaagtagcgatcacaaggagggaacaatagtgaggagaaagtacgtgcggtcaaccgtcaccgccgatgtattgctataattattgtgtacacgatgtaaactattttggatgtattgattatccatataaatcaattgttgtatggcatatgttaattacgtacgattattagaggttttaaccattttaaatcatgtaattgctagttatatgcggtaattagaatttttaaaagttttaaatcatgtatgtggcatttacatatgatacttagagtttttaacaattttaaatcatgtatatgctagttatatgcgataattagaatttttaaaagttttaagtcatgcatgtggcatttacatatgttacttagagtttttaacaattttaaatcatgcatatgctagttatatgcgataattaggatttttaaaagttttaaatcatgcatgtggcatttacatatgttaattagagtttttaacaattaatttaatatcattcatatgctaaatatatatggctattagaatttttattaattttaaatcatatatttgcttattacgttttatccacttaatttactacagacaacaataatttttcgaagtaattgtcatttaattttcgactttaaataattttaatgcattattttctattttagaaacacatatgtaatagaaattaatattcagtgcgcttattagcagtcccggttcttacccctaaccgggtttaaagagaatttagaaataacgggaaaatatctttagtcccggttgatgagaataaccgggagtaaagatagaaaatatctttagcgggaaaatatctttagccagctgcctcgttgccgacgccgtcgccgacgtcgtcgcggccgaacatgactctgccgcgccgacgatgccgaccccgacctcgatgcggccggcaccggcgacgacgtcgcactggcagtgccaatgaagccgcgccacgacgccgttgcggcacggcaccgccgccgtgcaacgccgccaccgcgccacaccgatgccgcgcagccacgccgccgccacgcaacgcgccacgccgatgccgcgccgccatgccgccgtcgtgccaagccgcaaccgccccgccatgccgccgctctgctgccggcacaccgccgctccgctgccgccacgtgaatgaatgaacgatcgtgaacgagaacgaacgaacgaacatgaatgagaacgttgtcacaccctgaagttttcccccttttgcttgctttaaaaatttgttaaataaatcgtccggagaaattatcttaattaacctagagctaaatccctagttaataaatgcaattaataatcggaaatagtgtggtggaatttttcttgagttccccatgctccaatgcattaacaagaattttagtgaaatttttagagccttggaaataattttaaccaattaaaaatcaccaaagtgcaattttaaatcccaggaaaaatcctttcttccttttctttttcttttcattctttttt

SEQ ID NO: 22053 - DNA, 5186 bp, Oryza sativa
cactccccacatcggcggccaaataggggccattcccggccgtttccgcccctccttcgaccataaaaacctgcccccgagtcccctctctcgtttcacccatttgccgtcccctcccgtgccttctaccgagcccgggccgctcgccgctagcgccgccgcttgccgctgtctccggccgcacgctgtcgtagctagagccgtcgcctcgccgctcaatcacctccgccagcttcgccgacgcgagagctacctcggacgccgcttctttgccgcgaatcaccaccggagctccgatttccccgcgtcgccggtgtgctcgccattggttccatttccggccggccattttggtcgcgcggtcggcctctccatccctaactcctctcctcaccttctttaggtgttgccaccgcccatccgccgcccgtgtcgccggtcgtcggcgccgcctttgtttccccgcgccggccgccaccgcctcctcggtgaggaccggtctccctcccttcctctctctctctttgtcgcgacgcccgccgtttagcgccgccgctgtccgccgctcgccgtcgtgcgccgccgctcgccgccggtggccgcgccgagccgccgcgcgccatggccgggccggacatgccgtgcccgagcgccatgcccgggctggcctcggtgccggccgtccccagccgcctgatcggccctcggccgatcgtggccgtccatcccgtggcccgcgtggccagccacgtggtgccacgtggtacaccaccaccccggccccgtggacccggtccacggcagaccacccctttgagccgctgacccgtgggccccgcctgtcggcgccgccccctggatgacgtcagccctgggacttattgcgcaataaatacattaaggcttttcttttatagtaataaacacagtttatcttctaaaattcataagtaattcatccgagctccgtttaagtccattcaagtctcagtaaatcaagaaaaatgcaaagaatccattaaaaatacttttgtttcctgtttcagtagtcttatagcatgttttgcttgtgtgctttgtttgtcgcgtagatttcggccgtttcgtcgatccgcggtttctcgaagacgttgctgaggtctcatcagtgcaagagcaaggcaagtcatgcaatacgtttgatcatattgtacccaatttacaaatatcccgcatttctattaaatgttgcatccttttacaatgtaatgtgggatgggtcctattactcagccatttattgtttaccatatgccattgataacttgggtatttaaaatgactagatgttggcttaggaaatgcttagccatgcttagttcaactagtacacaaatggggatcactttattacatagactctgtctattggcataactttagattggtgccaccgcaatggtgttagttaattaaaatacactgtatggtgggctgtgggtgcatggttttgctggtcgcacccatggcagttaaagaccggttcacgggaaaccctgggagacctaccgtgcttaccacaagcgggagtgggtaactgcttgatctgaagtatagctcgaccctttcctaggcaccggtggcgagggtgggcgtgatggagttgggtcagccggggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatactttggagcatggcgacatgtgtgggatcgtgtcttgtgggtacagttgtacacctctggccagagtaaaactattcgaatagccgtgcccgcggttatgggcgatcaaccagattcaccgtgattagtctcacccctagtctagcttaatgaactggtgtagttcaggtggttggttgggcctgttgcaacgtggtgtagcgttggacagtgattggttaatattgattaattactacagctattttactgctttcaactactgctttgaaatgtctgctttatgcaaaagaacccctagcttcctttggttatatcctgcatcatacctcctcttccggtatgacttgctgagtacagtgggtagtactcagtcttgctctcttttcccccacaccagagttgaagtttttctcagttggagatgtcttgaagaggtgggtttcgtcgctgccgtcaagggttgcctatggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggacaggggtttaatacacattcagcttagaaattctggttcgtgaatttctgggcgtgacaaacgtgaatgaacgaacgtgaacgaacgaacgaacgtaaacgagaacgtgaacgtgaacgaacaaacaaacgtgaacgagaatgtgaacgtgaacgaacgaacgaacgtgaacgagaacgtgaacgaacgtgaacgagaacgtgaacgaacgaacgaacgtgaacgaacatgaacatgaacgaacgtgaacttaacgttgtatttgaacgtacataaacgaacgaacgtgcgtgaacgaaaagtgaacttaacaagaacgcgaacattatttaacatacgttaacgtgaacgcacgtgaacgaacgaacgtaggtgaatgaaacgtgaacttaacgagaacgcgaacgtgaacgatcatgaacgaaacatgaacttaacgagaacgcgaacgtgaaatacaatatatgttactttgcgtttatcctaatacatctttttgtatgttgcagaaaagacgttgtcgtcgtcgtccctcaagtcggagtggtagctagccctcgaaggaattcgcgcaggcaagtgatgtaaatatatgattgttagatttttaatgcaattaagactattagatttaatatacgacacttagacttagcatagttgataattacagttttaatacaatattatttgagttttagtataagattattatagttttaatataagattattagatttgtaattagacttagcatatacgacagttagacttagcatatatgacttagcatatatgattgttagcatataagattgttaaagcaaaaatgacctatagacttagcaactatttcttgtatgaacagatggctgatcgcgatgaggaacagatattgtacgatacaatcgcggagggaagcagccagtactggaacgaagaagaggggaacgaggatccaaaccagtacttgaacgaggaagggaacgtggagagggatgcggaggggaaccaggaggggcacgtggagagggatgtggaggggaacctggaggaggaggctagtggaagtcaaccctccgcaggacagaagagggcacgcgggcaacgaggtgccgtgaagaagcttgagggtcggcacatcataacggaagtggacgaagacggccgacctagtgccccggcggaagcagccaagaactacgtacgacacagcggttgggttgtgcgggataacatgcctgttagtacggtgtactagcgcagaacaagggcactcggagatcatgagaactttgtcccagattcggagaaagagatgctgtggacaataatgctcgagacattcacccttcccacgggtacataggacaaagtgaaaaggtggactctaaagaaaatggcagaacagtttcaaagcttcaagggagatctgtaccaaaaatatatcctgaagggacagacaccgaacttcgacacattcccaaagctaagggatcactgggacgagttcgttgcatataagacaagtcaacaagggcaggcgatgttggaaagaaacaaagaaaatgccgctaagaagaagtaccatcaccacttggggtcaggcggctatagcgtcgcgatgccgaagtgggaggagatggaggcaagcttgcttgagaggggtatcaaaccggccactgctaaatggccagatcgatcgaagttctggtactatgctcacggtggaacgctcaacccagttgatggctccctggtcttcagcgatcagatacgcgaggctgcgcgtcgactaacggacgcagtggaagcctcttctcagggcacgttccgacctgacagcgagaaggacgagctgtcactcgccctgcagactccagagcatccaggacgaacacgagggaaaggggtgattccttggaagattgggttcagggaggacatccacacgtacaggattcggatgaggagcaagagagataccgaggcgaagattgtagatcttgagtacagggtatcgagctacgagctcagcatgcaagaggaggtggcaaggaaggttgatgaacgcatggccgcacatcggtcccatgatccccagccgaccattcctcctgcaatggtgagcccttcaggaaatcgtagcagctgcgcctcaacggggcaggtaggatcacagagcatggacgccatgcaaacccaggacgaaaccacctgccccgttgatgacatcactcagcggataccatgtgagctgcatattcccttaaagaacttatcaataaaggtaagctcgtagtttatagattttagatttgtccattctgcaagttgctgcttatatatgttgattactaataaacaacctctcaccacgtgaaggtggcgtcgggcatggccatcccaatggacccttcaggtacttaccactgcaggccgattccagcaggatactccaaggtcgaagttcagttggtcgaaggcgcgtacgaggacctcgagttggattaccctagaggagacggtgagacgcatctacgagacacaagccacgccattatactatggcgcaagtggtacatcatccttcctgggcgacaagcggcgtctcgtgcaccatctcctccggcactgccatctcctcctcatgctcctacaccgtctcctcctcatgctccagcaccgtctccacctcaggctcctgcaccgactcctcctcaggctcctgcaccgactcctccgcaagct

SEQ ID NO: 22054 - DNA, 3850 bp, Oryza sativa
  unsure (1)..(3850): unsure at all n locations
tattaatgacaccaagctaactacggatcaattgctacgaggcgcaccaatcgaaaaggcggaagtgaaatacatgtacgaactcggtaaaccgcttgtcaagcctgagcagttgcagtccctacccacacaaatgtacaagttccatcaactgtacatggagatgagcgccaccggtagagagatgatcggagcgaggatcagggacacagacttcttgcaaggagatgacattctctggatcaatttcaagggtatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcagaaagtaaacgtcgcaatgctcgaccagtatccgcaagccacagaggaaaatctcatccatctcctgaaggcgcagcattacaagacgttcatactgttgccgtacaacacagagttagtttaattttactgtcttcctataccaaatttcattcccatacgaacatgctaagtgtttcatatgtaatgcatcccacgcacattgcagattccactaggtgctgttactcttcgacctggaggcctgcaccgtcaacatatatgactcaatggataaaaaagagtctacgtttgacaaggttttcgaacttatagacaggtattgtcataagttcctatgttaattaagaatcttgttataattaattgctactaagaatcatagctttaaactccatgtagggcttggtatcggttccgtcatttggtccgcgcaaatgaagagaaagactatgcgaagtttcaattttcttgtgagtacacatgctctacattantattgaatctcccattcaaatacanacaagtgtatattattagatgtctcgccgtttgtcatttatttatagtgcgcaaagcaaaagcatggaactaacttgtgtggctactacgtgtgcgagtattgccactgccttgcaaaccaaatcatcaccacaagagagctcgatgtacgtacaaataaattcaaattttcattacgtatcgatttgttgtttaattactaattaatttcatacattcatatagtttattcgcatgagggataacctgatcacacacaaggaatttatcgcggcggttcaagaacaactcatgggattcatcaacaaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtgtacacattttctttaatgtaaatatatattttggtcatatatatatatgcaaaaaaaatgttaagtgctttcacatatatatatatatatatatatatatatatatatatatatatatatatatatatatatatatatatatatacacacacatgcatttgcataacatatatatgtataaatacatatatattatgcatgtatatgtattgaaacatatatatatatatatatatatatatatatattatatgcatatatatatatatataatatattatatgcatatatatgtattgaaacatatatatgcatggtatatataaaccatgcagcaacagggccatgcaaaaaaaaaaggtcagctcaatctttagtcccgattgatggctcagccggccacgtggctgagccatctttagtcccggttattttacccgggactaaagatagcgatctttagtcccggattgatagtcctggtttagaaaccgggactaaaggggggttacaaaccgggactacaaacgctttctccaccagtgtagagatcctaccttttaccataaactccctttaaatagcaagttttacggttaggtcctttgccccatctctaccgtttatttttaatccgatggctttgaatcaagtggtgacacgtggcaaatttttagaagggctaaccagatttatagggcgccatgtggctcaataggaagccagaagctataccctgaattcagttttagagattggagttttatatatgtaattatacaagccaagcaacaaccttgccatatgaagtagagtgaaagaagagttggtgtatgttataatttgttaattattaatttttaatttcgaaattaaattaacgaagagccatattgagaaacctaactaatgatgccttcgcttgaaatttattatttaagattgcaaaagaaaatgcatatttaaattaagacaaaaggaagaaaagcacctaacctggtttgctcgctaaatttgtaaattaatcacaactattcctcctgttttgcatccttcattcacccgcctatgaccatattttaaaagaaatcttccacgatcaccttgtcattggtctatgctaatatgctttgtagattgccatggctttgttgcacgggttctgcagcagaactgcatacatgatgcaagcatatacctgtcattagaaccgtcacttaaattatagatggtggaatgattaacgaaacaatacttcactgtgccggcgtagtggcaggagattcgaaccgggggatcacgaacgagatgtggccatctcagcggccgctcgctcctcactgcactgtttctgcagcagatactactactgcaagaattcgccgagtttgacgcccgcgatgatcattgtcaggtagatgcatcgtccatgaagtatcgattttgttcatcaacatgacaacatcttaatggccgcgtgcatgatcatgatgaaaagccactggaaacaattgaaacgaccgtgcggacggactaaagatgatgaaacacgatatggattggtcaacacacttgtatattagatgggtttttggaacacgtatataataaattcgttctaaattaaaacccatatataaatacgtattataatctacggatctttctaattaacgcgtgagagctcctaaaagtgtccaattagtataggtatagatagatagatagatagatagataggttatagatagatagattgtccatatagttgatgagtaaattgtatcgcgaagggcggtagttacacaaggacaaagcgtgattcctacttttatttatggttatcgttcatcactagaaattaattgcaaaaccccggccatctaccgatcatgttctttctatttactcaacctcttcatctttgttcctgttgcaaacgcacaatcaaaaaggctacagtagacggcatggcttcacttttgaccaatcatctactgttggagacatgttacgaggattttcgaccagaactgccaaaacgaatcaacgaccatggggcgaagcatagccaaggctccgggcaaagccgaagctcttcgctaccgagttggccatcttcgccaagaccttggatgatatgcagattcctcgctccgagctaaaaccaagcaatgcgccttttcatggagtaattccaggattatccgcaactccactcggccagatcaccctcccggtcacttttggcactcgggaaaactttcgcacagagaatatcagctttgaagtcgccgatttcgagacagcataccatgccatactcggacgcccggcgttagccaagttcatggccgtcccgcattacacttacatgatga

SEQ ID NO: 22055 - DNA, 2944 bp, Oryza sativa
aaaaagactttcgggcactggagcaggagtggttctaatttcaccaactggagaaagattaagctatgtactttggatacatttttcggcgtcccacaacgtcgccgagtatgaggccctccttcatggactgcgaattgcaatttccctagggataaagcgtctaatagttcgaggtgattcacagctagttgtcaaccaggttatgaaagagtggtcctgccttgatgacaatatgatgacatatcgacaagaggtacgcaaattggaagacaagttcgatggactcgagctcagtcacgttcttcgacacaacaatgaagctgccgacagacttgccaactttggatccaagcgcgaggtggcgccctctgatgttttcgttgaacacctttatacgccgacagtacctcacaaagatgctactcaagttgcgggcactcaagacgtagctatggttgaagccgactggcgagagcccctcatacgatttttgacttctcaagaactcccccaagacaaagatgaggccgagcggatttcaaggcggagcaaactttatgttatgcatgaagctgagttgtacaagaaaagcccttcagggattctgcaacgctgcgtatctttagaggaagggagacaattgctgcaagatatacattctgggatatgcggaaaccatgctgctgcacgcaccattgtcggcaaagcttaccggcagggttttttctggcctactgcagtgtccgacgccgacaaaattgtgcggacatgtgaaggttgccaatttttcgccagacaaattcatctaccagctcaagagttgcagactatcccgctgtcttggccgtttgcggtttgggggcttgacatggttggcccgtttaaaaaggcagtcggcggttacacgcatctctttgtggctattgataaattttccaagtggattgaagctaaaccagttgtcacaatcacagcggataacgctcgagacttcttcatcaacattgtgcatagattcggagtgcccaatcggatcattactgataatggcacacaattcactggcggagtttttaaagacttttgtgaagactttggaattaagatttgctatgcctcagtggcacaccccatgagcaatggacaggtggagcgagccaatggcatgatacttcaagggattaaagcgcgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgaatctttgcgctttcgaaatttccgtgaagaacgctacgaagaggaccgagtggatgacttgcaccgattggaagaagtccgcgaagcagctttgattcggtcggctcgatatttacaagggttgcggcgttatcataatcgcaatgttcgatcccgtgcctttctagtcggcgacctggttttgtggaaaattcaaactacacgggatcggcacaagttatctcctttatgggaggggccatttatcatctctgaagtcacccgaccaggttcctaccgactcaagcgcgaagacggtactctcgtcgacaactcttggaacattgaacatcttcgtcgtttctatgcttaagcttatcattgtatctccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgacaaaaacttttaagaaatcaaagatttggctagaactatcaagcacagcataaatacaccagtattgtacaaattgagcctccatttgttacattcatattcagtcagaatcagtcctttcatcatcagaattattactacttggctgaaggtcgttgttacggaattgatatacaatgtcacttgcaattttgtcagccgcattctgagcattgctgataagatcaagggcggcctcctcgcttgtcccgtctgcaaagccatcaatggagtcaatttcaattctcgggtacaaggatttggtcattgccaatgccatgctagcttccatacttccagctttcttgatgttcttgaagtacacatccggtgcaactcttagcttgtcaaagatctcggttgcgtcaagtgcactcggaccactggtattaagaaacatagcttggacaagtggtgtagcgacattggcgacttcatctcttgcttccttcaagcctcttgatcttaccaaccaagacgtcaaactgagcttggggattgatcttgcggtctgcaaaacacattcatgataagaatttgttgcattaaaaagagataagttcagatcgtcagctggcagtaccttcaacctcttcaaggccgagtccctttcttgagctagttcttgccttgtcttttctcaaggcttcaatttgcttctccatttgagccatcctggcggcttgcgctgtttgagattcaaatggttgaggatacggttatgacggcctgaatcaatgggacagatctagagattaccttttgatgaaccactcagctcgtagtttgaatcctggagctgagcgattcgttcccttaattccttctccgttttcttggcatgctccttggcctcgtgtagctggctcctaacggcttcaagagttcccaaatgaggaaccagcttttctaaggttgtggtcttggcctcattgcgaagatggattctctgcacggtggttcatggattagttttgctaacga

SEQ ID NO: 22056 - DNA, 19841 bp, Oryza sativa
  unsure (1)..(19841): unsure at all n locations
ctcttgatttagatctacatccgactggtttccagtcgggggctctcgggttgtgcagtttcagttgctgccgactggtttccagtcggcggctgatcactcggattggccttgtcgtccgaagcttgggcgccagtcggctgactttcggcagtcggttggctttcggcagtcggctggctttcggcagtcggctcagcatctttggataaatttggctctgtggcagctggatcaggttcttttccagttggatctatatcggacggtttcctgcaaagtgtcctttcgatattcagcgtaatttctatgagagaagcatgccgaaataaaatggtaccgagaggtttatacctggaagatgttctaatctttggcatttgacggccagccagttttttcctgggcatggtatgctttgggggtttattgggcgttcctttgtccccagatttgttgctgtcatcgccttcgtcgtcattaagtaccagctttctcttgcgagaacctgtctgcccagccggtttggaggtttgaggttgcgggtctgacctgattgtcggtcctccacttccctgaatggtgtgctggcgaggagatcggcgctgagcaattgggggatcagatttcatcaatacgtgctcctgaatgagatgtttccacggttaattaattcgacatggagacaagattatgttttgatcatgggttgccgatttctgatacgtacctgcggaggtggattgaatgcgttgtatggtacaactggcagttggtgtgagtagctgacgacaatggcgttcgagaatatcttgtacatcctctccttcatgatcttaaagtccagagaatctgggtcttcacggtttggatcatgtttgccgtcaaactcaaatgctgtgcgggatctctctttgattggagctaatcggcacttaatgaaatgccgagtgatttgttctccctgtaagccttgctctttgagcttcagcatgcgttccatcagttctaaggcctgggcagcttcatctcccatgggaagagagttccaggtatcttggtatactgggggaagacaggagcactcaggaagagcgggctcgggattttgaatataaaaccagttggcgtgccatcctttgtttgaagtcttgaaaggcatagagaaatacttctggctcagagtgccccttagttgaaatccagccccaccaactacgcatggtttgtttttgttcggttgaggcttaaggaaaaagattcggcggaacagagcaaaatgaggtctaatgcccaaaaaagcttcacagacatggacgaaatttgcaatatggactatggagttcggattcaaatgatgtacgctgattccatagaaattcagtatcccacggaagaacgttgaggttggaagagcaaatccaccataaaagaaatgagagaagaccacgacctcatgtgtatcgggggtcggaaaagcctcaccgcacgctggccgccacccgatgatctccttggcagggagaacgccgtgcgccaccatctccttcaggttctcctccgtcacgtcggacggcgcccattggccttcgaagttttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcgcagctctgtactgtagcaaggagtggggaaaatggcgagagttccggcggggaagacgaagcgtcgtttggatctcgggttttcttgttaagggtatcggaggtgagaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtacgcttttttaggctacaaaagctgtctgggttaacttggaatgacttgtttttatcatagtcatttcctcggtatgttatatgcctgttttcattatggtaaatagtcatagcctaggctattagacttattcattaccatgatttttatgatatttggtgggtaatctttagagtcttatattcggatgcctgtcaagtgtgttcattcgtgaactttttagagtgttaaccactcggattccttttattgtgactaaaaagcagtcggctagaatgcctctttgggtgccgcgtatgcttttgtcatatgatgcatgattgtgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattgtctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgagacttagtcggtcacgactgtatttgatctgtatctgtgtattccgttaaggatatagattatcttttgtaacctggactccttcccatatataaggggggtccgggcgcctctaggggcatatgttgattttcccaaatcatacaatcaataatacactcggcggattcatccccggacaggagtagggtgttacttcttttataagaaggcctgaacctgtataaatcctttgtctccaaacccatacacttttccagcttgatagccacccccttttattattgccgaaatctagtttcgacagttaccgagttggcgctcggtcacttgggggagggggaaaaatcaggcgctccccccctcccgacgcgcacgtacccctgctagcgtgtacatctcagagctcgcctagccgctcagtttcttgaagagcctgacgaccttgtgcttgctagtggccccatcgaaggcaagcccagcgctggaccactcgaatgggaaccacaacatcatgatgttgtggaactgcgcgccgctgaggatcggtagcggtgattccacctccgccgctagcccaatgagagagatgactccgtgtaataatgccgcaacgatgcactgacatgtggggcctgtcgtatgccacgtcagcgaacctagggttaaatttggtctatactgctttaggaccttttttacacggtttgtaatagttgaggggtagggatttctggtattgggaattgggaacctcagacagactaagtgtaaagttcagggatgtcaagtgaacttacatgaaaagggatgacgaattgcattgccacgaagcggacgacacggtgcgtgcgattcatcatcctcgctgctccagtgctttgggagtcgcgctccatcctacaacatcggagtgctaatccgtgcgtgttacccgtgcatgcggtgaaagacgcgatacgaacgattcttcaatttttataatatactccctaataatatttacaacacaccaaattagtttcattaaatctataattgaatgtatttttataatatatttatattgggttaaaaattttattacatttttctacaaacttatcaaacttggagcagtttgacattgaccaaagtcaaaagtatataaacatgtaaagataaagattacccgtatatcgacatcgtatcgaaataagatggcataccaaattttggctagaaatatcttcaatttttctactagcagagattggattgccacgttggcgctaagtgtataccatgccatgtaggacccaaacgttccggattgagtccgggggtaattgtctagtatcaataatttgaggtttaaaatgtccggctttatggtttagggggtaattcatactttttccttaaacaaactatgataatatatgcaacctgtttatttaaaaagaacttactttttttaagtagtactagtcaaaatggcatctgaccgtatcaaacataaaaatgcatttttagacgtattaaaataccaattcacgaaaaacaaatacactactctctccggttgataatacttgtcgttttggacaaggacacggtcttcaaaaaataactttgaccattattttctattataatatgtataaaagtgttgacaaatatatgattttattaaagtactttttaagactactctatacatgtagtcatcatatttgaaagccatatattttaaaaatgattcataatcaaagattctaaaacgacaagtattatcagtccggagggagtactattatctccgtttcatattataagccgttttgatttttttagttaaacttatttagctttgactaagtttataaaaaaatatagtaatatttttaaacacaaaataaatatattatcattaaatattgattttagtgaaactaatttgatgttgtagatattgctaaatttttctataaatttaattaaatttaaagaaaagtttaactataaaaaagtgaaagtgacataatatgaaatatgagagagagagagagagtaggtacttttcgtgtatttttatttccacacgggatgttccgtgtgcgagttaattcaactcttcggaagaccaccctccctcccctcacaaatagacacacacatccacgactcccccgtgcgcacgggcccacctgtcaggagacaacacgtgggcccaccccacgccattgaacccttctattggatgcccggaaaatacgtgcgccccaccaactgactcacatctttccccctccccctcgccccccgcaacgcacgttcctttccgaccgatccaccgatcggaaaccacgccctaaccccagcaaaccccaacgccccctccgccctgccaccctccgccgccgccgccttcgccggcgaccaccccgccgccctccccggggggacccatctcctccgccgtcccctcgccgcctgcaccccggcggtgcctcggcgtcctgctctgccgcctcctcgccggtgagcgccatcctcctccttcctcatccctctcgcgcgttgcgttaagcctcgtcttctctgggtagatctggaagcttttctcttagtttggcttagccttctctggtaataatggcgatttgtttgttttttcccccaaaaataaggggttccatgcccccacacccgcgttaggtgcgccgctcgattaaatgctgtaatttctgcatcctttcttggttggaatgggtgccctaggaagggtaaattttggtcatgccaaatttgatgattctacaccgagagatgcggaatgcgcatgtggattgcacctgtatggctgtatgcgattgaaatgagaggaattgtgcagctctcaaaatgctataggctagaaaaatcataccataccatgcatacatttgttttaagactacgtgattagcgtggaattgagggtggcggatgtacttgcttactctgggtgaaattggtgttgctcaatcgaaattccacatgttggcattatgatatgcatgctacattgttatttacaatgtaagatggagacatggtcgttattgatacatcgggtttgttttgagatcctgggcaccataaaagcttttgctagccaatccatttagcaccagatgacccatgctctttacttacaaaattactatcactgtgggagtcaccgggtaagcatgacctatggccatgggtttggggaagggaaaaaaattgttttgaaatatatttgatgatgggccttacctgtattttgtcaatctcaaactagaaactaacatcttattagcctgtagcattatcttaaagtaatcccctgtagaattctataaaatataacctagtgtgacgctagacatagggcctgttnantttnatgncanttttaancttaccaaattttggtaaagttgccaaaaaagtggctacatttagtttgctgtcaaattttggtaactatataagaaatcctaccaaaattttggcataattgccaaaattttggcaatgcccaaatttggtaaggttttttttggcatcaaagtgaacaggcccataatcaatatacgttttcttagaatgctcgtaaactatatgggagaaacagactggtttcaaggcctattagcacatgttatgcagtttctttcgtaaaactggccatatttataattcatttactgaacatattactacaatcattttctgtaataattgttttgtaactccattaaatcttctgtggcagtgtgcataatacatattcggaaaggcaaatatggctacaaaactccgtcaaccgtcaactgatgcagaaaaaacagaggttggagaaatagacacaagggctccttttgaatccgtcaaagctgcagtaagcttatttggggaagttcgattttcatctgacaaatcagctgcaaggaagccaaagcctcctcaggcagaggtaggtacttatattaaacatttttttcatattagattaataatagtacttcaatgtgtgcatgcatatatctttatgaaggttgaacataccgatttgtgtggaatgttatgcgtgcctactattacatggaatacttataagtacagcaatgttgcagaccttgatgttcttaagccttgttgattccagaactgctaacttcaaatcttacgcaacaaaatgctgtgaccttcaagtgtgttatactgatgccaatatgccataatgttgataaccattttcaaatgtctaagtagtttcatgtagcacttatttgaagctaagtaacacagatcttggaacgatgctgtgttcctcgtccagtgaactttgtcccgaaacaaggaacgggaacaacacaagatgacgtaccgaacgtggatggatcacatcctaacataaggaggtatgaggaaggcaaatctgagaggggttgggtttagggatggggaatgcaccagggtcacagccgcaacgggcgagcactgttattgctccctcgctgcttgctgccatcgcacctgagtgcatggaggaacgccaccgctgttgcgctgaggaggacgggggagtgctgctgctgttgtgccgaagggggttgggggagcgttgtcgccactgacctgagggaggacaggaagcaccgctgtagtcgtgctgcggggcttggggaagtgcggttgccgctgtcgcgccgaggggcatgggggagtgccatctccatcgtcgctatcacgctgagtggctgagaacgatgggatggattctttccatcgatgggataagactgtgagtggataagggattcatcttatttcatttttgctcttggactctgaatattatgaacagttctttattgaattgatttctttcatataagccataaaatttcatatatattcatttaagcttattgtatgcataacaatggaatgctcatatttataagcccttggcttctaatttctgatattgttccggactatcatcccggaaactaatggaacgcattccatactttgaacaaacgttttgaagaggtatttcccccttcataccatatttttcaaaatccctgttccgggatctttttatgacttaggtttgaagccacgcctttgttttttttaatgaaatttgtcatatcagcaaactatttcctgcatgttccagtgaataccacaagatacttgttttttatatgctctaactcttttcatttgcatttactttcctgttcattcctatttcttttttgcaagaaataggtgtgttcccactgttagaaatttcaggctgttccccagcctatttgctgtctttaattaaacagattattattaaattaatgcacattctccatttatgagtcttttcacagcagaaatttgatttgcatttctgaaagaatagtagttttgccttctacttttactttgattatttgtcttggtagttgttgtacctggtccacatctgatgaactacactttagaagagagcataattgagtgacttgttggcagaaacagagaaagaattagcgatgattcaccatatgatactactagaagtctaagtttttgtttgtattttttttttggggggggggggggtgtggggactgacatgcattcataccattaaaaaagttcagtcctgtaagctcaagttttgctggatttaattttcaccttcgttttcgactccaaatagtgccactcctggagattggttgtcccatgcttccttccatgtgcctatttgaatattgcatcatagttgccatggccataatcacataaacgcaatgcagaaacattagttccagcttaagacaggagtatcaaatttgttatatggtataagctttgaacgtaaacccagatacaaatctttcactcactgaaaagttaaaacatcaggtactgggttttttctggattggaattgtatcaagataggactaatttgatcaaagtatcaccccagtctcactcctacaagtagtgatgtccttgagccaacttaggggcctgcgaggcaccatgatactgggatctgacgtgcaatcctttgctcatacccattcattgtctgttgccttggtccactggtcttcatcttctctgagcctggcatggttgccagtatctccaagacctactgttgccatggaaataggggcagcggtgagctggttagaccgttagagcaacagtttggtagaggaaggtggcagctgctggtacttgggactgttaattggatggaaaggtggcagtggcatgatggtggaaagcactgttgcctatgacacttggtgtttacgcagcaggcaagcgagccaatgtgtcctagatggtgcataggcaagcacatttttagggattgcggcaagcaacaatagcatgttatagcatatcagcttcacatgtggacccagtcagtgttgagtgttgggtggacaccaaaatctgatgtcatccaaacaagccttagtgttttacttactaagagtatgttttatttgatgatatatataatttttttatcaacaattacatgcatatcaggcgaatccctgaatcatctttttttagctcaactcagacactcaaatctgagttggactctgacatcagtgtcccagtaagactggacccagttagcaatcttaggctcttagtaagtaataatggtggtagcggcaagtaggcagttagccatgcagcaacagccaagaccacccaagcagcagaaaagagaaaacaaagaaggctaggagtgggctgcctggaagagatggtttggagcttgcaagcggtggctctgtttcaggtgttttaatgacattagtggtgacatcactagtttcagtatggcagtcgaattagcactgaatcatgtcttagtgaactatacacacatcttttgtgacttacatgattggctgatttgtaggtcacttcagcatagctaagcttactaggacaccatgtaactgaaaacaagccaaaaaactatagcggttttgggcgagtgggtgattcttctgcttttatggttgaaaggtgcctaatggtttgtttgtgattgggatttcatttgtagacctaggcaatagtttttttctttaggtgagagtgagtcccatggtcacgacagggagtccacagaagcacctctcacatatgtgtatctagtacatgtgggaggatgctttgttaagcttaaattttatttgatttgttttggattggcatggtcaacataacaaaagaacagttagagacagtgattgaaaattttttttggatgttgtaaatgtacatgcgcagatagttcacaatgcctaatgttgggatgctgtctaatatagatcaactaaaattgtcaactgcctccatcatccagacatgtagtatctcaggatctttcttagttgtttttactttttccaattttatagttttttaatgcgattgtattatcttttgaggatgcatttttgtgcttatatttaacatgttttttcatgcatttaaatttcttcattttaatcgcatggacctcatatttttacatcatagagtataactgtataagtaataactgaacactcatatggtttaactgagtctataacttcattatccatggaatggcatttcactttatctattttgtatttggttatccaaatatactctgatgcttgcaatatcaaaatcctatcctgtggcagagggtgttagctaaggagacagaactgcacttggcccagaaagagttaaataaatacaaggatcagctcaacaatgctgagacaaccagagtgcaagcgttatctgagctggagaaagctaagaaaactgttgaggacctgaccaataagctggatgctatcaacaagtccaaagagctggctattcaagcaacagaggatgcaaaaactcgaacaaagcagcttgaaggtggagactcgcttgaggctgttggaaaagatggccctttaaagcaggaattggatgttgcaagggaacagtatgttgttgctttggcagatcttgatgcagcaaaacaggagcttagaaagctcaagaaggattttgaagcttcattggatatgaggttggctgcagcacagcaggaagaggaatcattgcacttagctgaaacaaacaagcaaaaggctgatcagcttcgcaaggagattgctacaattcaagagtctcttacgcatgtgaaggcagccactgaacaagcacatgaagaagaggctcaaatccttgctgagaaagatgttactaggaaaacatacaaacaagctttggaagaagccgagaagaaattatcctctttgaaaaaggattttgatcctgctgtttataaaagcctcaaagaaaagctagatgagaccaatttggagatttcatctatgcagaaaaagattgaagatgctcgagctcaagatttggagtctattgctactgtcagcacagagttggatgatgctaaggaaatgtacagaaagtggcagaggaggaaagttctcttcggagtttagtagaatcacttaaacaagagttagaagctgttaaggaggagcatgatcaattgaaacagaaggatacagaaactgaatccatagttggagacctacatgtgaagcttcagaaatgcaaatctgagcttgaggcagccgtagctgctgaatcaaaagcaacgtcagcttctgatgacttgatgttggccctccaacagttgtcttccgagtcaaaaaatgccctgcaggaagctgaagtaatgcaaaagagtgctgcagatttaagggatgaagctgaagctgcacgagtagcattagcagaagctgaacaaaagttgcaatctgctttaaaagaagcagaagaggcaaaatcagctgaagcaaaggcccttgatcagatcaagcaactatcagaaagagcaagcgctgctcgggcctcaacatctgaatcaggtgcgaagataacaatatcaaaagaagagtttgaatctcttagccgaaaggtggaggagtcagagaaattgagtgagatgaaagttgctgccgctatggctcaagtggaggctgtcagagccagtgagaatgaggcgattaagaaattggaggcggctcggaaagagatggaagacatggaattggcaacagaggaagcactaaagagggcagagatggctgaagcagcaaagagagctgtagaaggtgagctcaggaggtggcgcgagaaggagcagaagaaagctgctgaagctcagcctgctccagaagcgcaagcacatggaactgcatcttcccctgtacagaaagcttctgctggaaaagccaatgagaagaatgatggacctcacaagaacagcagaacactattgaaaaagagctttatgctaccaaatattacaagcatgttccataagaagaagaatcatgccgacggcagttctccttcacatcttcctggggacaaatctgtataatctatctgaagctcacgtctgaatgatgtgattccaaacttggaatcatggctttatgtatgatattatatttgtagttgcttgtaatatataatgttatcctggtctatatctatgacttgcctgttcctgactatttgggctcctgtgataagtttttttcttttttgtacctctgaaattcgctgtggttatattgatctgagcagtttgtctgctatcaacagaaataaccacgttttattcatgtcgtgcattactttcagatataatgcaacgttgaagtgttaaattctggattattgaattgtgatttatagactgtcacagttgccaatgaacatgaagatctagatgtgttttgctggagtatcatatattcatctttgaagattagaaagtgttgcctcatcattggcataatcatgtgatcttaggggctaccttgaattttatttgggaggtaatttccccaattaaattatctttagtttcattttggggatagtttctacagttaaattcatatccaatatgtagttcagtattgtctaattcagccatacatcacattagtagtaatttaattggtaacatcatatctcagcagcacagaatacacaaatgttgtgagagcctgtcaggtgaggtgcccatacaagtacacacaacgtgttttctatatgcatgtgaaaattgcaaaactaaagaatgctaatgtcaatatacttcttttatttacaagacgtgcaaaaataaaatgctaggatacatgtaggcgcaaggtgggaggaacctggcaaggtcgctgctttccgatgattttgtcctgcatcattcatctcacataaccaaatggtctgtttcgtgagaattccacaggatcattttgtaagaaaataatgtcattttcccttattttccattggcaatccactgatccaaacagggcccaaaaccttaaaaagtttgcctttttggggagctactgtaagctcacaaaggaggttctgtatccgattgtgaaataagtaaagctgcctaatcaatcctttctagattatatttcaccatgttctcaagagtgcttctgaactcactccttggaagacactgcagactttggatagctatttcacccttctctcttgcaagctcatgagccctctttattccaccacttctatgaactagctctattgcagtagccaaggaatttgtttcactgaactcggaatcaatgatctccctgagctgtggttcatcttgcaaagcgaaaatgaccggggctgttagattaccctttgccaggtcacttcctgcaggtttcccaagttgttcagctgattgggtgaagtcaagaatgtcatcgactacctggaaggagagaccgagattccttccgtattcatacatttgttcacatatagcagtgctgacaccactaaatatggcagctgaccttgtgcttgctgcaatcagagaagcagtcttgtagtagctcttgagcaggtaatcatcaagggtgatgtcacagtcaaaaagtgttgatgcttgttttatttcaccactggcaaaatccttgattacctgttaaagaagcacctttctggatgcaaatcatgcatagttttaaataaggcacaaaaacttgctcaaactcttcattacctgactgatgagctttataacttcaatattttcaaggtttgcaagaaaccaagaagattgtgcaaacataaaatcaccagcaagtacagccacccgtgttccatatagctgatgaatagtttccttccctaaaaataataaatgtacctcagattaaacaggtaaatttcttgagtcccctatttcacaatgacaatagaaaggagttaagtaaaatcaaacaggattgccatataaataacgaaaacaaataacaaaacagtttcgtttttttcttttagagcgaaacagaacagtttctgtaatgcaacgacagcattttttggtttcaaactagatgaatgcatggaggcaaaattcagacaatgtatttctaagaatatgcaggagagtattctaagaagaataaacggtaggcacatgtgtcacaaaaatgaaataacaaagatcggtttttgttgacagttctgttggctaagagagaatggttattactgccagtactgctggccttccataaaaacaacataatacgtacctcttcgcatcccactatcatctatgacgtcgtcatgtattaaacttgcagtgtggatcatctctatgatctctgccaaacgttggtgttctgtagttagttccctgtaatccaaaaatcaaagatcttgagggaataattttaaaagactaaagtatatgataggtgtctaaacttgtgtggtgtcacctaggtgcttgaacttgagaactgcacattcatgtcctgggatttgtataaatgggttaacaaagtaccatatgccattttatggtaattagaaatgacatgtgacacccttagtccaaatcatagttttgttttccaattgaaatcaatagatattaatattttgcaattcgaaggaaaatttcacacgtcactaagatttttatttactttggtagaaattctttagtcaaacttgatttagcagggttaaagtgctgcctgaacattggtaacttattaagtttgggttggatagaagccaatttgcatttctgtaattcggtgacttaaataacacacatgttatggtttagggacctatgagatagtgcactctattccaaactgtcacaccctgattttcgtttcaggatttataaattatttaataaattattaatagaatttatattaaatgttcattaatttacaagtgaagttaaatgtggaaaataaaatttcctaaatacaaagcatggatggatttaatttttattaaattctccatggttaattatactctctggaattttctcggatttttcggagctcaattgttaattttaatcatacaaagagaagttcagcaattatttaaatattaaaataatcattaaatgatctaattataatttttaagagtttttcttgtttaaaaatccttaaattataaattgttgtttaaaaggaattattagaaataattttaaaagtttaaaagagaagatcttttttttaatttgctaaatctcaatataaaattgaactagataaaattttattaaatactatgcttgctcctctattttctagatttttctgggaattatttgagcaagggaagtatttttaataaatgaaacatcatttcacgaattattttaattgaaaaagttttaaaaatcccttcctaagccgttgggccgttttcggcccaactcttctcttccccgcgcggccgaaccggcccaagccggcccagccgacgccgcccgccctctcctcccctcagccgccgacaggtgggacccacctgtcgggtgtgtcttccacctccggccgagcccaagccggccgagatgccgagcccgagccgccttcttctcctctcaaatctgctccaatccgactctttttcttcgggatttttgaggggattttatcctcacatactcctctatcttttccctcaagaatcggagcaaatggttgagtatcttgcccgaatcaaattcgttttcgagtttatctccaaaaccgagttttgattatcttggatcgattcctctcgtttggagtccgatctctctaatccaatgctataaatagcatcccctagtcgtcctctaccgtttgccccaagtcccgagctctctcgtcgcccgtagcgttgccgccacgttgccctagccgctgccgtcgccggcgaccttccagccgcgtcgcgccgccacggtagtcgtcgccgttgccatccgtcgccgccgttaggtgcgcaaggaggtgaggaacctcggccgcccgtcccccttcgctgccgaccaccggagttcgccgtcgccgtccaacccgagccgccgccgcctcttgcgtcgtcgccggccgtcgtcggttgtcgttgggcgctttggtgagtaccatcgggttcgtctcgatgccctctacgcgtaggtgccctccttttccccggccaaggcccctatctccggcgagcttgctaaccctaatcggccgatcgtgggtgacgtcatgctgacgtcatcgtccctttttccttttccttttttcttttttttctaatagtttaaatctttggaaaatcataactaaataaccgtagatccgttttaggtggttcaagttgccaaatttttctaaaataaagatctacatattaaaattgtccataaattgaattaaatttatttagttttttttaaatgggctttaattagatttgatcttgtaaaattcataataaattcatttgaagtcagaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgtgagtgcgtcggaagtgatcaagaagattaattgaagactgattattgcaaggcaagtcacacagatcctaaacacaatcctttgagcatgttgatcctatatttaaattctctatttatttcaactgtgcatttattttcgaatgtcatcgggtggtgtgaacctattcctttgttatggccaatttgcattgaatgccctattccttgataccttgggtaataaattgattagcttgaaccttatatattggattggttcagctaaatgctatatgtaagtttgcttagctatgcttagaaacattagcctaactaaagggattaattataaactatgttacattattcttattaattatggttacatttaatggtagctcacgatggttaatcgtgtgatgataattaattgataattaaaacctggttaaggtgggttgtgagcatatggttttgatggttgtgctcatgacaattaaggaccggttcgcgagctactgttgtgaaacattttccgtgccaaccacaagccagcgtgggcaccggctttatctcttgtatagcatgatttattatagtgtgccagactgtgaagtggcgagaagtccatgggggtcgctggggagtccatgcctctggttgtagagggggtgattatgatccaggaatggtgcaccgtggtgagttgtgttatgcaggggataatgtcacagcctctattcgggtactttccagtatcgcgacgcatggtagacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctggtttggagttagatctgtacagccgggtatggttgttcaggatggttgggcctgtgcagcatgggtgtgctgttcagtgttgattaaaatttctgattaattactccactgttttgtttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagaaaaaggatccagaaggagaagacgtttggcttatacccagttgagctgcctgtgggagtggagtcggagcttcgctagattttatttttccgctgcagctttcttcatgatgaggactaagtgcctcttaagtaagtatttatttgctttagttgttgatgaatctgtatattaaattgtcagtttgtgtacctcggctgattcctggacgaggattttatgcacaaataagttcggaaattactagtgaatttccgggcgtgacacaaacctactcacatcaatgataatgcagccaaaaggaacttacaataaaccagccaattcagcagttgctctggataccagaaaaactagtgccggtcttaatctttttccaccggcaccaaatatttgttcagccgcagaaactaaaactggattttctgcaccaacaagctattaaaattatgtcagctagttattgtaacaagaacgtacataagtacaatttcctcttgaaaaaagtttaggtactagtatttgatatgtcattctgtgatgtttgatgtcttgcttaagcagacattgatgatctatagaggaaggattggaaaaatgatagtattgtgcaatgtcactactcaagagcagaaaacatgtcaaagctcagcaattatagagaagttgcataaaatagcaaacatggaagaagttattgagtgtgcaaaagcactacataagagctactataaggcatttgctcattcagtctacttctgactcccaacttcccaagcctctttggctgtgtatatcccagggtttacaatttcgatttcggtgatttcggtaggaccgaaatttaatttcgtgattttcggcactttccagaaattttgaaagattttgactggatttgaaaaaactttgaccaaattccacaaaaaattgagaaaacccgaaaatttcggtcagtatattgattgccggtggggtccgaaatttcgaaccgaattgtaaacactggtatatccatttagagatatagaggccagatttctatccattatccaaaaaaacttcccaagcctccattcctcgataactggggtcattagttagttcaaaaggaatggaccattatgcgactctgcactgtttactcgctcctgcagtatattccagtaacactgcaaatgatgggcatatttctttccctttcaaccttcgttgcacattaatttccctcgacgaacgcaaggaactaagaatacattttatttttccagaagttacaaccattaacatattgttcaaccagccaaccaaccaagtacttaaattgtccacaactttatcactaagtgcaaattttttttattctaaaatttatggactaaaaactgtcacagttcgatacatttccaagcaaaatcagtgcaactttttttttttttgtattggactatgtcgtagcaaccgtgagccttgtaccaaatgtgctaggagaaagagaagctattcaatcatacttgtatcatgaacaagctgaacagaatgatgcaaactttgggaggaaaaggtgaagctcaccgatttgaggttgttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22057 - DNA, 1050 bp, Oryza sativa
  unsure (1)..(1050): unsure at all n locations
gcgcggnannnnnnnnnnnnnnnnnnnnnnnnnnnnnnnnnnnnnnnnnnnnnnnnnnaacgacatggactgctcggattgtatccatattggtttccttagttctacttggataaggggacatctatgggtataaatacaaggccccctaggatgagaggggacacgaacaatagatcaagacataagatcgatatacaagccaacatacgccaagacaagccgccggacatcgacatcagagatatgcctagatcgaccctatctggtacctacagaggccagccgtagggatctagcgctgtctctgatctcgctgggtacgaactcgagaaggaagaataccctgttgtcgactacgagtcagaacttcagaccgccaagtcgacaacagttagataggctaccccaaatattgtactggtgtgattatggtgaataagaccaataccgggcttcggccaacaggatgtaggattattacctgacaattcaagggcccgaacctgtataaaaatctgcgtctccatctcttttactacaatctcgcatatatcctagtaccaacgatccccatactatgcaaacaccggaatcgcgacatcaaacatcgacaacttggtggcctacaagagttggtagaaatgacacataagatataatatgatatagtagtaaaaatatagctaatatagcagtggaattggtgatttaattaaaacaatctacagctgctaaagtgtatgcgtagatcgtctataaaaataattgtttatttacaacaccaaatcacttgtattgtaaattaaattcctagcgtttgcacgttcacactcagattactctctatgaaaaaaaccgatctaataatttatgataataaattatggtgtacatgtatcatgtaatttggaaaaaaaaaggagaattaggatctggatggcatcaatcgagctcaccgaggcagatcagtctccatgaaaatgatcacaaattatgatgcacatgtattttgtaattagtacgaagggtaccgagctggattgccaa

SEQ ID NO: 22058 - DNA, 1021 bp, Oryza sativa
  unsure (1)..(1021): unsure at all n locations
cagcttgattgacttatcttaatnnnnnnnnnnnnnnnnnnnnnnnnnnnnnnnnnnnacagaaatggactacagaaaataattcaaaggaatatgggaatatgatttcactggctatgcagcgatttctgcgggttactaagttatattgatataatcaacagagcagttgacccattggagaaaatgacggataggtagcaagtttgtcaagttaagctggcaagcagcaatgtactgatgcaatttgtcgattcaaatagataaaccaattacactcaacttgctagttttacactctacaggaagatgggaacagttctagaaaaatcaaaagaaatactactatcatacaatgcttagtgtgcgaaatctcttttggaacaagatggttcaatctaaacagcacagtttaattttgatgaatgtattatggccatattatatcatcacaaaataaatccagaattacaaacaggaaaaaatgccatacctttaagggagctgccactgtcatgaagccatgatttcaggtctaatgggcatagtgctatgtcattgcagagctggcggagcctcagaatgaaataaagcacagttgagtaattacgcaaaatcgaatccctgtcaccaaactcccgcagtttggttttcctttcaattccatctggtcatagtactcacgttcctctgcagaaagcttatataacaagctaaaacagtttgggcggaatgctgaccaagcttttgctaccactctctgtctctttggttctgcgcagggaaatagcacctaggaggctctgtaataagcagataatgaaaggaaaaatttttaaaattttaattttccaagttgccaannaatctcgcaggtatgcacgtgaattttttagatcctttccaacaccattattaaagtactacctaagtatagctactagttcatgtgaattgggaattacaaaaaaatgacatgtaatgacaaggcaaacaattttccaaacttacctgcaatcgc

SEQ ID NO: 22059 - DNA, 1806 bp, Oryza sativa
  unsure (1)..(1806): unsure at all n locations
cacgattgattagatgaataacaatgcnnnnnnnnnnnnnnnnnnnnnnnnnnnnnnnnnntagtatacgatcactactccataaaaacgggaagtaagataaatcaatcaaacacacttgttatttcatacttaattatcatcaatattgatcgggaactctccgagagcaataattcctagctaatttggtgtacgaacaacaactaattatgctgatttatagccaaatttcaacaaagtggtaaaaagggcacatcaaatttttttatatttcaaaaaggtgttattacactacaatcactactccataaaaaaggcaagataaatcaatcgagcgcttcatacttatcatcaatgactatctctgataaataactcactaagtacgtgaatttctaatttgctacggagacaacaactagccaagtaatagccgatatgtagcaaattccgataagtggtaaagttgtgcactaagaagaaagtagcaaatatattctatttatgtaactacatcgtttcttctcgattttatctcaaacaggtaatgagaaattaccatagtacaatcactaatcacgaaaaagacaagtatgagaaaccaatcaaacacatccagcgtcttatacttatcatcaatgactatcttcgaccgttaactctctttcaacaaaaattcctaatttgcaacacagacagcaactagccaaaacaatacccgatatgtagcggattccgacaagtggtaaagttacgcactaacgagaaagtaaagcaaatatattccatttacatagctacattgttccttctcaatctctccctctctcccctacagttcccctcacttccaccagtggtttccccacaacacaagcagttcaaactccaataatccgtgtgtgcccatagcaatttcgtttgtaggctaagctcaagttagagcaatgggccttggcggcgcgagaagtctcagcgattggcttaatttcaagttagtctaaaccaaaagatctatcttgtgcgtgtgtagcttatttcttttgtacagttattctttctatattcaatgaaattagcggctcaccgattcgcttaaaaaaaatagctagagcaagtaagaaaaacacattcccataccggcacggtaaattgctccggccacacgggaggtgatacagctgatcggctggagcaaagcaggatgagattgcggctcgtaatctgcgagcaatcgcaagttcgcacccacccccaccacaatctctctctctcggttggcaatttggcgtgtcccctctttctctttctctctcctctacctctcggcgtggtggtggtgagcgagagggattgggatagataggcacgcccagggtaggggggacgacgagacgagggatcaatcagaatttagtcacgcacccaggaacaccaagaaaaagaaaaggaaaaaccttttctttctttcttcactttggttgcgttgcgtctccaatccagcgtgcgttgagtagatagatggtaatgccgcccacgaatccgtggcgagttcttgcgtcgcagagtggcaatctgtaggagtttctctgggggtttgttttttttttttttaacggaagaacagaatcaaatcgaatcgggtncagagtcggatatncaaagtctacacaccgggnnnnnntgntgnggtgntnggaagagaaaacggcatacacagtatagagaagactagagaaaatgaatatatggaagggagatctaaattaaaatatttgacaccataaccggcgtaaaaaataa

SEQ ID NO: 22060 - DNA, 726 bp, Oryza sativa
cccttgtcgtactaattatgttttaccatgttgatgcagtcgaaggcgacgttgctcgagctgctccggcgactgcagcagctggagctcacggtggacaccttgacggtgagaccgccgccgccgccgccgcagccatgccaaaccaagctcatgtgttgactagtgtgttcatgcggattcgtctttgcaggttaccgagattgggaaggcggtgagcagctaccggaagcacaactccaagcagattcgtcaccttgttcgattgctcatcgagtatggccatgtgttcccatctcgtcttggattgttcatattcaaatcgaatttgtttttcttagccagttgcattcgttgacatgtttgtttgcgaatcgaatgcagaggttggaagcgcatagtcgatgagtggatgagcagccgcgacgccattgtaggtaggaagcaagcaagaacagttcatcgtttctaagtttcaacctctgtatcatgatttagtagagaattaagcattctgcaatgatatgatacacagatcatactcctcaatccatgcatccctctggcttgaagcaggatgaacgggggctctcttctccttccatggatgagggcgctcttttcgctacgccgagcacttccatccgcctatctgaggtaattggaattgtcggcacatccatccggaatcatatctgggtggtatgttttgacacagctccctct

SEQ ID NO: 22061 - DNA, 835 bp, Oryza sativa
  unsure (1)..(835): unsure at all n locations
nnnnnnnnnnnnnnnnnnnnnnnnnnnnnnnnncatctcnatactngaataaacaaaatacgagaaaggaacnancaaaaatcacccccccccncaaaataacacatgtanntnccnnnnnnnnttnnnnaannnncgggnngggggggggggggggggnnnnnnnnnnnnnnnnnnnnnnnnnnnnnnnnnnngnnnngnnnngngggggggggggggggannnncnnnngnnnggggcnnnnnannggngngaannngnngggcgggggngggggggggcccggggggggagaaggggggggagaaaaaaaaaaaaaaaaagaaaaaaaaaaaaaaagaaaaaaagagaaaagaaaaaaaaaggaaaaagaaaaaaaaaaaaaaaaagcagagaaaaggagaaaaaaaaaagacaaaaaaaaaacaaaaaaaaaaaaaaaaaaaagaaaaaaagaaaaaggaaaaacacaagaaagaaaaaacaaaaacaaaagaaagaaagaaaaagcggaaaaaaaaaaaaaaaaacaaaaagaaaaaaaaagaaaaaaaaaaaaaaaaaaaaaaaaaaaaaaaaaaaaaaaaaaagaaaaaaaaaaaagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22062 - DNA, 5012 bp, Oryza sativa
  unsure (1)..(5012): unsure at all n locations
gtaatccgttgagagtagatgactgtaattntttattgncggcgtcntctcgtttttnnttctttnntattttactcgctctttcttttgatgctgtcttacattccccccccnccccaaatgtgtttgcatatccngttgcccgcaggncgactctagaggatccccatgatccagaccagagctggaagcaagaacaatctgcgatgaggcagtcgagaccacaggaactgagcaatgggcagacgagagagcaattcatcgcggcgatgcttgcaaggccctcaaacccagagtccggtcctgggcgacctcaaccgaggactaagcagcatcaagatgcctcgccagctcaaggcagatcgcaacctatgccatctgatgtgagcatattgctttatcgacaaaatatacatgcttatttgattgatgcaaatgcttgtttgaggtcttaattctttgccatggctgtagaaatcggcgagccatcacgatgaaaattcagttcgggcaaagctagaactcgcgaagaatgcaaagcttgaactcacgaatagtgcaaagctagaggtgacaaagagaaaacttcaggaaggctaccaagaatttgataacggtatgtgttccgccatgaaattgggtctattatcacttgttgcaacatcaactggatcatggaatttgtttacttgaaccacaatatcttgtcctctgtttggaatattatagtactactactattttttgctgatcagtaaatttcattgatttgagtttctatatgcgacgagtcatggttatatttttgtgtaaatgcagcaaagaagcagagaactatacaaatggtggatccacaaaatttgccgaaacaagcgaaccggaattggcagcctaatggcaggccgaggaataacagcaacttcaacaacaaccggaattggtcaagatgaggcaccaattccatcatccagcaccaagggatcatagactcccatctcccaattccatccaaatttttctttttttttcggctaaagttagtccagccaagtacataaacagcaataaggctttccttcaaaacttgctttcagtgccacacacacacaccacaaacacttcttgagagctgtgttgctggtttgcactctcttttaaccttttgatcacgatggctggtttttttttcctagtggtttgtcaaaaaaacttgtaaagatagtgctactgccaatccgagatgagtttctgcaataccgatcctgatcttgagcccctaaatttgctgtttgtgttggtgtttcctcggttgaaatgcaaattgctttctaccctgccatcggaatgaggatgtttgctgcctactttgggtctctgcgccctgcttttcaggctcaaagaccttttggggtctgtcttttcgctgaattcagcgtagcttgtcccccctgcgaagacttggactggaacgccaacgtatcagactgtacatagcctcaagtgaaagtttcttggtaaattcaaaattctagttgatgccaggaaaaattaactatgaagttacctatggtcaagatcacactgtcaaaaatagtaggaccatactctccgtaagtctttttgtcttgttaaaaataaaaaataatttattgatttttttaatacatttgttcatagcgatttaaaagtcaatactgaaaacaaattacgttgaaaatatcttaaaattaacttcgaaaattcaaattttagcttttgctttgtcttattaggccaattgatgcggccctaaaatggttgaatatccaaaagattttgtaatgaccattcgagggcacttccttcgtactcgtaaaggaagtcgtctagaacaatatttaagctaaactttgggaatataaatcatgaataactattaggttgtcgagtttgaaaatataaaatttatataaatagatttgtcttgaaaaatactttcataaaaatatacatatataactttttaataaatatttttatagaaacaataagtcaaaattctgttgtgtccataacgactttctttacgagtacgaagggagtacaaataaatgaatcaataattataaagttgatataaaaaaattgacaagaaatttatacatggaaagttttttaaaaaatcacaccgtttattagcgcgggagtacctttgtgctgcttcttggaacttggaaggaaacttgagttccaccctttgggagttggggtccaaatgaatgaccttggacggctgaatttcggtggatagaagtcaatccggtccattcttgtggatggattccaaattcaagttcagagtaagaatgagcaggctttgtgtgaacactataaactatttttgcggctgttttgaccccccaaaaaataaatccaaacagatcatattcattcatttcattcatcggccatgattcactcatgcagcagttgtgctgttgcttcgaggagcttgctctacttgcgttagcactgtacgggtgactgccgggtgggccccagttctgcggcggttaggtatgggcccaccgtcagtgtcatgtgtgtaccacgtcggggggtgcgtttaaatatggagggaatggacagcattgggggggctctcttggctgcttcaaagttcgaagcactgcacttgtggcgttgaaagttcccagctatgatcatctgtgttcactatctctgtgtcccatgtgtggccatggaaaaaaatgcatcatcttatacttatcagctaaaatttaaattttcaactttaaatttgaaactgattttggggtttctttcatcgaagtttatttttcagcttttgcttttaaaatgttaaagaacacgtatataaaaattctattcataaattactttttgttcgcaaatataccgtttggcttattcaacgtataaacgaaatgatggtgccgaaagtgtatacacttgagcatatttgcatttatggagtacttgaaatctttcttaaaagttttttaaaaaagggagagtagtactggtacatttccattgcaattaatgaaagatctgatatattctctcccttcaggttcagcatatgcggcattttattgttcttttttcttccgaagcatttttgttgacgttgctcgatttaaatgccgaacgatttcttgaatatttcaactatagtagcatattgttgcggctgcaacttctctgcagccgctagaagatggttgtcgcaaaatagctgaagcaaacaacaaacccactatagtattagtacttgctccgtttaaaaatataataatttttatacgattacacgagtattaaaaagagtaaaaatacttatttgctttcttgaaacggcgaggtgtatgaccggactataataaagtcaaagaatagtacgtgtagtatgggtaatttagtggcaaaaataacatttacatcttgttatatttagaataaaatctgttttttttaaaagaaaagtttattatattttgaaaccgaggaaggaatatactgtactaatagtatgcataaattgatcatcatatatatttatgcaccaagactaaggataattaaatcatatcaattaaaacatcatgcacatattcttccacaatacatgcatcgattaaaacactatgctaattgtatcttagcatgcacatattctcccatcatgtattaattgtattttgataaaatctttgtccattcagttatatgacgatcaattggagaaattttaaattttattatgtaatgattaatttgggaagaacggagtattatgcttgccagaaagtaaacttttcgcagccagccgggcaccgaagagattgagatcctgcaggtcaggtcaatatcttcagctcgtgacggcggagcagaacgcactagttttgataatgatatcgtgttggaaacaccacacggctacgccaaacacaaacaaaaacaaaaaacaaaaatcaaatgacgctcgtttttcgccgcctaatgacgggatttgattttcttctcactttaattaacatagacgatacgcaatcgcatctagttaagaaaatgcatcggatgctgattgctgtcgctttcctttcggttttctgtttcgtgttttttcttggacgaaaaaagaaaattgcccttgttttttagtaacgggtgttctgctctaacaatccagctgatttttatatcacgacagctcgagtgagaactaaagctggacacggattggagaagaagcaaccgattataatcatatagaccaaaataatcgttagtttcatgtcgaaatcacacccaagtaataatatgttgggtcttcaattaaaaaaaagtttcaaaatgatacatgtcgctttgttggactgaagtgtactgtaaactagtgctactagtatttgatcctaattaaactggagaggcgaattctagtggcattttgggtctgattagttgccggtaacaacttgctacaatctgtcatgtcctatgttaatcaagtttaacgcatagaagcccttaattagtttgaaaaatataaaaaaaattggggatttcaatcctataaaaaaatctatgaaattctatgtgtcttttaaaattatatgaaataatttgatagagattttggaggaaaatttacatgaggtcaaacctcatgggaaatttttcttgagtctctcatctgattcatgcgtttatttgtcttcaatgaaacaatcttccttgtgtttttaatcatatcttttacacttgtatttctatcaaaattctatgtttttttatctattcctcagttttttatttttgcgattcaaaggacccttagagaaatatacctggttacaacatacaccattcatccaaaaagaataatgccaactatatacggagtacaaagacatgcctaacagtacaaagacaaatacatgcctaacttcatagctagaagcacttagacttgtgttcgg

SEQ ID NO: 22063 - DNA, 8119 bp, Oryza sativa
  unsure (1)..(8119): unsure at all n locations
taaagcgtttgaccaaagcggaggggtattcgccgatgtgagaaacggaaagcgaaggtgagtaagatcctcctccccggcacgcaaaacaaagcacctattattatatactccctccatctacttttgatagtcatatttcatcttggcacacagaccaaggataagtaattctacttatcatccatttaaatatgctactagtcattcctcgtaaacaaacgattcattaatatttacatttctcaatgcccatgtagccaatcatgtgtggaagaatgaagagtcatgcattaaatccaagaaagtcattaagatgataagttgttggattgaaatatgtctatcaaaaataaaattttcagatttggaaatatgactatcaaaagtagatggagggagtaattaattaagtatttactattttttttaaaaaatagattaatatgattttttaagtaactttcgtatagaatttttttttttgcaaaaaaacgcaccgtttagcagtttgaaaagcgtgcacgcgaaaaacgagggagggaggttgggaacccctggtaacgaacggagcattagttgtgacaagatcccgttccaataaactgagggcccctttgaatcaaaggaatttcataggattgaaatcctataggaaattttcctatgtagctctttgattcaaatgattgaagtttttcaaatcctacaaaattcctatggaatggcttattgcatataggttttgaagggaacttagcaagaggtcaacctcttggtaagaattctttgagtctatctctttcattcgattcttgtgcttttcctgtgatccaatcaaacgatcattcctgtgttttgcatccactgttttacacttacattcctgtcagaatcctatatttgttctgtttctccgttttttcattcctacgattcaaagggctctgattgtgggaaatatgtggcgagatgtttgatatgacaaatttgataaaattttattgataaataattactacaggtccttctatctcttaacaaaattcagagttaagagcataggaggaagacaagaacaagtcggcaggaggcggacagcagcatgtcggcggacggggttggttggttagccaccggccgatggagtggacggctgcgatcatgtcaccttccaacggcgacagctctgacacccatgtctgtcttcggttacaatttgtttgcaaaaccacgagcatttgaaaattttggagtggatctcgcaatgacaaaacaggtctcgttaatagtataatgttgctgcaattgcagtataaaactacagtatcctcagatgacaaagagtagtagtttaatgtctttgataatcatctttgtccgtccttaagcatgttgaatttgtctgtgattaacttcgttgtaaagtgattccaaactgactgattaactcaaatgtactagacgagagagtgaatggaagagagaattgctagtatcacatgcatgatggagtatattacgtctgcatcatcgctggtccctgagagttagttgatgaaccatgcatcagtgcaccgtgtttcttaatttccttgatcactttacaggtgtagagagattcagaacaatgatactagggctggatgattaaatttcccttgggcggttagaacacggaatcagatcaaacgagaaaagcaattaaggctaagttctttagttgagttttccaactcacattgattttgattaggatctactccaacttaattacaaagttgattttgattttttttcattgtaatttatttatagtattaacttttgagtaaataaaaacacatatataaaaaaattacacataaattatttttatcattaataagtataacgggttttaagttataattagctgtatacgaaatagaaaagttgttagttctatgcttagtagtgaatctagctcccgggctgactgggtggtcatctgaacttcatcgcagacgttgctactattgaacattaggggcggagacacgagtagggcagctagggctgtagcactagtcctgatcctaaatatttattgaaattttattttaaatttttaaaaactagaagataaaggtaaaactttatacattcaactaattgagccctaggtttgaaaaaattctggctccaccactgttgaacataaaacacacctcgacaaattaaccaacaaccaaatatacgctcttcgtcgtcttagttccatgagacatctttggcttcattgttgactctacttacatataagtagtaatctatccatcccattttaagcgcaaatataagttttcgtgtccaactttgatcgtctgtcttatttaaatttttttatgagtaggactttattgttatcagatgataatatgaatagtaatttatacgtgacttatattttaaatttttttaaatttctatggactaatgtttagccctcaccttttagcctcaaattaaccctcaggatccaaacaagtgggataattttgagctaatatgaattagcccccctcaaaacattagcccctccaaagggtgctataggggctaattttgtgtgggaccataaaaaagcaactgtctctccttctctctcctctctttttaccctttccaccttttagccttgaattagcccatggatccaaacataccaccctagactaatgtttagcctaccaattcatgactaaacattagctctcaaaattagccctgagctaatgttccaaacagggccttaattaagctggttgttatgaacctttcaaccgttagatggaagcatgtatagtgggtaggtatcaactagcactgtagcaacactctcacaccacagagtctaggattaaatgaggccatgatcaagtgcttgatcacctctgcgtatacttaactgacctaacacacggtgtggttaactgctgatagtgatacccaaagcgtgaagcataagtaatatgatgaactaattaatccgatatcgatcggtactatatatgtttttcacgcgagattaattgcctcgatgatttttgctatacagcgaacacatgtcttattctagcctgcagatgacaattgagccgaaaatctatgctaaacaggcctggagaatctgagaagcaccggctttcaggactgtttagggagcttaaaattctgaaaagtaactggtggtagccagtttctcagaaactaaaaaaaagctgggttttccagcttctggattctagtttattttctagattctataactatatcttcttaaaatctaaaaaaaataaattatttggaagatcttttgattgaaaaaaactgcaacagttagaaactatcccaaacggacccttgtgcgttttgctaggagaaagtgagaaattcgaaggtgcggatgccatctttttttttttttttgacttggttggctgcaaatgcaactgccagcgctacagtgtagtgcagcaccgatgaatttggcgcctttagccaccaactcaaacacacattatttgcatgcatcggcatgtgatgcaaggggcccctggctggcacgtctatatccatcttctgaattctgatcctttcctgtgtcaacgaagacagtattgttattgtttctgttaatcctagcaagtagatgctattaccaaaccttcacacgtacccacgtactcttcctgtcacataaaaaaaacttccactacatgtttggatttatctttaaaagttaatttttttagacgaaaggtgtacaactttgatttgttgtaacaagtcggatagcgagtttgacttgaatataatcttcacatatatctcatcggtttaggcccatatatatctcataaaaaaattagagattttaaacttataagggaattttctttaaatgtatttgatacaaagaattaaatcctatcattttcgttaaaatttctatagaatgcacgatactatacagattttagacaaaagttagtaaaaactcaaatcatttgaaaatttattctctctcatctgattcatatgtttttctgcgatgtaatcaaatattcgtttttgtatttttcccatgtcttataatcctccttttgatatatacttatattcatattaaaatcccattgtttttttttcttattttccctttttaaaattcaatgtcttaaagaagcaattactgattgtctgatttgttgcctcatcatgtctagatcatgttgaaggcgaatcgatatccaaaatccgccatctataaacgttgctagcttgtgatctcatgagtatctgattaattagcagcagctgtgcaaggattaactatgtggacgacgtagcagcactgatgcgtgatccgtcaaattgcgcgtgaaatcgatgtgaaccacaaggcgcaagagatttttttttcttttctttttttcccagctaaagcagctgtgtccacttgaggatgtgtttagttcacgtcaaaattaaaagtttggttgaaattggaacgatgtgacggaaaagttaaaaatttgtatgtgtaggaaagttttgatgtgataaaaaagttgaaagtttgaagaaaaatttccgaactaattaaactcggcccaaggtgttgccacatcagcggcgcactagctcactgcactgcagtggccgcgagatcccatatctatctcacgatcatctcgccattggagcggaggatttgtggctgcctgaaccggagctgattgctattcgattggatgatccggatcgggttctacagtagatgatcgatttaccgttggatttgttcgatgataatgagtaaaacgagttggtgaattataggatagcagcaacaataagaacaacatcaataacaacagcaagaatttgtacacactccgagacggttacatgggtgggggtacaaagaatgcaataacttggctaaaccgagcggactcctaagggaagggtgaaagaaactaagcaaagctatgtgtcgtgtaaatgttgaatatttgtttgcaaatagttggattagttcttttgccagttcacgcagatatcatcagcttataagagcagatgcgtaagaaactgctgcggaacaagtcatcacagattatcacagtacaacaagagtgtgtccaccaacgcagagcggaaattggagaacctctggatttctcaacccactcccagcatgctttggtaccaatattgtttactactcctgcatatgttctagctgttgacatggtaaaaagacagctacatggtgtgacagagtttggaaccgtcagggaactggccccaaatatcatttgtctccctggtaatgtctctccccaagcataatcaaggtaagcctggaaataatctcagggtaatttacattgtatcatcacttctccagtcagctgcactactgctgctgataagatattagatttaaattttagtcatggctaaccagctgcagataacaattaatagagccgaatatccttaatgaaatcggcagagctcctacctttaccccttggaaaaaaaaataaacagggcctggagaatcagagaaacaatggccttggtgtcttttgctatgagaaagtgagagattagaaggtgcggatgccatcctttttgacttggtcggctgcaaatgcaaactgccagcgttacagtgtagtgcagtgtgcagcaccgatgaatttggcgcctttagccaccaactcaacacacattattttgcgtccatcggcatgtgatgcaaggggcccctggctggcacgtctatatcttctgaaattctgatcctttactgtgctatccatgtccacgacgatactcctactattgtttgtgtttatctgagcgagagcgaacatatgctactactaacaccatcttcatattttttttaagataatggaatgaaatatttcgaactttgctcatcataactacagtcaattattataaacgaagagtatagttcaaaataaaattaaacacacccaacaaaataaaagaccaaaccgagataagaagtacacatttattcaagtctatttgtgaatctccatccatagtttgtaaaaagttgcataactgttgtcacaccccaatctgataccgccgtacaacggcacctgataggagcgtgttgtagggaaaacggcgtgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaccagcagcagcagcagcggaaccaacggtctaacacccaacaccacaggcgacggctgggaaccaggacgaaaccctaatattcacttcactttgccttctcttcagggcggaggaactatatatatatatatttatatagagcaagggtgagtactttcgtactcagcaagtcacgagaacttaggtgtttaatgcaagcttggaagagaggtaaggttgttttgcaaatcttttatttgaagacattttgaaatcactaagtgatttatttctttctaaagtttggccgaaaagagacttgcgtctcgattcgactttaagagatgtttttcaacagctcatttggtaatgtaccgacctcccgggtcagatcattacttatcggctccaagagccattccacttgattaatcggctcccagagcctttttcattttctcggactcccagagtccagctgcctagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaatacaccgacaccacatgtcgggttttgaaggcttcacaaacccatttcccaagttttcgacaaacaatggtgtatgtgggatatttggtatacgtgctcaaagaacacgaataccgaggtcccccaagggtggagcgacaaggattcagggtagtatgacctacgaaaattagtgcgactactgggtaggtccgtcggttttggcacgcaaaccgaggccaagcaagttaagtgtgtgattctaataatgcgagttgcgcccgccgtcgttggtggtttttcctttttgggggcgtttgttccnagggtgncttgccttgctcngggtcttcccccagcttcccgtttcttcgnggtttcccgcggtcgtcgantttccgttgtccgcntctttgcgcntccgtcgnccgcttttctnaggggtcctctaggtcgnctgcggcgcttgcaggcaatcaantccttggggttttggaggngnnatatgttccctcttcatttcattttattgcgccttgattaaccccacattgaaccccattatatcca

SEQ ID NO: 22064 - DNA, 1002 bp, Oryza sativa
  unsure (1)..(1002): unsure at all n locations
tagaggatccccgtacgaaagggcccagcccattgctctgtcgggctctcggcccatgatactcctaatttctctctgggtccccgcttcgataaggcccatataaagccttgaatagaagaatcgagcccatggacacacggctccggctcgtcacgcccaatcgcattcgcatcgtgattattctctctcttcctggtcacactcacgccaccgccacggtctaagattccaccggcatctttgcccttgataacaccgaaagttttcccggtttccgcagagccgagccgagccgcgccgtgggcgtttccgccgccgaagctttggtcatgcagcgcgaggagattggcggcaaaaccgcatccaaccgtccatgtccccggggacggagctcctttaacgtaaagtgaaagagccccacttttctctaagggtctgtttggtacagttccaactcctaaatataattttaagagttaaatttagagtggagttgggactgtaccaaaccgacccatagagaaaaggggggctccttcactttacgttaggggggccccggccccggggacatggacggatggatgcggttntcctgattactcattgtacccacttattatttactcccctaactatatctttcttccttttttacactcctacccccttctctattttacctggattctaaacaaaaaaacttctagctagttgccatactcctgacgtcatcccctaaattcaatcttatctggggcgttgactattacctttcgacagtatgagggttcgatctaagctatcattgaagcaaaggtagcaagggacgtatcggtcttcccctgcatacttaagtatctaacttaagctttcgtccgttctctaagtatcctaaacaacccaacgcaccataggatcggcaaacttattctttctgcgcgaaatctaccgtaccgtaaatagtccacacatacctttatgttctcgctccctaca

SEQ ID NO: 22065 - DNA, 14404 bp, Oryza sativa
gtcttgtagtgctctcatagtacaataatgtgtatgagccccatcggttggcctaataagccaaagcaaaagcatatatttgaattttcaaacttgaatttgaagttgattttaagatattttcaacgtaatttctttttagcattggtttttaagttgctaggaacaaatatataaaagttttacctataaattaacttttattccctaataagggaatatgggcaaccaatgaggctctcatgacctctatcggcagcatgctatagcaccgttgtttatggctaccatgtacgaagtagtaattactctctccgtttcacaatataagtcattttagcatttcccatattcatattgatgttaatgaatctagacatatatctatctagattcattaacatcaatgtgggaaatgctagaagacttacattgtgaaacagaggaagtacttgtgagtgctacagttaggaattgatcgaatacttggtggtggtgttgctgaagaaccgggaaccacacgtgcttcctcgtttaggctgctttcttctggtagttcaatatttagaatgcttgctgttgctagctattggttgaacgttgagtgggaaaatgatctattatgatgatttttgttcatccaatattctgtatgttcctgatagttatgctgatactgttgctgtcagtatatgatataaattatgttttaccattgctctaataatctttgcatctggaattccaggtaccttctcttcagagagcatgacatcttgggcacccttgtggactgatttggatcgtcatgaacgccatcagtaatcagttgcgctaatgcaaggcatgtttttttagtattggatcgacgggacacaatcctccagacacaactgtcttttatgatgtcgtagaattttggctaagaacatcatgaacttgcaaaagattgttgcttccttttatctgttgcgatgaaattcagtaaacgttaacgcatctgaagagcctcttcctttttaatctgctctgtcttctatgcatgtttgtgttctctgtgtgctggttggatatgtgtcgctgtgacccgagcttaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggcctgtgaagttcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaaatctttgagcagcatctaggttcagctctttgtaaacctggcacagagaacaatatcgtgagatctcaaggcagttttgcgtggtggtggttattgaagtgatggctgggagtcaagtccatacaagtttcttatgggcttcttcaaatgtcttgcagaacaactctgcctttgttgctccaacctgagacagtaaccaataacatattagtgcgcaatcagatcggcctgtttcaaggagagatgccactgagcactcaacagcgccattccctcttaaccaacaaaatatgtaccatacagcctcaaaaaacagtgcatgtaggatgtagcttacagatgtactatttatatttaccagctttaattgatggacacctcaaatttttcaaaaaaaaaaaaatccaggacagccatgctcacgatcattttgccaaatatttaaaatctcttaccaaagttcttaaccgcataacagcagacttttatgacaaatcgcatccaaggagatctttgatttattccttactggtttacttattcatataaccgacacatgatattaaacaatctttttgaaacttccatattatactgagcaggtagttttgtgaaacaaagtgaaatatataaagaggaaatcccacctttttctcagcaaccatcttcaattttttcatgaattgatctgagaaacatgcaagaaaattcatcaatatcagtatatgtaagctggtattctttattgaagggcagcatatgagaaatacatctacaactgcaaccaaagtcttcatccccttatgcactgttcatgcaagtcccacaggaagtaactgacctcaactcaagtcatattacaaatatcaccaagctactgcactagagaatatatttgtctattctaaaaaaatcaatactaccttcatccccaaatgtagctattgtccaggtgcatagctagaaatagctacaatttgtgacagaggtagtattattttccaatcttcatctccacaactattttgaagatctattccttatgatattcaaaactgcacattgctcagaacacagcctttccttatcatttcagtgagatacatctatagacttctcccatgagagggacttgtgctgcaagtatctcatcaatttctacaaccttgtgccaaagtgtacttaagtttgaaggccacaaaaaagatcagtttgtgcgagtgtctatttcaactctttgagtgttctggttctcaattgaatactggtaactcagactgttgttacagctcagtttagccatccaggaaatcaagcttccatatctactccctattaatctagtttggttatacacagcttcagttgttcaagtcaagaacaagaaaatcctaaatggggaattcaatacctacctgacccaattcataaagagtgatcaaatgatttctggacctcaaattgaagagaaattgatatgtgctgtgaataggagtccagcaacatgccaagttgatcattaatatggaattaagtcccatggaagtcatgagtatgtcatgtctaaccatggagaatgaggattgtggtgtgaaatgacaaacccagggcctcagaataaaggcccaaggctagttagcaattggaagaagtgaataagttccccatgggattcacatgaacagggatgaagcaggaagagcaaactttatggtagtgacacaggacgtcattccagcataagaatataaagttaaatgggtattgcaggtttagttttctgctgtaataattggtaagataagattaaaagcagagcaatcaaatatttatcgataagccttcagtaccagatgactcatttttgttgccccttgttgcctcctgcaaacaatagctttgttagaaataattacaaaatacaactaggtagcatttagatagttaaattagttcatacacacctgagcccgtgattgctgtgtgctgcctttgcttgatgcccctgattcagcctacatccggcgaaaaaaatttcatcagttcatgaccatatcacgagatcgtcaaacaggaaaacaagcactgaccatatttacttcagatcattcttcattgaagcattgcccattgatgtttccatttaaatttacttattattgcagcaaacattgttaccgttcaacccagttttctatttatgaaaatgagctctaccatctagttctctctcaaccatagcctccaactcaatgttatgcagagagaaacacaaacatgcttgcaaatagcctgttaaaagttattcctaatattaacctacacacttcaaggggctaaaattagtgtcactaaaaatagcctgaccacataaatggcatgggaaacacaattgcatggctctgtaattgaagtagcatggttatattgagatatgaccaacttagtgtatctctagcttttagaaccatctgaagtacagaaataaaaatcctacagctctacatcttcaaaagaaaattccagatgtactgcattctagcatccttatattgttaaagaaaaaaaaagagttttcctctctctatctcattttaactaacatcactcaggcaattaccagtgcactatcatctctacaacttctactgcgcaaacaactcaggctagaagacaggttcatgacgcaattcgacggatcagtataaccaaagtgagattatctcaacataatgcgtaatccagtctccacgcacatcagcccaaggccacaaatcaacagccacccaaatcaaccaacccatgccctaaaatcgagacccctcttgctcccccaactcaagcacctgaactgctagatcgccgccgaaacgccgattcgcccccgccctacacgtgctggaaacgagagagtagggtatgagaaagggggggaggggaggggatggaaattacgcagtagtcgcgagatcggacgacggggaagagctcgagcatccgccggaactccctctcgtccatggcgccgcgcgccgccgctactccggcgatgagctccgcctccgcccgcgctcgtagggttcgatccgattcgagcgagctcctcctctcccgattcgttgctctctcgctctcgaagcctcgaactcgctggagacgagacgagacgacgacggcgagtccaacccagacggagccgacgtctacgcggcgcagtcgcttgctggattatcgggtccaactctgtttcagattccggcccaaaataaacctctcaggtcttgggcctcttctgggctaggcccagaaaggacacaataaaatgggcacgaaaccaagcttaagtacagatgaatttttttcatttttaattttaatttttttaatatttacataaatattataccatccaaaatatttacacaaatggcccctgccgcccaagtggagggcggcaaggtgtgcgcattttacacttaggtcccttgccgcccttgtaccctctacaagggctgcaagggggtaaatacaattttcgccctgccaaaaatgcatttttctagtttttttttcaacttgtctgtccctcacgtcaccctgccgagggcagtagggtctatttctgtaaatattttcgctggtgcaatatttctataaatattaaaaaataaaaatttaaaaatgaaaaaaaaaattcaagtaccgatattgcgggagcaggaaccatcgacgtgctcaatgcccacttggtttattccatgagtttctgagacaatatttatttactactccctctgtttctaaatatttgacagcgttgactttttagcacatgtttgaccgttcatcttattaaaaaaacttttgtaaaatatgtaaaactatatgtatacataaaagtatatttaacagtaaatcaaatgatatgaaaagaattaataattatttaaaatttttgaataagacaaacggttaaacatgtttaaaaaagtcaacggtgtcaaatatttagaaacgaagggagtaagttatttgtgtcgaagcacaccatacacatttggcaactggcataaaggctagttcccctcctccatggaagagcagaggcagtgaagtgggccaagaagaagctgcataagagggagagagagttcgcaggaatctggaggctaaggagagagagttggtgaggaaattcttgcataagagggaggttgataacgaactaccctgagttcttgcacgagtttagggttgaggactgttgaatcattcgtcgagaagtaggaacaggagaagtagataagtcaggtggtggcgctggagacctcgggcggcggccggattcggcgttgcaggtctagtgtcagtgctcatgggagctggcggcggtgcgtcgtcttccttgttgccagtcagcaccctctcccttcttgaactcctccccttctttgtggggagtttcggttgggttgaggcggctgctggtcagcaggggaagctcaggcggccgaagtgacactgtccagtccggattctcctttggtcgaacttggcgaggaggccggcgggtggcgggacggaggtggcctgggccagctctcaggggaggagcggtgggatgcagcgagctggcggcagggttctgcggcaagttcagaagtcaaccagcagagaggcgctggtgcggtcttggtggaagccacgcgctgccaatgcttgtgtggtggttactgagttggtgggcgacaaactacttgagaggttctaggggttccaggcgaaagcctcactcggtgatcaccgggccggcaacggctacaccttcgagtgtcgtaaccctcttgggggcgctgtcgtgggtacctctccccctttcttggcgagttctctttgggtggaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggtttgtgcttgtgtggttagcgtgtggttcttggaggtgccttgtgcacgtccgtacttgacaacttctgtcgtgtttttctttgtaactttactcctccttaatatactcggatggcctccttcggcctttcccggtgaaaaaaagataagtcaggtgagatcttgttcatcctttttatcaattcattacccctgaggccctgaattaacaatcagtgttgtccatttgtcattgtaatttggtttcttgaaacctttgaagtctgaactcccttttgcatttgcaggagttccttgctggtatccgcatgactttggacttatttcaaactgtgggaactgaaaacaaatatagactccaggcctctcggaagtgatgatgagagctgctctcctacacaccatgaaaattatccacctcaatgtctcaatctcattgttcgtgctgtatgaatctagtaatgagctggcttttcagcatattctgtggtccaattctagtcacatttgagaaaatcaccaggcacgctcattggtgctattgcgcactaccatttgttgtgggatacagacaattcgtatgcggttggttgtattgcaattgctcgcctattcatttttttttaacaatataaatagatctcctgttctgcttattttgaattgctatgggttgtattgtcgctggtagtggcttgtgtctgacgatagcctgattttctggtaaggccactcgagcaatcttctttcccgatcagatcaggcagtggacggctcagatcgatctgtaccgtatgaactatgcataattggcgaatacttcacattctttcttgatcagatcaggcggtggacgtctcagatcgatctgtagcatatgaactagtatgcgtaattggcgaatacatttcgttggcggaggaggtcaagtcgtggcgaacgaccactctctgcaacaaactctattttccggtttcatgaaaatggagcagtgggcttcccctgctatttctggattatttttttaataatggaatagataacatcccggtctttactcaacagagttacagccaattgttacaatctaatactcgaacaaagaggaaaaaaatatttttgaaacagaattatagatgaaatcaagatcaacaccaggctccaaagacaactctctaaacgatcaaatagagtccaagagagcataaacatatccattcaaggcaaatttaaaatgcagtcatgcccaataaccaaaatacataacggggcatgcttttcaacagctagctctaattaatttatgcccgggcatgattttcaacagctcaaattaatttatactcccttcattctaaattgatctacatatttcataggtacactaagaccaagaaaaattaataattctctcatgttatatttactctagcaacaaactcaatgcatgcaccatccccaatatttcctagccaatagcaaatcaagatattgcatatgggttataaatacttgtgtgtatggatgcatgcatcaatgtccatttactccaatacacaaataacgaatagactctactaaatgaacacaaatatgtagatcatttaggaataaacttaaaaactatatgtaaatcaatttggaatggagggagtaataatttatgctcgggcatgattctcaacagctctaattattttatgcccatttagtttcactccaaaggggcatgcatggctattccaagtccataggattatcgctgtcttcagtttcgtctttagttcccaaaccaaatccaatatccagttgcaatggctcatgcaagtccataggattatcgctcctgctgattgtttcacccagccgcttgtgaggatattgcgcatgaaatttcaaaggtctcttcaggtttccctttacacctgcacccagtaaaacagcaaaacaaagggcccatgagttagtgcatatagcctacacacaaatgtaggtacatttgtatgagagtgacaaaaagaaaacctacaagagcataaaccaatttagttcaagaatgtttaaaaaatgcaagagcacctaaagtggtcttctctctccccactttgatgggggcagaaatcttgtttctgttttcatttctgacaatttcttttaataaaggctcactttgtttaattatgtgcatgttcttgatatagcgtgcactgacaagaaaattttgatatgaaggcaatctagaatccaaaatgcagttgcatttggctgggtttgtgttccacatagcttgcatttcatgtactctggagtacatcttatctggaactgtactctataacttgtctagaatctcaccaaaggcggcttccataattagaggggtaaagagtctagcgaggttcaaaataattacagcctaaactaacaagtccaactagcactatagcagcagccacacaggtttaaaatatatgagcaatcacaactttgaatcaggtttactgtcatatgcaacacaaagttaccgaaaagaaaagcaataagcagaaagaacaggccaagaattaattaatcacctgcagctgtagtgaaatattgggagatggtagactgcgtgtaggagtaatcaaagtcgtcgacgatcctctcggcgtcatacacagacaccgtttgaagccttttgttggccatgtcaaccgccaacaccaccgccttctcatcagaggcgtcaaccttgcccatgacgtaggcaacattagcatctgtctacctgcagctttgccatggccggtcgaccctccagcttaggcaggagctggacattgcagcaagtggcgtcgaccgtgatgtcactagaatctaccatgaagcccttttgccagcccttgttgtcgcccagatgagccaccggtttgctccatgtggacagatcccaggaccagcaaccagtgtccgaatcaaagcaagtacgcagtctgacaatggtgagaaggccattaacgatggcaatgtcccggcaaagcgatgaggtattgaagctcattggagagttgatgagctctggcggcagtggcaggtgacttccaggacagccatgggcgagcacgttgcagatgtggattaattccccgcttgagatcaatgaaggccacctctccctgcccctcatccagagtaattaccttgttcgtcaaatggaccaggcacagatgtaggataccagcggcggtggggcggtaaaaatggtggccgttgccgagatcggcggcggcggtggtggagttccggcggtcggcgatgtaggcgcggacgtcgaggaggatccatggtagaggctggtgtgcatccagagggtcgcccccatggcagggcgggcgcagagtgaggtgctcggttctactccacctgtaggggaagacggtagccatggctcaggaggcctctcctcccgccggcgatcgtcgtccgcccgcccgggctagcttaagtagagcagagcagaggagtcggagtcggagaggacatctaaatcgatctcagcaatcctatcaagacaagttggaattgacgaaagatggtttggatagaaacggattgccggcctgatcaaacacacagcatagtttacagtcttaactaagcaaagtattttcagagttcagacaaatgcattttcagagtagagaagagtgtattcaggggctcttttttcaacttcaaactttattttttttcgtttttcgttagcatgttttttaaactattagatggggtgtttttttaaaaaaaaattatatataaattgtttaaaaaattaaataaatcgaacttttaagtttataatagttaatacttaattaatcatatgctagtgagttctcttgtttcacacgaactgaaacatcttctccaataggatgaaacgaacgggccaatccactttttttttccaaattacaataacaatatcagcacgcatacaaaacactagagtcgaacgcgcggcaccagtggtgcaagaggggaatttgttgttatttagttatacaaagttaaggaagaagcattatggtagaagagtaatcttgatggaaaattaattaacaatttataatatatatgaccaaacatctttaaagttataggaatttgacatgatgttgtgtgctgtatgaaaaactaatattaagctagtatcaaagatcatgtgctatgaaaaataaataatagtttgaccataattgtatgtggtgctctgaaacaacatgataaggaaaagccatgtgtggtatttaggaagatgaaagagcaagatgtgaagccaggtgattttcagggagatatggttcaaattttaaatctcgggaatcagatggttgttgatggaatgcactgacaaaattctcaaccacccagacctatcacagctactttcactaatcagcacacccctgtgtcccaaacctaacgaagaatgaatcaatagatagttccaattccaccagcaagtatccaagaaaaagatgtatatgtatcccagtttgtaggagatagatctgggatcagagaacctgaaatgcattgccctatcgcttgcatttcagattttctgatggtcagcaccaatgcctgtcgcttgctaaccatcagagattgctaacaaaagagctctatatctatctcagtttggttgcactgcacatttgcattttaatgtatattcccaaaggcttatcagattagccatgaacattgtaccatcatatgataatgctgcatgggacagcatcacctttaaattccttgtacagcatttcattccaaagcttgaatgctttgtttatatagcacctatcttacagagctgaggtactataaaccattttgcaaacaattataaatgaattccaagaaaggaagcaattaaatgaagcaactgtgactttttttgggacaggttggagctgccagatttttactgtgattaaaatgcagcaccaaaggatgatttataacagatgctatattgttgtagaaaataatcaggaaagtgaagctatgttattctagaagataagaaaggaaaattaaggcaaaatagcaccattcaacaggactgactaagatcaaagatctataaagcttatgttgctagacatgaatctaactgggaaaaaacatgtctcccagattagaaacaaacatgtatcccagcttaatacatttctatttttccataacaacagtaatgtaggtcatcccagattagcaacaacagttggctgagagctatctcatgcatatttttatgccatatctttaccctgaaaataaggagcatagcaaagcagtagacatccagagtaataataattaagagttataggattccaaccataagtgcttggtcatagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaggatagtttatgttgtcagtgtttatagtttttgctgaaagcagggataagtattaattaccttgtcctgagtagcagaagatagctcaacagacgatgcaatctgcggaggttctcccttaatttttgtctcagttgttgcctgaccattgaaagaaaatgcaaagttatattacttgtgatgcagtgataaaaatagttattgtgtaagtagcgatgttagaatagaaaccttaggatcatgtgagaatgagatctgtttatcttgagctggcttgggagagactgataggacatagcttttcttgcttggtgctggtgcattagctttgctagttggtgtctgatctgaagcagaactgatagtataccttgttggtgtcgatggactatccattggtaacatactttctgtcgtttgtgcttctatctttgatcctgtactgccttcacttgttgctggtgctagttggagagagctgcttgagtctgctggcataatagctaatgtctgttgtgaactgcttggtgagataggcagtaggccctgcacttcagcattggatgagataatgttgttaacctgtaaggtttcttgatttttcataatagtatcttgtgtgaagctgatgttccagataaaggtttggttgaaaagagctacaatctcatctggaatatattcactgtcaggtggattttggtcaatgagagtctcaaccggtttgcgtacgaggcgttgtgctattctcccaaagaggataaatgtagcttgagcagtatcatcagcagcgatcaacacaaccttgtatctacatgcagaatagaaatagttatagcagttttgataactgtgaaataagcatggaggaaattgtgccagcatattcttaccttggcactggtatgcctacattggagcagctggtgcatttataggtggaaccatatggttttgaggtcttgtagcatatgtcacatgaataataccaccaggagctgttgcttgatatgcctttaatagtcactctgactataaaacgtgctcgctgcaaagaaatatgattttatcatttttgtcaaataagaaaggacaatattgcagtaacaaagcctgaggtggcactgaccgcatgtttgtgtgggttgagagcaaggatttgtgctatggttttttcttctggaatatcctggttaaaccctgtggtagcagttcaacccacttgataggttgaaagtttgcgctaaagctacagaaagaagatatcttaaataataatgtatcgcagggaaaatgtatatgtaaatggatgattgtgtaagcattaaaacaataatataagcttgtggtgtcacctttcttttaactcaagcacttcaggcatatcaaggttaatctaccatttgcatggtgaacttccatttaaagttagtcctgtatataattgtattaataaatatgtactgcagatttacagaaggcatgaaaagattttggtacaaatttatagagatatacctaatcctttt

SEQ ID NO: 22066 - DNA, 1139 bp, Oryza sativa
  unsure (1)..(1139): unsure at all n locations
nagtgtggataatgtaaggtaaaggcagtttataacaaaagaaaatttcagtctatactgtagcttaccttgcatcccaaatctgcattgttcttttcaaagtttctgtgtttcttgattttgggcgtagagtgtctgttgcaccaatttcagttatgacacccataatatctggttaaagagaagatatatgtaaacaataaaccactaatgtataagaagtaaacataggaagacaaaaaagggataaggaggttataccaacatagaaagcatttttgtccacaagagacgggacgtcttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaagcagtgagaaaatagcacatggaaatctagtagtctgttggtgcaccagtgctacagcatatactacatgtgagcccaatatatatactccaagatttatactacattgcatatactacatgtgagcacaaaagccattgcaattagctgatgagggaaagcatgctacacatggagtggtgaagcctgcaataggaaagaacgtccactgtgacaccaagaatgtaggtaaacatagagataaaatatgcagagcggcagcgaggggtaccgagctganatgcaaacaaattctcatc

SEQ ID NO: 22067 - DNA, 2578 bp, Oryza sativa
  unsure (1)..(2578): unsure at all n locations
ggcggcatagataacctttcnnnnnnnnnnnnnnnnnnnnnnnnnnnnnnnnnnnccatgcgtaaagacaggtttcctaaggtatatgccaacctgctcaagtgtttgtccttggctgttgttgatagtcattgcataacaaactcgaactgggaattgtctcctttgtaatgcaaaaggccatttcattttcgatgtgcttagtgtaattcttagtatataaactgtttcaccgatgtttgatccagttagtatagtacattgtaaaattgtttcgcctaaagcaataagtaatagtcttgttccattacaaaggcctattgattggttcaaatttcgtagaagcataacaacactaccttcctttaaaacaagtttgtgtgtaggaaagttagttgctacacctcctagagtctgtgtaggatcaaatgcacaagccacagtatgcatgcatgtttggctacttttgctataagacgtttagaaacactaaaaaccaaattttgggacgcagtaacctcttttcatcatattgcctcatgttaaaatactactgctattatcaaacagagaagaactgtaatatattagtagtttaactctcaaatatatttgtaaaaaaatattacattacacaatgcaaagcaaagtctttgaaaactaaggtcccaactcccaacaatttgctgggtcttcacttttgaggaagacctgtaacatacaaaatactctaagcagggacatacattaagcctaatgcatcagaaaatgttcctttacagtgcactgaacctccctttggtctgacgattaaatcattgtacaaccaatcgtactgtttatacactataagatgtaacaaagctgaacagaaccctatgtatatacaaagcatgagcatcatgaataaataggcatatatgatgaaattgtgggagcatgttctggaaaaacctcacatcatacagctagtataaataaaatatcagcagccaagctccaatattctagaatcattgaatactaatagcacaatacaaaaatcatatcatgcagtaggcatgtttaatgtgaagtaatcaatatcgcactaaagcaaaaaaaaaatgtagtcacagatacccctgaatatagatataagaggtggcttaaaataattgcgtgcaataataatcatggatttgacttaacatcttgcagaatatcataaaaaaagaactaaacttgcaaaaaaggcaaaaaaagacttaatagtttaaaggcacactacccaatttgcagaactatcaagccgcttcaacagtttaacaactgcagcactaatatatcacttacataacagcaaaactgccctgctgaaagctcagaatgagatatgtcactccgaagcaacaacagaaaaagaatgttaaaaggagtttatatataaaaacaaatgcctaattaaagtgcaaaattagtccatttggaagccttcacagcaaactgaatttctgtcaactcgctgaataaatatcttgcactatataaaatagatatattttgtttcaaaagggaaaatatgtcttgcaaggaaccctggcactctcccactctcctagccatcatataaactccatcatacatgagtatattttccatgttccaaatcactgggtgtttatttagatctcaatttaatttgtgaaaagcgagaacaggcaagaagcaaaacttttgctttgaggtcgcagtgcgcggattgattacttgtattttttttaccagagataaacaatatttaataatagaggttatatctttaaaacttcatatggcaagcttgtcttaaagataattactaacttttcccaaaaaaaaaatcagaggtaatgtgcaaaagttgtgcagccatgtaggattaaaacgccaaatgcatattttacaaactatcgaatgatagttttaattttactctagataaagggaggtagagttagaatctagaagcatgcagagctagaagcaggacaaaacgaggcatcaatagcaaacatatttagatggaaagaggaagttttacaataatagctccaaagcaagaaaagatgacatctggaagaacaaagcaaaaacctagctgactttgatagaaaacatgaggcagaggaaagcaacattcttatgggcagcaagggacaaaatattaggaaagagagtatgcaagaagtgtatgcactgtgcaacggctacaaaaggtactgcagtgaccattatgactgcaatggcttacgaaaccgagaacacgcatgtaccaagcgctaagtgtcacaggtaagctatcaatatagtaacaaacaaagcaccataaatgcacaatatcaaaaagaagcagaaaatagtgcaaaatagtaatcaataaaccgaaaaggaaatattgaaacatagtacaagacagatgggaatnnnnnntggtaggtacgagaggacacaatgtgggggggggttaaggttaacacaaagaggtgtaagataagagacccaattagcctttaaggcgctagtcacacaattcacatgaacaacagagacgcattga

SEQ ID NO: 22068 - DNA, 1913 bp, Oryza sativa
cgcggaggacgagcagccacgtgacggcgaggagggccgcccacaccagcgcgttggtgccccgctccgcgtagtcgcggaggaaggcggcgcccccgcacgcggcggcgtgggggccgcccccgctgaggagcgcgcccaggagggtgtacggaacgtggtgctcgcagggggaggccatggcaagggggtggtttgccgacgaaggcggtgacgaagacggcgagcggcgcggcggtggtcggagcagcgcgagctggagctctctgcgtgcagtaataaagaggagaagaggagaggagagatggaacattcgcctacggctccctggagaaaaagatctgcgcaccacaggcctcagacctggtaatacttctcatctggtccaactactccctccattttaaaatataaggcacaaccatccttaactcaaaaatcaagaaataattattattatcttatagtttgaatcatcctaataatataatacatgcattcaatagaattagataacatgggagtggaggatttaaaaggtaataatttaatggaaaagataccataattaattgtatgccttttatcatggaacatctaagaaaagtggttgtttcttatattacagaatggagggagtatttttaattgcaaatctatccctaagcaaaaatgaaacagaggattaacaaattactactcccttcgtttcacaatgtaagactttttagcactgctcacatgcatatagatgttaatgaatccaaacacatacatatgtctagattcattaacatctaaatgaatgtgggcagtgctagaaagtcttacattgtgaaacagaggaagtattacttagtaattagtaattattagctaaaaattaagaaaatggttaatatgatttttcagacacagcgttgctatcaaattttgcaaaaaaaaaatatcgtttaactgtttgggtagcgcacaaaaaataataggagtggaagttaaaaaagcgaaatatgtaacacacgccatcctttgttaaatttaatttttagagctgatttttaccgttgtgtattacttcgtattagttttatataaaattggtaagaatacatatataaaatttttacccatgaatcattttctcattgatgataagcttagttatagccgaaacgattaattttttttaatgatggattactctaagtttatgataattttgaaggcatcaataaagtacccactacaaagttgatatgttgttttataattaaaaaaaagttatttttaaagaaatagtactaatttgtgagctcgagaacaaccaaacgggcctagtttctgttagtgttgtctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtctttccgtcactggctgcgccccctcgatcggttagggtttttggggtggagtggcggcggtggcaaagaacctcgttccttgtgtcgttatgccgtcccgtcctccacccctctttatatggcacagtgtgacgggggcccaccagccattggggttggcgcccccgatcagggcggggttaaggcccccttagccattggcttcaggtgagggagatccatcttacatttttccctttggcgtactaattccttaactttttttattcatcacagattacctaagaagctgctgaacg

SEQ ID NO: 22069 - DNA, 4418 bp, Oryza sativa
  unsure (1)..(4418): unsure at all n locations
gcgtgttatctgntaatacagtgtantnttatacgtgttttgttatattncttctttacttccgactcctctcatcctcattttncgntantttcagtttcgtcttnttctcctcctctcccncccccccagaggcttttgtttgacattagctccccaccccaccgncacgggnaaataccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcaagactgattgtttgatcccagactttgtctttcacaacatagtactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccgtagcctcatggcatgctataaactcggcatacatggtagaccctgcagtggtcgtctgttttgagcttttccatgaaatagctcctactgccagggtaaacatgtatcccgatgttaactttgtattatcttttgcaaagtcagaatccgaataccccactatctggagcgattctgcttttctgtaagacatgatgaggccttttgttccttgcaatcacgcaagactttctataccaatttccagtgctctaggcctggattactttgaaatctgccaaataacccggtaacaaatgccaagtcaggtcgtgtgcacacttgcgcgtactgtaggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagcttttctttaacccataaatggatctctttatacggcatcccatattttcgtttcctttcatgacaaaacctttcggttgcgccatgtatactttttcctccaaatcaccatttagaaattctgtttttacatccatctgatgtaattccaaatcataatgtgccactagtgccattataatcctgaaggaatctttacaagagactggagaaaatgtctcattgtaatcaatcccttcttgttgcgtgaagcctttttgccacaagtcgcactttaaacttttctatattccctctggagtcatatttggttttgtagacccatttacagcctactgttttggctcctttaggaatttcttctaaatcccagacatcatttaatttcattgatttcatttcatctttcatggcttctcatggcctcttcatatgagatgggatcatcctcgatatgcgactctttcaggccttctaggggcctcctattctggcacattatatgtttgaggctggtgcagctcctcctctgatgtggcaataatttctgttgaatcctgtagaataggttcttcactttcattcattgttgccacaggagagataacaacaggtgttggtaccgcaacgtcatgcattgctggcacaacattagaaaggttcctgagtcgacggagcgggtacagacacccgcctctcctcaagatcaatttctcgaattaccgagctccccctaatcatttcgtcttccaagaagacgacgtgtcttgtttctacaaactttgtataactgtttggacagtagaaacgatgaccctttgatctttcagaattagccaataaaatggcagcttactgttttgggttaaatactttatcctttgcaggactcccccacacacggaggatccatagctcatatggtgttttgggcaccgatgcattctatacattgtatgcatcgttctaaaactgagaactccaatggaggaagaactacattcttaaccagtctctcaattctccccctcgaaatatggcataaacaacagtgccataatttcgatgagacatcagaagttcgctttcttttcttttgtcaacgaggacacaacattcacattctcagaaagaaataaagctgatcttgcaacacaagaccaatacattcattattataccatagttcacatttgccatttccaaaatggcaatcatatctatcaaaatccaatttggatacacttattatcaagtttctttgcaaagaagggacataaaaacgtctggaagtaaaagtgtgaagccattcgcgagttctaggcgaagatctccaacagcctcaacttttgcttcaactccattggcaactctaatggatctttcacttctttgcgtagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaagatgatctttcttggaatgtcttgtcttcttgcagtgtagacactgatcttgtctcaactgtaaactgttgtttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtattttacaccacctccatggtacctctctgtaacaagctgctttatcagctgtgtcgtataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttgtttacgctctgtaaaattctcccgttggttcaaatttaaacagagataaaacatgtaagacaattcaaaattctattgtaatttgcatgaaaaaatacaaaatacatgttcagaagcatttctcacatttatctattctttaaacaattttcacgttggttcaaattgcttagaaataaacacaatcatttaacatattgaaaatgcttccttcggccgagggacttttattaaacctccttttttttgattcggccccgagggacctaaaaagaaacttttcggccttggcaatttggcccacggccgtcttgcgcggcgggggggcgcccccttccctttccccagagccgaaacctgggccttgggcccgcaaaaggggct

SEQ ID NO: 22070 - DNA, 1443 bp, Oryza sativa
  unsure (1)..(1443): unsure at all n locations
cgagaaacgcattgaancgtggttggacacttgcgtaccaaccgttggaagattttgacagacacatacacgtcatctcaagatagggacacatatcatcagatccagttctcttccaatttttttatgaaaaaaacactgtcagatcaagaaacccatgcatcaaattaactggagatcatgcaccggaaatgttgcttttgggcagcatccagttgcttcaaagcaagctcatgaagatcatgcgtctactgatcgatggatcccttatttcgcgccgaatattcaaggattttcccacgcgattatgtgtcccctgtgatcctagcccacccattactctactgaactttgaaaattttttaaacttacttttcgatttttgctttgacttgctgcgatgatccgtgccacaaatcagcaccaaatcgattaaaatctgacaacctcaagtcaactggcatgaactctagtgctaataatatatcataattaacttggcagtaaaggcagcatggctctctttcggcgatcactatgctgcattgttttaaaagggtttgacttgtgcgaaattaaaatcgatggacagcgacctgaacaaagatgcaaactgcactgcaccgcgatatgctcactcatgatcgctctcttcagatatccaattagtaaattgttaatcgcatccgacctacttagtccactcaaagtctggatggtaaccaaaagcttcagcgcctgtagtgggacaagaacagattactaactaaaactaactaactaaagccttttacagttcagatatcttagtgagatcaccattgttaattatcgaaaatacttgtaaaatgttactaatgagcaggggcgaagctagcgtccaaacagaggtggtgcactatcattaaagagaaaattccctatctagcatcaagaaaaattgctcttccctctatagcacccaaacttcaaaagttccctatctatgcaccatcaaaatttttgttccccatctaacacttccgttagttttgagggtgacggtgttaagttgcatgaggaaagacaactttactggggtcagtctaacgcaggataccgtagtcgatggctgaacattatgaagcagctttaaggatcggtaatgaactaggataaagccgtgcaagaagatcgacactctactgggatgccttaaactccgcatacatgggaagaacctgcaaggggagggtcgttttgaggttttccatgaaaaaaatcctactgccaaggtaaacatgtatcccgatggtaacctttgaatattctttggaaaagcagaattccaataccccactatctggagcggatttgtttttttgtaaagaatgaagaggccttttgtttcttggcatcccccaaggatttcttttccaagttgccggcgcctaggtccgcttn

SEQ ID NO: 22071 - DNA, 2936 bp, Oryza sativa
  unsure (1)..(2936): unsure at all n locations
gcgcgccctttgattgacagctcggtacccgggaaagcaggtcgcgctcgcgctctgtcctagagaaagagcgacgaaaaaaattcctgagggtgggtccatgattgttttgacggtggaggctaacgggagtaacggaagtgttagatagggaacaaaaattttgatggtgcatagatagggaacttttgaaagttgggtgctatagagggaagagcaattttttttctgatgctagatagggaattttctcatcattaaaagcctagaaaaaaaatcaatgtagcactgcacattttagtgttcttaagtaagaaattttggatctgggattcgtgtgcaccacttgagttgaacgtggctccgccattactaataagtaagaaatacatattatcgtttgggtttgatgacatcgttggctccgccactgactggatcgatcggtgcatgataagctagtgctaagctgtgggacacattgaattcagttcaggatcagccatgaatatgagtggcgcgtggatttcattcacaaaccgctgcttctgcttgctcggccacttgatgaaacagcggctggaaacccaaaaactgctgcgtcgtttcgttcaggataagctctgcatctgcatttttcagacagacagcaatggttgttccaaaaaccgatggcagatgaatgcaagtgtcactggcatttccgacatggaaatcagggaacacacacataatgcagagagaaatgcagcatactccctccgtcccaaaaaaaaaaggcaaaccacgggtttacgtgccaacgtttaactgtccgtcttatatgaaatttttttataattagtatttttattgttgttagatgataaaacatgatgaatactttatatgcgacttatctttttaatttttttcataatttttttaaataagacgaatggtcaaacattggacacggaaaccagggtttgtctttttttgggacggagggagtagcagaggagtatatatgaatgtgatggataatactccatagaaagctctgctcgcaaaacaggcaaagctgcagcagctgtttttcgtcagacaaactgtccaaagcatccgtgcaaatgggcgaacacttgcaaatcttctctcgtaatagcaccaattatgaataagacagcatgaacaataaactttgactaccaatatcagtttttcttttttttttctttttcttttcttttgagcagttggccggcccaagatattagcttctacagtgcttgcttgtttgtgttttgtccacagttattaagaccggaccggaccggcggtcggaccggaaaaaaccagaaccagagccccaccggtccggtccaggtaaaagaccggcatgcaatcgatccggctataaaccggttagaccgcccggttttgcttaaaaaccgctattaaaccggggtataaaaccgctttgaaccggcctggtggtggttggcgtgggtgggattcgaacccacgaccacgtgggagttagttaaactcctccaccaccagactacttggctctttgtgtttacactgaatgatcaatgtatttagtatttattgaaccggattagaccaccgatccaaccggttgaaccagtgaaccattgaaccgacagcctcaccggttcgattaccagtccggtctcaataactatggttttgtctagtctgcgtggggccctgtgtgggttagaggtggtggtgggacgagtgacgtgggcccacttatccgagacacggaaaggaagggcgcggggcccacatggagaccgccaagcaacagataggcgggggggaaggggacacgtgttgcgcgcagacgagtgccgtgagctaacaccagcggccatggcccatgtggccatgtgcgtgttggcctccctgattgaaccgtgggacccacctctccgtgatgtccacatctttagtttatggagtactagtagtactagttttattatgcagcgttttgcattttttttctttttttaagatggaatttttttattacaccgtaaactcacatgcactacacacgtaatacagtatttctttatttttttcgattacatggtagacttatacgcacacacgcaacaacatatttatatccctatgaatgtgcttccgaatatatgttttacttcctctgtccaatatgttgatcgttctataattggtgagctacatcagctaaaggtgaaaattaataaattatcctaaattattattggtattggttgtatgtggtcattttaatcagggaattagcacaaatggcaccaaccaagtactccctccatttttttaaaaaaaaaagataacctaggatatgatgtgtcagattcgttgtagttgactgtgtcacatttcatttttaagttatgttttctttttttacggagggagtaagccacacaggaaatattttaagcatagaattaagtagtggcacttatacaagcaatacgtcaaaacgttaattattcatgcataaatgttagggggtaaaacatcaaacaatcgggaacggatggagtataagacagaaattagcggtacatcttcaatctcactaaaatccagaaattagcataagacaggaataaggtggtgtttnnnnnncnnnnnntnnnntcntttcntttttttttttnttatccttttctctttttctctctttctcccccccnccctcctttttcttttcttctctcttcctcatcctttttacttttttcctctctccctctttccctcctttcctccttttntcctcctcttcctctctcttcttccctctcttcctcctcccttcccttcttcatccctccccctcccctccttttccttctctctccttcctctttcttttccccctctcttttccctctacc

SEQ ID NO: 22072 - DNA, 36360 bp, Oryza sativa
  unsure (1)..(36360): unsure at all n locations
aggagaacgagngagagagaacgcgcgccagggaacaaagaacaggagaaaaagacaagggacaagccaacgcagcgcgaaaacaaaacgcgagaaggagggcaccaagcacaaaagaaccaaccgaacgacaccagcaacacagccagggaaaaccaaaaagggaacgaaacacgaagcaaggaaaggacaccaccagaaaaagccacggagggccacccaccaaggagagaggggagaggaagggaaacaagcagacgaacaaaaaaagcccaaccaaaaaaaanaaaagcgcacccaagcccgcgcaccaccgaggccgaaaanacgnacaaccgaacgagggcccgagaaaagaccaccanaagggnngcccganaggaacgggngcggggnncnnnnnggggcnnnnngccccgngnggncngncncnncnncccaccacctaagatgtaaactttattctgggatttcgcatgacaaaatagtatgagtggtttgaatgagaaaatgataaatatgtgacacaggtaggtggtaggttgatgaatcagtcctcactgtgcaatttgcacctttaaaatcatctatcccattcaaaatgagaaacttctatggtggtcttttctcaagaccccagaacggtagtacgattttacgaactagtaggagagaggacaaggtagagctatataatatttggtaggtttaatttgtttgcatgaaagtatcaataactaactaattatctttggtggtgtacatccgagaatttttttgagaattaatattatttttatggaaaatcgcaaaagtagtggccaaccggggaaaattgcgaaagtagctccctgtcgaacgggtgcagttcgatagggcacctatcgaacgacgggcagtcgacaaatccctatcgaacggctggagttcgacaagctcacctgtcgaacggagggagttcgacagggcccatcacccggcgccgcgaggcctgtcgaaccgggggcgttcgacagggccctccaccgaccctgtcgaacaatgggcattcgacaggccggtttaaagccccgtccacccaggccgcgatgcttgttcgatttgtttgaggaccacatcgccagccgccgccgagagtcgccacatcgtccccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtatggttaaattagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgttaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaaactctgccttatgttcaccccacgcagggagtatctgggtcggcacacttcccttacatgccaacgggggacaacgtgttgaacacatcagcatggggacttcatatcactccgcgtgcgccagagcagggccacacaccgcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggagaagtagggatggattactggcacgcagcacctcaggtcacacagccgacgcaggagacggaggccggtcaggggccaaacgtgacaccacagcaggcagctagagataggcacccccctgataatttgacatatcctactgagcagattaggcgtaggaagaagggaggacctagcaagcgtgcgaagggcactgatcgtccttgacttatatatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatataaaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaaattattattacaaataaatggagaacacgaccctgtcgaactgcgccagttcgacggatatcctgtcgaacaggggcagttcgacagccctgcctgtcgaacaggggctgttcgacaggacctgtcgaacggcagccttccgatctcctcgccagtcgcgctctggccgttcgataggcgccctatcgaactgcacccgttcgacagggacctactttcgcgattttccccggttgaccactacttttgcgattttccataaaaatgatattaattctcaaaaaaattctacatccgattggatgaagaggctgggtttatcccattttctagaaaactactccctcagtttcaggttagacgttttgactttgttcaaagttaaactattttgagtttgactaattctgtataaacaaatagtaatatttataatatcagcatagtttcattaaatctataattgaataaactttcataatatatttttcttgggttaaacatattattacttttaaaaaaaattagtcaaacttagagtagtttgactttgaccaaaacgtcttataacctaaaatgaaatggagggagtaactaattaatttatatcatttgattaatacatcgatagtaaatggagggagtgtgtcttatgctctgattggttcagctatagctaataagctatagaaatataaatgaagaaaaaaatcacggtacaatttttactcatgtattaattattcgtgatttaaaagacaatactaaaaatggagtacaacaataaacctctaaaattaacttaaattaagttgtaaaattcaagtcttcgaccattgatcagtactaaaccgtcacgagtactcactattgacgactcgaggagatcaaccgcaatgaggtagctagcacaactcacaaaataaaaccatctgattgaactgaatattttttcgaataagagattgaattgaaccangggcggtggggggggggggggggggaccttaattacacagtttctttaacctccagccatttagagacctttagtttatcatttatggcgaaaaaattgaatgaggtgctccggggtatccatgggtcttgtgggtgtagggaggactcacccacgttggatccgcccctgaattgaactgaatattgttagtttagaactcaaatcagctcaggctgcacatatctgtcaattggtctctctctgttttttttttcttttttggcaatgcgctgcacacagcaaatatgggtcgagatgacacggatgcggaagttggagaagctggacagcagcagcatcaccattcaggtcatcaggtgtttcaccggtgacgtacgacctctctccggccgggcagatcagcctgaccgacatcaacgacgacctcgagcagcagctctgaattatctgactaattaagtagtactacatacactctctccgtcccataatataagggattttgagattttatttgcattgtttgaccactcgtcttatttaaaaaatttatgcaaatataaaaaaaataaaaagttgtgcttaaaatactttggataataaagtaagtcataaaataaatctactactacttaaaaaataagaggtgcttccatcgtccgtcaaaaaaaccgggtgaaaaaaaaccgggcagaaaaaaccaagtttgtccgataaaaaaaccggacgaaaaaaaaagtccgatcaaaaaaaaagtgaaaaaaaaaccgggcgaaaaaaacacccgtccctggcaaaaaaaacacccgatcccttaaaaagggaaaaaaaagtccgagagacaaaccgtttaatgaataaaaaaagcgaaaaaaaagagtccgattccctggagaaaaaaaatctgatttccctggaagagatccgatctgtattggattggagaaaagaaaattctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatacaaaaaaagccaaaaaggggaaaaataaaaacgaatccgactccgtcgacgtggtgaaaacagggcgaaaaaattccaaagtaaatggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctggccgatccaaaaaaagggaaaaaatcaaaacgattccgacttcgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgccagaaaataaaaacggtttaaaaaaccacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacggacatatttgctagtaaataataatttcaatttttttaataagacgagtagtcaaacagtgcaagaaaaactcaagacggagggagtatttgagatgtgaatagatcttcaggatcagtttctgaaccagtgattacagtcagcttggctaattaattgttttacattcttgcagttgcagctgagctagcgtctcgatcagcaccaggccatcagctcctgaaccaacgacagctggacacgtgcccttgtatccattaatttaggatgtgattgaatacttgaatgtattgaagtcaatgagctgataaattaatcagtgttgtgcaatggacattagcagcacacatcatcgacgaaggcaatgacagctttcctctgccgcacgccaagaatttcttccgttcctgagctatactttctccttccaagtgactcgaacaatgaatctagtttatgttacattactatcacaaattgagttattttgagatggagagagtagacctgttattataaaaacaataataatttaattctatctatgaacttgataagcacccatccagttctataactagaattaagggcctgtttactttgatgaaaaaaaaaatcttaccaaattttggcatagttactaaaattttggcaaattgctaaaattttgataggatttcttgtatagttaccaaaatttagcagcaaactaaatgtagccacttttttttgacaactttaccaaaatttggtaaggttgaaaatggtatcaaagtaaacatgccctaagcttttctttggagtggatagagcaagtacttcctctacccaaaatatataagaagttctgattagatagaacatatcctaataccacgaatccggataaacgatctatctagatttataatattaggatgtatcttatctaatcaaaacttattatattttgcgatggagacacgggtaagtattaaaagtgaaggcgctaccgatgctgacaacgtactaatctaaaatggcggtgcagcttaatctcaccacctccgaccacaaatataaaggatcgaattatactggctatacatattgggccggactacatgggcctcgtgcagttgtttccatttgggcccaaacactagcaccccaagtgcttctcgcgaactgcagcggcggcggcggccgaggcgaccagcggcgagccggcgaggagcaactcgtggaagcgccggtgatctcccttctccgtggagagcaagaagcagagacgatttgggatgtgtttagttcacaccaaaattaaaagtttggttgaaattgaaacgatgtgacgtaaaagttagaagtttatgattgtaggaaagttttgatgggatggaaaagttagaagtttgaaaaaaaaatgcaactaatcacggccttgggtgtgtatctctgtgtggacaggcaaaaggcagggttcctcctctgttgccttcatcaggacctggcaagtttggcagtgacatttcttggttttcttgttcaagaacagattctgttaagctcacctgaaatcgtgctcagttggttcggcaatatgcagattatgcagatgcacgtgcgcctcctggaatggaggtttggtcgagagcaaggtgaaagcacaaaagtgatgtgagctctctgaattctgatagactcctggaatggaggattggtcaggagcaaggtgaaaagcacacgaatgatgtgagctctctgaatctgatagaggctttccattgattttgttggtcatcatcaatcatatagttttcatattattgattaaataatctggagttatgagctaatggctccttttttctttccatagatgaattgttgtgcaagattgagccttaattagcagaagtccggtaatgtaacaatgttggttttctttcgaacttcgaagtataccaaacctcttgtccttgacaatgaagttttatgggagcatgctgaaatgtatttagatgtcgccttagtggtatactggcagtttgtacgtgatatctctactattttaaaaacgaagccgttcttcttccttccgttccctccctcccgctgcacgtaggaggtcgtccgttccttcgcgtgcgcgcaaccacctaggatctagtctcattaacattgtggtttttgcccctcttttattcagcatatactgggatcactgcctattatcccaaaaaaatagaggggctaacattttcgttgttcagctactccctccgtctaaaaaaaatccaacctaagtggggatggaatatcagattcgttgttctaggtggtatttcatccccatctagattggtttttttggaccaagggagaatattgttgagaagaactcgtacggataatgtccaacgccaagatttgttgtatcagtgatggtagtcactactcactagtcagtctgcctaattcaggtgcggcatgattcgacatctatccaaaaaagcaccctattttctcttgccaagtttttcctggtctgtggcatataaagaaaccgtagcacgactatacttcaacatttgcattgcagcaaataactcttacacgtaatcacataattaaatagtaatattttatctttagtttcttctctaagaaaaaaaacttaaagtttctgttcaggaaaaaaaggactatctatatatctgtagtcaaatataaatacagtataattgtagtttttttaacaaaaaaattgacaaatgtataccaaaatcggggaaagaaatatttgagtagagtagcagaagcagatgactgacggttgggctctggttcagacaaaactcggcccaattactcaaataccaaataagcccaattcctccgtaaaaaagttcagcccaaaatccttgaaggcccaccaaaaccactcaagcccttgcctactcgggttccaactcatcggcccaacaaaacgacgcgccggcctggccaagccaagccaagccagcctctccgtctcgactcgatctctctctctctctccggcgcaaatcctcctcgccgcggcggagcactaaaccctagcgagagatgccgtcgcctgcggggggtccggtggccgtggcggcggcgtctgcggcggcggcggaggcgctggggatctcgccggagatgtacccgacggaggacgacctggcgtacgaggaggagatcctgcgcgagccgttcaagctcaaggggtggtggcgctacctcgtcgcccgcgccgccgcgccgttcgccaagcgcgccgtcattctacgagcgcgcgctcaaggcgctcccggggagctacaagctgtggcacgcctacctccgggagcgccttgaccacgcgcgcccgcaccccattttccaccacgcctacgccttccttaacaacaccttcgagcgcgccctcgccaccatgcacaagatgccccgcgtctgggtgctctacctcacctcgctgctcgaccagcgcctgctcacgcgcgcgcgccgcgccttcgaccgcgcgctgcgcgcgctccccgtcacgcagcacgaccgcatctggccgctctacctccgcctcgcctcgctcccgggctgccccgtcgagacctcgctccgcgtcttccgacgatacctccagtacgacccctcccacgctgaggacttcatcgatttcctcatctccgcaaaccgctggcaggaggccgccgaccgcctcgcgtccgtgctcaacgatgacggcttccgctccgtcaagggtaagacccagcaccagctctggcttgagctctgcgaaatcctcaccaagcatgccgatgaggttgcggggctcaaggtggacgctatactgcggggcggcattcgcaagttcaccgatgaggttggcaagctgtggacctccctggccgattactacgtcagaagaaccttgtatgagaaggcgagggatgtcttcgaagagggggttgcttcggtgatgacggtgcaggaattcagcgtggtgtttgaggcgtacacacaattcgagcagagtatgcttgcggcaaagctggaggcagccgaggaggagggtgcggggagtgagggggaagaggaagcgggcaggaagaatgggatggacaagctgtcgaagaaattcctcgcagattgctggctgaatgatgaggatgatactgatttgaggctggcaaggtttgagcggctgttggatcgccggccagagctcctcagcagtgtcctgctgcgacagaatccgcataatgtggaggaatggcacaggtgagactcacttgattgatcacattgatttattctttttcatgtgttttgacaatagtaaacactaatttgctctttagttcacttcatgtacatgctgtttattttttcaacatcaacatcttaacttagtagcatctcaatattccagcctagtagaacaattttgatttggataattcatgttaaaccagcaaaccaaatgtactgttactgcaaaaagtttggtcccttctcatattttaggtgatatattaaatgactaatgcaagaccccactggactattacatatggttgtaagtatacggtctatgtatttttactgttttattgtagttgcaatttactgtttttgtagtacatatttctttccagcgacaagttttggattctttagtgcagtaagtggctgtggtaaattttaattcaaaacatgtatactgtggaatgtatcaatctagtggcaggtgttttcatttctcagcctagcaatgtactagtatgttggcagttcccttttgtgttttccattctcatacttgatggaattggctaacaatacgattatgtttgcaggagggtgaaactttttgagaaggatcctacaaggcaagtagccacatatgttgaagctgtgaaaaccgtagaccctatgaaggcagctggaaaaccacatactctatgggtggcattcgcaaagatgtatgagaaacataatcgtctagatagtgctgaagagatctttaaaaaagcaacacaggtgaactacaaggcagttgaccacttagccagtatttggtgtgagtgggcagagatggagctgaggcacagtaattttgacaaggctattgagctgatgaggcaagctactgcagaaccctctgttgaggttaagaggcgaggtatatatatatatatatatttaccatcttattttttgttgtgtgttttactgttcatattttctaacagtaatgcaatatgtcctgtgcagctgctgctgagggggatgaacctgtccaattgaaagtacataaatccctgaaactgtggagcttctatgtggacctggaggaaagtcttggaacattggaatcaactcgtgcagtttatgagagaatattggatttacgaattgccactccccaaatagttctcaattatgcatatcttcttgaggtaggattatttgttaactccgcatttccaaaattcgagtaaactattttatcgtgcatatgctaatatcatgacatttcctctttccacaggaaaacaagtatttcgaagatgcgtttaaagtgtatgagcgtggtgtgaaaatttttaaatatccccatgttaaagacatttgggtgacctacctcacaaagtttgtaagaaggtatcagagaagcaagttagagcgggcaagagaactgttcgatgaagctgtcaaacaggtaactagaatttcacccacatgtttcttacatatagttgtatgcaatgcttgcatgtaagcaatatttgtggcatgctgctgtagtcacaaaagagtaacagtttggatagagacaccatctccacaacacaataattttgtaaaatcatgaaagtagttatgaatatatctacatttaacttttgaaacactgaatgcatgtgtccctaagtactgttcttgttcaccggataaaatgtgctaagttgaatcatgtttaatctagttggagttgggacttgttttagttaacatgttaccaaatgctttttgggtataactggcaatcagaaattttgtccttgcttcatacgaataagttcagggcgattcttgttgcgcctgctttcttcttcctttaagaaccttgtctctgcttgctgatatcatgtcatgcgatattttgcatttgcttgcttgcttgtttagattccaaacctttggttgattatttcgtgttcctttttcctgcatcgatgctgttttgaaaatgatgtttttcctatattgcttcagtacttacattttgttttgtttgatcaggctcctccacaagaaaagaaggtattgtatttgcagtatgctaagctggaggaagactatggccttgcgaaacgtgcaatgaatgtatacgacgaagctgtaagggctgttcctaacagcgaaaagatgagtatgtacgaaatatatattgcacgggctgcggagctatttggtgttccaagaacaagacagatatatgaggtgagtgtgttatcttggttcttactaatactggttatatcgtgtgcttgttttgagatccagttttacattttgctgttttaagacaaaattaatgtgggttttattacattccaacagccttgcctttttttttttttttgctaactgttcgtatgaatcaaagaactcattctgcactcgctgtaacaacccatatacttatgaaaaatccagatctatttttctgtatagtatggtctagattttagttgagtcacactttaggtatgcacaactggaaatgattctaactttattcctttgtgctgcagcaagcaattgaatctggactcccagacagagatgtcatgacaatgtgcatgaaatttgcagaacttgaaagaaaccttggagaaattgatcgtgcccgtgccatttatgtccacgcatccaactatgctgatccaaactcttatcctgaattttggaataaatggaatgaatttgagattcagcatggtaacgaagatacattcagggagatgcttcgcatcaagcgtactgtggctgctagccgcagtcaggtatgtcacaagggccaaccttataggcagtttggtattatcaatgatcatcttgtgagttagtaaactaaaatgatgtatttcgtttcatgtgcagactcatttcatactcccagagtacttgatgcagagggaccagaggctgaacctcgatgaggcagttgacactctgaaacgagccggtgttcctgaggatgagatggctaacctagaaaggcaactagcgccaggaccttccacggctccaccagctccaagcactgctactgctcctgctaaccggatgatgaactttgtcagtgctggagtgcaggcacaggctgagagcagcagcaggcaacaacaggctgctgctactaacaatgaggacattgagctgcccgatgagagcgacgaggaggaagacgatgtccaaattgcggagaagagtgttcccgctgcggtgtttggagagctcggcaagagagctgcagagaacagggaggaggaaagctctggtgcccaggagaatgagcagcttggcgcccttgagaggattaagcgaaggcgtcaatgatctgccactgtcaagatgcccacaccattagctggtgcccttaacgatgttgtagctgtaactaaccaaaacttgtaaacatgattttgagtgggtgtttttgctcttgtccaagaatttacgggagttattaatccgttgttgatctgcgaccattttttcgtgtactaactattgggtacattccccgctttttattccctcttttaggctagaaggcaatcatgcatgatgcattattcaattctttttcttttttgcgaggaaacattatttgatttcgaaagtgtacactgctactggagtgttgaaacctgaaaaatggaactgggagactgcatttctgttgctgtctcctgtggtttagcctttcatttgcaaagttattagttgagctacggcttatagaccgagtaatataatgatggtgataggtgaacaaaactacaaatttcgttaattcggattcttccaagtgaaccaaaatagtgtattcctttgatcacaaaataaccatcacaaaactgtcagcaattttgagcatatatttgcaatttgagctctgaaggtaatgagtagtggaaagcatgtacaatttgatcacaaggtctctcatcttgatctatttatcgttatccctttcttttaccaactcatttgtaccaaaagaatcaatcatatggcaactaaaaccccatatgaaaaaaaaaatcctgtcgctcacatccatgtagatcacctgacataatctgcaccgtcaagaaaatgagcatactgtgtcccattcagtttgttgctcacatcatcccagttcctgacaaggcctggaagaggactagtgtgaattttcacctgcctgctgaccagctttctcaccggaactccgaggaattcttgtacctggaacaatgcctgcattcatagagatgatattttagcaaagcgagggttatcattgatccttcgttacagcatttgaatatgttttagtacatttctgttggggacaatatactcgtagtagaggatcatgtgccgtgtggtgttgaagtggtccaagcaatctctgatgtatttctcggcatttctgatgtttggaatcagatttgacacatccagcaccggcttgaatttcgctaatatctcagcctgctcagaaaaaatatataagcatttcattttttttttcttccttgccaacatgattgatagtgatgttacatttctcttggaatggaaatatgtaggatttaagtttcaccaaaatatctataccagaagtccagtagttgtctatattctataatataacctaatataagggtacaagttcggaaaggaggagcccttttatatgtagagaaaatggctccttccaaatgcaatatagtcattcctccaatattgatacaatatttcccatatgcattcaaatatactatggtcatatttcatcaaaagtgcacctagtatgaaaccatgttcaatgtgaaaaatatgaactgaaaatagtaaggagaggacataaactgttgcatggatataacctcttcttttgagtgtacatgggatttgtgggttccattcagctgcttcgcatctctgtcgtaatcattagccaaaacagagataagcctgcgcaatgtatttctcctgaagagaaatatcacggaaacacccttcttgtttaaataactagctatatcatcatgatggtccataaacccctggagaacacaatgatggcagtcaaagccatgcataactttgtaagttgtaggcataattttacccatgcaataatgcttgatgaatgagattgaacacacaaatgccaacatcaataatcatagctgaccagtttgtgttgtacaactacaaagagcagccagaacatatcattgggaattgcaagcatattaccctgtagttctgttaaaaattctagctatacctctaaaattttagcaagcgaatagactatatgaactggattgcccaagaacaggactagtgcacactgtcggtaactatggactatggtaagtttcagagaaaggtgtgcgatttctgaagttcaatgtaacagagagctaaccctctaatattcacatggaccaagaaaagctgaaatatacctgatttagcatccacttcaatccaaatgcagccgtgcactcattctttgctgcactggtgaaccaatccaaattatacaatttgtcaagggtctgtaagatagatgagatattctctcttctatccaccctgttaaatatttcaccatttgagctgatgttagggtggctgttcagcaaagtctcaaaccatccacttcccgaccgttgcatagatacaagcacaaaggatcgaaccagattgcaggaacactctcccctatggaagaaggaaaatttgaagcaacatgaatcagaaaatgcacatccataacaggggcgtactaagagataataattctactctagaggaaaattacctgctataactctcaggtttcggaaagtgcacataacgcagctcctcatgaggaagatgaggctttcggcaatgaatttctgcctgcacttctccactgttctcctcagatctattctctagtgttatctggttaaaggagatgtagcatacatagaatccaaatattgcaatgaggaagacaagaatcggtcgcggtggaaacggtgctcccttggaacttttaagtgaatatggatgctgcgaatacgaaaactatgatcaaatattgttgctatcagatatcagagatacaaaactagaatcatgcagtaccattttcttattgcaatttggtactatatcggccgaattctgcttcttccggttgtccgcagcaaacaagcatcaccatttgtggatgagtgacactgcattctggtaagttacagattcttgcagttagcaacaacttgcaaaatgaaaccaagaaaaaaaagaaacttagtgaacctacaaacgaagtgctaatgacaacaatctgttcaccgaaacgcttcaaaaagagcagcaaacaacaattggatggaaatcaagaaccctaaatagaggggaaataaaaaataaaaacctcaagcaggattgagcaccaaaaatgggggggaaaggaaggcgcagacaagaaaaccctgaaatgctcaaacaatggctcaccaagaacttgcggcacaaagaatccccaggagagggaagaaatccgacgcggtgaaaagattcaactccaaaatggcgaccaaaagaagaacaaagatccaaacccagttactccgctcgagaaaacccaggcgacattcagcttacaaagcggccaaaattcggatgcgtaggcagaatcaagcaggagagtgacaaagatagggttttgaggcttcggatattggtagaaccatcaaaaattgggggcaaaaaaatagcagatgcagcctagcgaccaacttaaaaatcatataggggcccggagtatatatagaagaattccccttggttcgtcagcgagaacacactttgttatcttctctcactatctctagtagtgacgttaatgcagtaggttattaggactatttggattttaaatggtttgaaatatgtgggatgattagtagctaagcaaagggctaacacagaggcagctttgaactcaagatgcagacgaagtattagggtgtgtttagttggggaaaagaaaaattttgggtgtaacatcaaacgtttgaccggatgtcggaagggattttcgaacacgaatgaaaaaactaatttcagaactggcctggaaaccacgaggcgaatcttttgagactaattaagccgtcattagcacatgtgggttactgtagcacttatggctaatcacggactacttaggcttaaaagatttgcctcgcgattttctctataactgtgcaattagtttttctatttatctatatttaatgcttcatacacgtgtccaaagattcgatgtgatgtttttgagaaaaaattttagggaactaaacgggccctaaaagaagagcacgaagtcagcatggggggacatatttcggtgcacttggtctttgtggaccgcgtaaacttcggagttggaactggtccttctctcgctgattcgctgaattttgtgcagagatggcgatgctgttcaactgaatttcgcggaaggattttgttatatagggcatgttcactttgatgtaaaaaaaaccttaatgccaaaattttagtatagttaccaaaattttggtaggttttcttttatatttattaaaatttgacagcaaactaaatatagctattttttttagcaacctggcatcaaagtgaacagacctttactctcttttttatcgttattgtacggtagacatatacgcacgtgtatatcatcaaacacgcatacctcactcatatacttgcaaatgcacaccctgactcgtgtatcaggatttgaaccttggttgtcatgaagtcaccacgggtgcttcccaaatttattatttattacttgatcattcaattgataagccttccgttctaaaaatgttatagttaaacaaaacttgcttgatctgaagctactaaggattggcaaaagattttcatagaattcaaattctagtgaaaatattttttcttacattaaacttggaaaaggaagaaaactttccatattattatatttgtacatttcattttaatcggaaaattacctagaggtctcaccttttctttattatttttcttcatttttcctatggcatttaaggggccttctattatttttgcatgggtttcatttctatatgattagagaagggtaccattttaaatcacgcgttttctccaatcctatgttttctctatcacgcaaaccaaaatttaaaatcacgtgttttctccaatcctatgttttctctatcttgcaaatcaaagggggcctaagagtgcggagatcctgtgctgtactgcatatgcagtaggtgccacttacaagtgggcccgaagtaggtgggacccacatgtcagtgacacctactgcaggtgcggtccagcagacgatttgcatccgggcctaaatgttgcaagttcaggcagcactatgacagcagcctgaaccaggagcgctgctatttcttccaataatctgaccgacaacagagtgttccatccagcaaaaacactgacaaaatcaacaaaggtctcactgacgagatcaaagtggtctacgtacgaattaggtgatggaatcccaatcaacaacggatctcaccaatccattcatacggagtaagccggtacaaaagacaagtaggtgtgcatgatcagaaagaccaggacatgatcacaggaaggatccacagtagtccagtaggtaacgagggcgccaatgaatcatcagttggaatgtcaaatcacaacttaatgctatccgcaatggttgtttagtgtctttaatagcacacacaagtgagcaacacacgctacacacagatcaagcaacatgatcctctttttggagaagccacagaaaatatgtaggtaatacgtgtgtttagtacccgttaaaattggaagtttgattgaaattggaacgatgtgacggaaaaattgaaagtttgtgtgtaggaaagttttgatatgatggaaaagttggaagtttgaagaaaaagttgggaactaaaccaggcttttggcctctgatgaaaaggagcagataaaagtgtattcaggacttgacaggatggataatgtcagcagctctagggcctgggttgcattggtcaagactctctaaccacacctcaagtgagtccatgatggaagtagaaaggttacctttgctttattcagactcgggattacaaaaaactgcgaatgcttaaatcctcttatgaagcaacaattttctgtaggttttgcttcctatcaatgaaaacaggtctacgatatgtacaagcaaaaactaacagaaacaagccaacaaaagtaagtggtgaggacatatctgtgaaacaaacaattggtagtgatcataaacatcgacatgaaaatgatatccctgacatcctgctaagagtagcatggcatgagaacaaaacaatgccacttgtttcaagaaaatacgcaaatcacctacctgaaagacagataacaaaaggaaaaggagtacatgcaagttatgttgtagtaataaaaagaaactaccttttactgccaactgccagcaatctacaagaaccagagagccatgcggtgatgcaacaatgaattatgcctccttggaacgcgaaaacctcagagaaatttcgacatcccagcattccaaacaagaccatgcatcacaaaggcatggaaacacaagcacagagacaaggaaccaacactcattcctgtcaataaactggtaatccagtaaaaagaaaaaaaaaaggctctatatgtctatcaacatcgcacaataaagtcagctcatttggagatccgttctgttacagattacgttgtaaaacttgcttacattacaagtgagggctatggcttttgaaaggaaggacgcaagagtatgttacatactttacactatctataagaacgacaacgaagatgcgggacagagaatttgaggagatcctcccctcaccatccctatcgctcgcttcccttggatcagccaggacagagactacaacggacgaaactggcttacgaccagcatggctctgactatggttcttggggggtgctttgaaatgatccgtgtcattggatgtcgaacctcgtaaagggatggcttctgagtacgaaatccttctgttcttcaccttctgaacagggccagaaggaagattttcagtataattttgtgacgtgttagtcactgacccagagtagacaggcacaatgccatttgcatcagctgttgttggagataaatcaaattggaatacttcagtgcacatcccggagttcaacatgggacctggaaaataatcaatagacagggttaacttcagtaaatgaaggaccaagtcatcaaactacttataacaactatcagccgaggaattaaaaggttagggtcaaagctacatcacaaggcacaaatgtttcatcactctactaatccatcaacaaaaaagagaataagtgcttcacatatgcacaaatctaagtactacctcactacacaatttagaaaaaccagtatattattcaattgtgccatatgtccataaacaggacatgtgtaatggaagaatttcagcaaacaaaggaaatacctacttgtgatggttatacatgtaaggttgaattcaactatacagaggcagctaaggatataatcaattcattcgatcagtgactttttgtccagaggaagtttataaggtcaaactaagagtaaattgcattggtagtacacaaacttgttaggtgggtgcaatttagtacataaacttgtgaaatgcttgtttcgatacacaaacttgtctagttcgtgcgaatgaggaccaaaatagcttggcaatgttaattttacgaagctaatgttgattaggatgtgacgtgcatacgtgtagtgagtgtacataagacatgcaatatttataaatgtggtctctactttatccttcatcatgaaagtgatgaatttcatatatttctaacccttatatcattgtttgttttttttatctttttctacgatcactatatccattctatttttattgaagaggtgtatgtctaatagcaaaccttctcagatatatgtttacataatttcctaatgagcccctaaattaataagattagccatgttgtgtcctttttgccttcctccgcatgcaccagacaaattcaagcaccaaaacgagcattttacaagttcgtgtaccggcaatgcaatttactcgtcaaactaatgtacataaatagtatactgtacaatagtaaattaaatatcataaaatatacagaattagcagtaattcagaacataacattccagtcaacaaaatatatgcattgagcagttaattatatatgctgcaatggtaccttctccaatagcataccgcaacggaaaaaactacaacattgagcttttcacaatggtgactaaacaatgaaccactgacccaaaagtctatgatcgcctcctatgtatcatggtatattggtaatcatccacccgagtggcatactaaacccacaataagtttacaactttaccacggcaaaagaacatgtaatatatgcagatatcttctacttccagcactgaataagcactacattcatctattaagatcgctagctctagcagatagtaagtgttatactccaaacaattcatcgcactaagtgccacattgtcctacaaacaccaacaaggcatatacagtattgttcatttaaattaaatagggtgtgcgtgcgacattatgcagcattcttacctgacattgcttcactaaaccactgcggcagcatcccatcatcctccctgtatatgcttccatctccaggagccagagccatcagttcattcattcctttagcagaatccatgacttctccagcttctaacggagctacatagccagggattgctaagctagtctcctcctttccttggtttccagaacccttctcgccatagttagacaaacgggaagaggctttctcactcgcaacaatggacttaataaccagatttccattgatcttcacatgcttcccattcctcggcaaatataacaaagctggcagcgtttcgcttccattctgaggtaccttcggatcaacaccatttgagacactattttgtggcccttcaacagccagaattctcccatgatgtgacggaacaatcgcagcgccttccccagtgtacgctgcaccatacatccgatttaccgcaggaaccaaacacccgcagaccatcatcaagaacagcaatccaagcaggctaacacctgcaaccttcttggtcttccgggccttcttggccggtggctccggtgtggacgcaggctgctgcgtcttgagccggggtatcggcacaagcggcacctgcgagccacgcattgcgtaggctgggtggatccatggcatcggcaatgggtaaaccgcagggtacatgggcattggcggcggtggcgcggcggcaccagcaccggcggcgccacccaattgctgcttgagggcggcgttctcggccgtgacgcaggagatcctggcggtgaggtcggcgatggtggcctgcatcaccttcaccttcccctccagcttctccacgtactgcttcttcctctgccgagactggtgcgcgctctcccggttgcgcaccagccgcgcgcgccgcttcgacttattatacttcccatacttgccgccgccgccgtaacttccgctcctcgacggcgacgacgaatccgcggactcctcgttcttggaacccccgtcgccggccgacgacgtccccgcttccggcgatccggcggccgaggacgacgacgacgtcgtcaccggcggcggcgcatccggcgggaagagatccacatcgaagtcgaagtccagatcgtcgagatcgaaatcctccagcgcgaaggcgtcatccccgagggtcgggaagtcggggaaatcgtcgccgggggggaaggggaggtcggcgaagggcgcgagtaggtccggctccgccatggatcccggtcaccggcggcgcatacgcggcggcggcggcgatggaggtggatgggatcacggacgcggtggtggttgcgaaagcgtgagggctctgcaatggaaaagagagcgaaggtgcgtgatttggtcgtagtcctcgcgattttaggtcgccgcggagacgaagctgctccacgcgtctcgaaccttctctgggcctagttgggcctcaaacatcgggccgattttgcggatgggcctagttattgagcctgatgatagagagagggggggggggggacagatggaaggctaattcggtttataggattcccaaatcaaaggtacagggaaggtaaagaattaggatgttagatgcatcttatttcttaggaatttttctaagaggtcttatctcatgataataagaatcatatggaataagcttgtaaggctataatccttaggtatttgataggattttataggaatggaaggaatgaggcatataggaaaaaaatcctaatgtttgaattcctacaataatcctataaaaatcctttaaaccgaatgagcccgaaagagagagagatgatgaagaagatgaggtgacatgaaagtcgctgacacgtggatcccatctactgacttagcaagttaaaccgtggtcaaactgtcatgtcagtagaaaccacttccaaaacgatcgaaggagttgattttcactactttccgaagacaaaaaaagccttccgggagcggcgctatatccggttttgcagttgagggagacgatttacaggagcaagagatgagggagacgaaacagacttatttgcctctactagaacagcagcttaggcccaaacagcggagcgagaccagtcatggcggcgacactcgcaggccgccgcctcctcctgcagcgatccgcggcggcggcgggggggaggtggcggctgctggggacggcggcggaggcgtcctcctctccgggagggagggaagaggcgggcgggggagggggagatgagatctacctgaagaagccggcggcggcggcggcggtaacgacgcgggacgagacgtcggtggcgatgccgatgtcgttcatgacggggtcggtggtggggaagcggttctaccgggaggccaccgtgcggcgcgccgacgacggcaacgggtggtcggtgatgctcgactaccgcaccctcaagtcgccggcgaagcggccgctcaagctgcagtcgcggacgctcgccatggccatcgccgccgagtgggagtaccaggtcatgatccccatcttctgtttgattggccctcgattggttatgctgctcaactgtagtgtaagattactcaaattcggatggaagatggtaaatcaaatgattcgaaatggaaattgggtgactagtagcgcttaggtcgatcttaatcttgtaagttcagtttaacccagaactgtaatgagttgcggaaggattttgtgcaatttaaatctattcaatcagtgaatctcgcttgccatagtgtactattcagtggcagtggcatcgatgatttagatcgtgcaattagaggtggttttggcattacatttcttttctttctccctgttgcggctagagcagctagaataactacaaatattgttcagctttaaagaatagtttccgtttcatattgtaagactttctagcattgtctatactcatatagatgttaatgaatccagacacatatacatacctagattcattaacatctatatgaatgtgggaaatgctagaaagtcttacattgtgaaacgggggaagtagcaaagaagatgaccaggactcctaattaattcggatactggtattatagagttattgtttcagtaggatatgaagaatgcagcatttagagttattttgttgtctggttcttatcttatcatccctataatagtactaccacaagatggactgtattcaaatttatcaggttgattccagcagctaagtaaaagcaaacttcataaggcaattgcgcctttgcatttgcatcacatattcacatggcaacccttaaaatgtatgtatgtctgtacttatatgttgcggtgggtaaacttaggaagtagtcagctgctctatacttccatattgcatatgtgaattaaaagatctgtcatgtcataagtaatcggttttgtttgttctttggttatattagcatcacgggtgtgcatccaattaatattgattactgccttcaactgtaacatatgttcatggctgaattgctgcaatcaaacatcatctattttacaagtgacaggagatgttacaacgaattctgtttacttgatgtgcttctcatctacacagcccagaattatatttgaatttaacttctttgcaagtctcttctttatgtatttgattttctagtttcttatgtaacatatactgataccaaactttcttgacatcataggaagcagatggaatccggccttttacaatgcctcttatgaagcttgcttgcactgcactggaacgagttccattgacacgaaaaaaaataattgataatttgatgaagaaattccaccaagatttggtattctgccgttcacctgatgataatgagctgactgtaggagtttatcgtaagttgtttcctcttgactgtgtatgcaatgacgtccatatgaattcatagtgttgtgagcatataactccatacattttggttagcgatgtcttctcttcatttccctccagcaatgtctttcttatgcttcttgtgtgtgtgtgtgtgtgtgcagaaagacagaaggagaaaattgaccctatactagactgggtaaacactgagtttggcttcaagcctgttgtatacacaagcttttttggtggaaagcaagatgaagggttagctaatgctgtagaaactgttttgaagaataccaccgactttgagttggcatctattgatgctatggcagcagcagcccattccctggtaatccctctcgcaatattcagagggaagctgggaattgagcaggcaattgaattgatcagacttgaagaagatcaccaggttattctgcaaccattgtctatctttattaaggctatttacttttctcttgtcttatggtgtttaattcccccaggttgatagatggggcttggttgaaggaggtcatgatgttgatattgccgatctcaaagtgcaaatgtcatcagctgttgtgtttcttttactttcatggcaactatagttacttatgtagcgaatctacggatcggttggtttttttttgtttgatctcgactttcgagcttgtatcaacttttgtgacgactggtagaataagacttccctgcagatggttaatagggagacagagctccagaatttaatctgttggattctggtgtctcaaacagtatgtttgttaagatataaaaactcaacctgtggaatacttatcattttttttgtggaactatttttgcaagcagcaacgaatgctggcatcttccccgctgccaccctggcctcttggtctatctggtgcgccgatgtggcacctagggtcggcgccgaccctcgagaggcactaggatgtgtcacatccacccaaattcccttatattatgggacgaaggaagttctattgttggctaggataatagatactttataaataaattaacttatatcaaaaccttattaagagctaaggtaaactaatagaccacatacaaaagttcttaaacaggataaaaagtcgcgcaaaacacgattatgtgggtagtctttattgaatgaaataaaagtgcgataatagtttgatacattctacacacacaaattagggggaaaataaaactgtgtttgggatacattttgcacactcgtcggggcatataactcgtcacgcaaatcaagcaactatatatcgagatggaaattcacctttttttaaaaaaaaatggaaattcaatttgtttttttaaaaaaaacatgcatgtaatgatcagatgtagcattcatagagcttgatgtccatctgcagcctgaagtacaccaatccctcgacggcgtcggtgcggagcgtggcgacaccgcgggacatgaagaagtcgccggtgccgccgacgacggagatgtccctcgtcttctccgacatgaggtcggcgcccatcaagttgagcgtgccgcggcgccccgtggagttgaacacgacggagaaggcgaaccacgcgtcgtacaccttcttgctgtcgtagaggtagaccccctgcgcgcgcgccgccgccgtttccctcagcgacgacgggggcggcagcgccctcgtcccctccgtcatcgggtcgtcgaacaccaccacctcgccgaagaaggtgccgttcggcgacacggcggtggccagcgccgtcggcttggcggccgccgccgacgtggagttggcggtgctgttgctgtagtcgtagaggatgtcgtggaagtagagcgtcatcttcttgcacggctcgtcgtagctcctgacgagcctcctgccgccgccgctacggccgccattggcgacggtcgccgaggtgaggctgatgacgaggaagatggcggcgacgatcagggagggattggaccaagtcgccattgctatcttggagtagtaagttagtgcaattaactcagcttaatgagcttaattcactaactagctggagaagctagctactccactccacttagcaagtgttgctggcttaatttgctgcagctgtgatggagctcgagttttgcatctctatttatagaggtgtgaaatggaataatatatgcatgttcatgcctggcaaaatgtgttgctgtaggttctgagatttgctctggtccaacaacaagtatctcaaggtaccggtgctttacggtatcaaatcattttcgaccgttgaatctaactggacagaatgggtactgttagatccaatgatcgaaaatgatttggtaccgtgaggtactggtaactcaaagtactttttgttggatcggagcaaatctcatatcctatagttggttggatcaagagggagtgagatataagcaaaggctactctattatatttatatatttatattgttattcccttctctttactttggactgtttgctcgaatgcttgattctgaatttctgatgctgatgcagggtattgtaacatgttattatgagcagtatggaggtatgcaaaggcttcaagggagggttaccagaaaaaaaaattctgacagatctggtcgcatgtctattaaaatattataagaaattagagtgggtgaattaatgagatcgatgttacatgtatctatagaagagggagtgcttaaagtcgtaaaggaagaaaagtgatctacgcctagccaatcgcttaatctcctgaaacccggcataatagccggatcccggaggtgagcttgtctagaagattagcaaatctgagcagtcaaaaatcattgatgagattagcaagtttttccccatgcaatttaatttgcgccaaaccagatttaaaaacataatataataatatgtatataattaactataatttttattttcatagatacaattatgttttgtatataagaaattctaaaagtagaaatgggaacaaaatttgcaatcgtaagacatatactattataatatgttattttcaaaatcattccaatggcataaattaactgtttaggagaaaattggagtcattcctgcaataatcctacaaaatcctatctcataaacaatctaattaaatctctcttttttatatacaatgttcttgtcaacttttattgtttaatgaaaagaagatttttattttgattaaacatgctaccaagaaggcgtagttcaaaaagcgtcgcccgctcccgcgtcgtcctccctcatgggcgacacgggaggcggaaaccgccggcgccgcctgctcccccccccccctcctccttccgccgcatcgccgctgcccaagcggccatcggcaaagccgcgcggccgcaaggacggcggcggcggggcttcgtcatcttcgtctccctctcccgtcggcggtggagggccgcgcagtagacagtgaagaccgcccagatccgggccgccgcggccggatctggtggggaggccaccggcggagggtcggcgtgaggtggcggcggcagccggcagttggtggtggtggtggcagggattgaaggtggtggggcggcggctgcagttggtggtggatccaccaaattaaatgaaaattgatggctagatgttttgcttttttcttagaatttgtaagatttattaaagcggcacgtggcaatctaggagcgtttgtaggagtctcacgtggtggctttagagtgtttatagggagtttaatggacttttagtatataatagatagattcattatcaacacatttgcataaggatgtttatttagaaagaatttagcatacaaactgtgtatatactcatacagctggtggtctgatctgatgatgggagcagcaacaaataaatctataggtagacgaagctaggagcatcagatcaccttgtcaattggctgatcatttgtctccctgaccaaagatgtcacatcttcactgaaatttgcatcgacaataatgaatagtgtttggtactccctccgtcttaaaatataagcgttcatagctaaaaatacttatattttagaacggatggagtatatattatacgaccatggatggatgcatcatacgtagcactcgtagagcttgatgtccatctgcagcctgaagtaggtgaagccctcgaaagcgtcggtgcggagggtggcgacgccgcgcgacatgaagaagtcgccggtgccgcccacgacggagatgtccctcgtcttctcggcgatgatgtcggcgcccatgaggttgagcgtgccgcggcgccccgtggagttgaacacgatggagaaggcgagccacgcgttgaacgcctccttgctgttgtagaggtagagcccctgcgccctcaccgccgtcttcttcagcgacgggggcagcgccctcccctccgtcacgggtcgttgaacaccaccacctcgccgaagaaggtgccgccggtcgacggcacggcgttggccagcgccgtcggcttggtggccgccgccgccgtggagttggaggtgctgttgctgtagtcgtagaggatgtcgtgaaggtacagcctcatctccatgcacggctcgtcgtagctcctgacgaacctcctcctgctgctccggccatggacggcgacgctcgccgaggtgaggctgagcaggaagatggtggcgacgacgatcgtcagagacgccatggaccaagtagccgtccggcgcccttgcactgttatccaagcttagctagctagctgcagctgcctgtgattaggagctcgagatttgcacttctatttatagagatgagaaatggtcagggtcttcagctatagctgtttgagagggttctagctatttgctttcatgtacaatttagccggtatagctccatttagcccgctatagcagttttagaagctaaccgctaaatatcttagcccgctatttaaaatattgaaaatggtaggctgcatgcatgccaattatctggcaaaatgtctttgcaagctggagttgtttggatcaagagggatagtgagactaccatcatttcacctacaactatttattaaagaaaaaaatagtttgtgaatacattttttatatatgcatgtttaacaatttgaaagccggtgtcaaaaataaactactacgacaaactctaaaatcaacttcaaaattaaattttaatatttaaattttagggtggctgagaggcaaaccttagacttagaggggctgaggcacaactataatattgtcattcccttcgcttttcttggggtttgttgcttgaatattgctttgattccaatgatgatctgatgctgatgctcatacaggttaattactgtacgtacattcatgaacatagaggctgcaaaaggctagcttcaatggagggttaccaaaatatatatattataagaagagttggtgaattacatgaaagataagaaatgttacaaagaagatggatcacctaaaggaagaaaacaacaaaggaattatgctagccaagtgcttgattggttaatttctgcaaaacgccgccacacacgtgcttccacaaaagtccatgcagtcgaaatcattagtgaaatcaggccttaatttcttccttgttgtggaccaatcaatctgatttgcttcatcagggggaggggtctaatggattttattggggagcacgctaataagttcaacagtaccaattactattaacagtaatattgaccctgaaatttctaatttccgatattaatcggtatttcaaccgataatatttggtcactatgttcagtccaacccactaatggtttatttgacctcaccaccctacactttagcccactcatggtttctgaaatcaaaatccatatttgagttcattcctctgctcttcagttcatgcagcaaattgttttctttagcagatcatttcgctcgtatcagacggctttcaacaggtataaatttgcgtctgctcacatgaacgacgaacaaaatgcagaacatggcctgaaaaaaaaagagatcaaaggggatcggagtcctccgacccccactccaagtgcaaagctgcgaaaatccatctgaaaaagaatcatcaaactggaagagcgaagtgttgattcatgtttcgtagcagcagatgattttctctcgcttgtcggtctgtaggatttaaggaatcaaaatttcaaaccatggcatgatgacaagacaagtgtaaattacagatagtgtttgatggtttcagaactgtctagtactgttcagttattggggatggttcaatttcttttaataatggaaattatttacatctcagccatctgagaaaacaaaaattatcgtgtgatgggacaggtccccaactcctctaaaaaagatggctagctgaattaaaagtttaaaaaaatcacataaatattaaggaggatttttttaggtgctacgctatctaaaatgaagtacaaagattacaaaagtatagcatcattgtgcatagtattcccttctcctgtgaggcaggttcaattccaactaccaattacaaattgacaatgaaattaaaattctgaaacttgtagtttttggtacttatcagcatttcactttaaatatttggccattatgttctgagattttcagttaaaacctctactgattcatgcgaactcttccccctacctttaggctttagtcctctcatggttcctgaaatcagaatcgatatttgagttcattcctgtattcctcactcctcgcagttcgtttttttttttccgaataagaactcctagcagttcggcagttcgttgcttagcctcatctggaagactggaatgaccgcaaaataggttttctgttttaacagatcgtacggctttgaacaggtttaatttgcgtctgatcaaaataatgaacgaagaaaaaaaattcagaacgttaactgaaaagaaggagaccaaaggatgtcggtctgtcggagtttgaaactccaacccctttcccatcacaaactccgtctcctcgctcgctccggtcgctccactcctagctagtggtggaaaaaaaaaaagcttaggctcatgagctcagctcgggcttggctcaaccttggttggcttagctcggctcgtaagcaaaacgagccaagccaagccttcttttcatctcattgctgaaatgagccgagcccgagctggcttgcgagcaacttcttttggctcgcgagcctagaccatcatgtgtttatatcgattattttattttttttatggagatattatttgtcaacttgaaatttaccattaagattttgaagaattgaaacttatttaaattttacatgttgatgattgttcttgcttttttttaataattataaaatatatatgaagaggtgtttcaacatgaatgctagccaggaaacgagccgagccgagccgtgctcaagttttacttgtttccctaactgagtcgagccaagccaagccttgtttgttgcgagccactgcgagccgagccggctcgtttccaccctttcgttgttccttactccttagaccttaatcatcctgcagagaagttcagattggaggtgttgtccaagtgcaaagcagcgaaatccatttgaaaaggaattcatcaaatatttttttccttccgtttgttgaaataactgcaaattgcaatttattaaattcttttattagatcatttcacccgtatcagacgaattttaacaggttcaatttgcgtctgatcacatgaacgatgaaaaaaaattgtagaaaattaccttgaggaaaaaaaaaaggagaccaaagaggtttggagtttaaactccggaccccactcctatcgcatactgcgtctcctttgcaggggtaccaagtgctaagcagtttagagaagcgttgattcatagcagcagctgatatcctctcgtttgttggtctgtagtgttcaaagaattaaaatttcaaatcatggcaagcccaaaagtgtaaatggcagacgatgtttgatggtttcataactgcctagtgccactgcttgggaaatgttaattctcttcgcaatgaatcaataggagcactctcaatataatgaatcaggctggaatctggatgaatgctcctgttaaacttcacaaaaaaaatgttatatgcttctaaatgctcagtaaatcatgctactctgtattatacactgaacttgggttcaattttcagcaaagtttgcactgaactttgattcagtttgttttgactcctccagtaagaaaaaaagatgcacccaaattaaattgccgtaaggaaagttgctatttgaaagtgatcatgcggttctcagttgatcgggcaattgactgatgaacttgcggcgcaggcacgatcctcaacgaccaatttattagtggattatcttatcccaagaataatggagaagtattatattagatgaaaatgattcacatgcaagctttaaactaatgcacaaaatgattgctcgccaccgacagcgcaaaagaacagccggcggcgtcatcttgtcagtcacctgctcacctgttaatattcagagatcttcagttaaaccctctacggactcatatgacctcatcccacaatccttttagccatctcatggtttctgaaatcagaatccatatttgagttcattcctctgctcttctgttcagtgatctactctcatcttggaataacactgaaaattgcatttcctctttcttataacagatcatttcatccgtatcagacggctttaatttaaacggtatgaattttgcgtctgggcacctgaacgacgaacaaaagaaaactgcagaaaataagctgaaagagagagatcaaaggggagtcggagtttcatcctccgaaccccaccgttttatgctctagttgtgttttgggcttttggcagtgttagctctgttcttgccatggatttccagatgccgcaattgactgatgaacttgcggcgcaggcgcagccacgactgactggacaggttcagcacctaaacagccactgtcctctaacaattccgagttcaattttctactaaagcaatttcttactagtacttccactgtttgaggacaaattttttttctctcccatttatcccaaaataaggcctcagttcttttttctcaattccaaacttcaactttcccgtttaccgttagcacaccgaaatttgtgaaaaatactccctctgtcccattttaagtgcaaccataagttttcgcgcttaactttgatcgtccgttttatttgaaaaatttttataattaatatttttgtagttataagatgataaaatatgaatagcactttactcgtgacttatgttttcaattttttttaagaaaatttaaataatacggacgatcaaagttggacgtaaaaaatcatggctacactgaaaatgggacggaggaagtaaagaataaatgtattaggagtagataaatacctgtattaggatttgatgaagcgatgattattttaaattttcttttggttttggttttgtattgatacatgtgaaatggatgcacaaatattttttttttggaacgtgtcccatcgccgacagcgacacgttagtacaatcactgtactcctcatttacgggacggttattacgtgcccatttcggaaacagcgttgcgtgatcacgactcacaaatccacaccgaaaaagcgagagaagaaaacgagagtgttcgtcaagctcgcgaatgggagggaagatgggcaaggacgtggccgccggcggcgagagcaaccgccgcccgccgccgccgccgcctatgccgctgggcctgaggctccagctgatcgggctctcggcggcgatcgacgcggtggagcggcgcgacgggacggtcaaccgcgcgctctactccgtcctcgtcgaacacctgatgagcgtccgcgccgacccgtccccggacgccgccaccggcgccgtccgctccttcgacttcaccatcgacgccgcgcgcggtctctgggcgcgcgtgttcgcgcccgcggcggcggtgcaggcggcggcgccgatgccggtgatggtgtactaccacggcggcgggttcgcgctgttctcgccggcggtggcaccgttcgacggcgtgtgccgcaagctgtgcggcaacgttggcgtcgtcgtcgtctccgtcaactaccgccttgcgcccgatcaccgttaccccggcgtctacgaagacggcgtggacccgcttcgctttctcgacgggaacgggtttcccgtgccttt

SEQ ID NO: 22073 - DNA, 2954 bp, Oryza sativa
cgctaccccgccgcctacgacgacggcgtgaacgcgctccgcttcctcgacgggaacggcatcccgggcctcgacgggacggtcgtccccgtcgacctcgccagctgcttcctcgccggggagagcgccgccggcaacatcgtgcaccaagtggccaaccgctgggcggccacgtggcagcccacggccaagaacctccgcctcgttgggatgatccccgtgcagccgtacttcggcggcgaggagaggacgccctccgagctggcgctcgacggcgtggcgccggtggtgaacctccggcggtcggacttctcgtggaaggcgttcctgccggtgggcgccgaccgcgaccacccggcggcgcacgtcaccgacgagaacgccgagctggcggaggcgttcccgccggcgatggtggtgatcggagggttcgacccgctgcaggactggcagcggcggtacgtcgacgtgctgcggcggaaggggaaggcggtggaggtggcggagttccccgacgccttccatggcttctacggcttcccggagctcgccgacgccggcaaggtcttgcaggacatcaaggtgttcgtccagagcaacagggcggcgcgcgccaccgcctgaattgagattcgagagtttgatctgcttcgtaccgtacacgcgtcgtacacttcatatacttgagattttgaattgggatttctgtgattcaaggtgaaagtttaaggccgcagttaaaagtttcgtatgattttatgttgaaaactgtataatttgagtatgaaggttttaagttttcatatgaaagttttaaatttgaatttgaacggtttttaattcaaaaatgaaaaattgaggtcacagctaagtgtcatgtgaaagttgtatgaattaagatgaaagttgtatgatcatgcattgccaccgcgatgaaattttggcatttcatacgaagcgagtgtaagatcacttggctaagtttcatgtgttgaaaacatgctcaccccaacatgtcatagacttactagggtgttcgtatttgcagctaactatttttaccctttttttaatggtaggtgtcatacccgctttatactgaaagatgttggatcagtctttggagatgttcatacggatagagagtgggtttacaccggtgcagtccttggagatagtaaggagtaagtgtgggtacgtatgtaagtgtttaccccctccgtccaaataaaccaatcctaactattaatctggatatatgtgtgtccaggttcatttttagagtttgttttttttttgacaaattagtatgtttgtaccgtgtttggcaaaaataaaaaataaaaaaaaggcatttggtatagaaattatgtatgagtcgacgactcgtaagagtacatacctccaatagttacgcattcgggaatgtattttctacactcaggtgtatgcatgtagtttaaatagttatataaaaatttcataaaatttgataagatggactacgataatataagatactacaaacatgtaagtctaaattcgatatacacatgaaaaacaaaaataataaattttatctgcgttgtacgatatcgattattattttggtttatctagttgtagatcaaatataatcttgcatgtttctgtatagatttatatcatcgtaattaatgttactaaattttttctataagtatttaagtcgtatgtaaatgatgggtgctatggcatttaggcgtagaaaatccttgttcttacccatccttactcacactctgtttttcatcaaacagtgtaggcctagtgtaattcaaaatcagcctaatactatctgggatttttcaggatattgctcctgttaaacttcaaaatcccatgtcagacgcttctaaatgttcagtaaactaagctatagtacgcactgaacttactgaatcagcaaaaaagattaagttttcaatacttaagtcaagaatcacctgaatttgccttgcgaaaaggaagagagatgtgataactgataagcgtacaaacaaattgcgaccctcatatagtcacatgtcgtatgtgttgcttgcacccttctcacaacaatcctacggcgtgagaccgcaaagatagcgtctgcgttatcttcaagtacggagaattggcgatctccataactccatgtcacctctatccaggccttaatcgtaatatcaatttcatatcactttgaaagttggtttcagaccaaggaattcctaaacttctctgaattttgggcctgcctgaacactcactgaaagacacgcttcctgaaccactgaattttgtggctgcttgaacactgaaacaacactttctgaacctttgaattttgtggctgcacactgaaagataaaattcctgaacttctctgaattttgtttctgaacctgcatttttttatcagtctcccaaacgaaaaggtagaaccgtcggagtagccaagaaatggcgggcgcgcacgggcggcgccgccgggtggcactgccgtggccggtgaggctcaggctctgcgttttcgaggccgccattgacgcgacgcagcgccgagacggcagcgtcaaccgtttcctcttctccctgttcgaccgccgggcgccggccgacccgcggccggacgccgccggcgtcagctcgacggacatcaccgtcgacgcttcgcgcggcctttgggcgcgcgttttctactcgccgtcgccgtcgccgcgccccgtcgtcgtctacttccacgggggcggcttcacgctgttctccgcgggctcccgcgcctacgacgcgctctgccgcacgctctgcgccgtcgtcgtgtccgtcgactaccgccttgcccccgagcaccgggctcccgccgcgtacgacgacggggaggccgtccttcgttaccttggcgccaccggccttcccgacacgttggcccg

SEQ ID NO: 22074 - DNA, 5574 bp, Oryza sativa
  unsure (1)..(5574): unsure at all n locations
naatacagccgtgcttcaacggacaagaagcggacgtaatccgagcgcgcgctcgacggcgtggcgccggtgctgaacacgcggcggtcggacctgtcgtggaaggcgttcctgccggagggggccgaccggaaccacccggcggcgcacgtcgtcaccggagacgacgacgacgacgccgaactgcacgaggcgttcccgccggcgatggtggtcgtcggggggctcgacccgctgcaggactgggaccggcggtacgccgccatgctgcggcggaaggggaaggcggcgcgggtggtggagttcccggaggccatccactccttctacttcttcccggagttcctcgccgacgatcaccggaagctcgttggtgaaatcagggcgttcgtggaagaatgcatcacgtccaagcagcccactgcttagtgacgagggcctcatcatttgacctatcgctataaaattttaaatttaatttcaaagttttctcaatgtagtttttttttatttagcttttaagtcgataagtaatggatatataaaaaaatttcattaattatttttgccgctaagctcttgccaaccaatggggactatgtctcgttggaaattatcggagtaacatctttagtttgttttttatgaagaaaaaagtgaaggaaaaaaaatgatgctttagctcatctcagcaaaaaaagatccaactatagtttgttagtttgtttttagttgcgagatgtacaagttaaattttaaattatatatttataaagtgatatattacatgttaatacatccttttaaacttttttataactatgtgagtatatatacaataacaataagaagatattcctcaagagtccccaataggcagccatgcatcgccatcaacgtaagcatggtcgttgcgagagacttgagacgttaaccacaaccacaaatgtacgtatcagataatcagatacacatcattgcaaaaggctactggattaattaattatatccttcaatcaaacaaagaaaaatcgctacaaacgtgtggctatgtgctcatcagttgagcagtacacaataatgagattggatcaaaatcatatcgcattgaagctattgggttgtacgtacgtagtaccaatgtgttcaactataaaacttaaattgaagacgtactaattatactcaaaacaaacagaagcaacggagctatatatggtcgtatggaattgcattaaaatacctgtacatgagattatgagaggtatcaagtgccaatttgtcaaatttgaacgcagctagagttcattggttcgacgatatggtcatgactcatgaatgccaatttaggctaaattcggcgctggggacttaaattctaggtagtacgagtagttacacggtatttcaaatttctactatcaaattggaatattcacgtaaaaatcaagggataattttggtcctgtgtggatcccaccccaaatcccaccgaacgtttaaacacctacatgaggtattagatatagactaaaaaataactaattgtatagattgtgactaatttgtgagatgaatcttttaagcctaattgttccatgatttgacaatgttgtgctacagtaaatatttactaataacagattaaataggcttaataaattcatctcatggtttaccggcggattctgtaattagtatttttattagtgccgaacatttatggcacaccgtatataatacctgatgagacacgccgaaactttactaaacaccccctttatttccaaaaaaaattaatcggttcacctatatatagtgtcctctggacactgaaatgactcgcacagaaaccggcgaaatggggcacgagaaggagcaagaaacggccggcgacgagctccggcggcccgagccgccggcgttgccgtggacggtgcggctccagctcttcgccctcgtcaccgccgtcgacatcgtgcagcgcggcgacggcaccgtcaaccgctttctcttctccctcgcagaccgccagagcgccgccggggcgcgcccggacgcccacggcgtccgctccggcgatgtcaccgtcgacgcgtcccgcgggctgtgggcgcgcgtgttctcccccgcgagcagcagcgccgtggaatccccgccgctccccgtcgtcgtctacttccacggcggcggtttcgcgctcctcaccgccgcctccagccagtacgacgccttgtgccgccggctctgccgcgagctccgcgccgtcgtcgtcttcgtcaactaccgcctcgcccccgagcaccgctaccccgccgcctacgacgacggcgtggacgtgctccgccacctcgccaccgtcggccttcccgccgacgtagtagcggccgtccccgtcgacctcacccgctgcttcctcgtcggcgacagcgccggcggcaacatcgcccaccacgtcgcgcaccgatgggccgccgccaccacctcctcgagccgccgcgtccgcctcgccggcgtcgtcctgctgcagccgttcttcgccgccgaggagcggacggaggcggagctgaggctgaacggcgtggggccggtggtgagcatggcgcgcgcggactggtgctgaagggcgttcctgccggagggcgccgaccgcgaccacccggcggcgcacgtcaccggcgagaacgccgagctggcggaggagttcccgccgacgatggtggtggtcgaagggtacgacacgctgcaggactggcagcggcggtacgccggaatgctgcggcggaatgggaagccggtgcaggtggtggagtacccggcggcgatccactccttctacgtcttcccggagctcgccgactccggcgagctcgtcaaggagatgaaggcgttcatggagcgcaacgcgccgcccaaatcgaatgcttaattagaagcgttttatttacctttggcatttcaaaatgttaacctggactgctatttcatatatattttgctgaaatttgatcaagttttgcgatgatgaattgctctgtgaaataaacagattttactttttttagataatgaaataaaacatctcggcttttgctcatcagagctacagccaattattataaaagtaacacccaaacactgaacgtagtttaaatgaattaaacatacctaataaaataaaaccgattttactagcagcgtattttttattccgatttcatcgcatggatcccatgatgctgacggagacattaacctaccatacgattctgttcacgcggagcacgagcacagctgcacatttctgacttctttttgacgcgacaagagaaaaagagagagagagagaggaaggctgtgttttcggtgcaaagtttagattttggttgaaattaaagatgatgtgactaaaaagttatgtgtgtatgacagattgatgtgatggaaaaggactgaagtttggattcactttagatctaaacacacagccttgaaacatgataagaattactttttgcgacaagtaaaatcagtctgacttttgagacgtacgcgacgcattacacgtcgatagaaaaaatcaaattcaaaagctattttgaagaacacttttcgtgtagggttctatccttttcttacaggctctcgttttgagcctataggattagattctcctcgttttctgttagcacgcttttcaaactgccaaatggtatatttcgtgcgaaaactttctataaagaagttgttaaaaaaatccaacaaatttattcataaaaaagttatatattaataattaattaatcatatactaatcgcatttctcgttttgcgtgcgactaaaccgtccaccgccccagccgaaacaatcgcacccttattgggccagaaaatataatcattgtgttatcatacaattatttcgtaagtttaaacaacttctatttccaactttagtcgtctattacacggtccaaaatgaaacacactcttttgtttaatgatattttctaattaagtagagggcgttttgtataaaacaaatgtttaatgatttttttcacgtgtgccaaagtcgaacactttaggagcgtatgctactacaaaatcgatcttttatggcgtcaccttattattttctccggcggccatacgtgaaaactaccagcgacaatggggctatagaccgccagcaaaaatggatcttcgctggccaacgaaagagtatctttttgctggcggctcactttagcgatttccactggcggttgaagaggactgccatattaaaagatcagctctctccaccgcacctaactctttactccctctccatccctatcgggacgcacttctttcctacccctctccttctccttccctgcagatgcccaccggcgtgcacccctcctccttcctcactggggcacacccccctcctccgtcttcaccgacggatccagcggcaacgaatcaagcgggtggcagatctggtgacggcgagtcaagcgtgtggtggatccggcggcggcgactttcgcgggtgacagtctggtggagtcaaggaggggaggttggtggcagcaaggcagcatatggagcgtcgggtggcagcgccccactcccccttccttcccaaatctggttggaggggaggaggccaggggcggcggctgccccactctctcccctcacctccctctttttgatttggctggaaaggaggaggccggtggcggcgcggcaacaagggggagagcggtgcgcggtggcccctcccctccatgatatgtgggtccaatgtcaaagagttaattgtcacatttaaaagtgacactcttaaggataaaataaactacacggttctgttcacgtggagcacaagcacatcggcacatttcagacttttttttgtcgcaaaaaaaaaggggaaacgggacgagaattaaatcagtattaaaacgagagcgatcgacttacacgagtatatagagaaactaaattcaaaagtacagcagtacattttgaagaacatttcgtacttttattacaggctcttaatgggccgagataccggcccatatcaacacaaggcccacataatagcatttgctcgagaggccgaatccgaattggaataagttcacttcatgaccctcaaaagtgatcgaaatctaatccatgaccctaaaccacaaaaccggatatctcgacccctaaactcttaaaaccggtgcaatttgactccctgggcggttttggagggcggtttcgctgacgtggcgcctacgtggcagtattgactcggtcttcttttccacgtggcgttgatgtggcgcttaggtggcattagaaataaaaatatgcctgggatcctctatctccctttcttcttcctcccttctctctttctttctggggatcctctactgtcgacttgccggctgcgcgcatgcgatatcaatcaaacctctttggggggngggaagaaagatgataagtatataaatatttaacaaaaaactaggatatatatagaagcaaatatatgataaagctataaaatcgaactga

SEQ ID NO: 22075 - DNA, 3538 bp, Oryza sativa
gggaaaagaaaagaaggcaataggacctagtaaggagccaattaaggataagcggtttcaaaatcggctttagaagtaaaattgtaagggtattaaggtttgggggtcaaaatatgcgttttgtaattttgggtaatggattaaatttagatcactttttggggtcatgaagtgaacttattccatccgaattcgcaaaggaaaccaagaagaacatggagacctttctgcccctatttatggcagaaaaaaaaaatccccaagcaatccaagattaatccagcatcgatcgaaccaccgccgcgacgacggagatggccgtcgacgaggtcaacaacgtcggcgaagagaagaaggaggagaagaagctgaggaagtggaggatgccacaggagcagatcgacctcatcctgtcgtggtcgccggagccagcccggccgccgcgctacgacgtggacatcggccgcctgcagatcagcgacgcgctcaaggagaggctgcggcgggtggacgccgacgacgcggtggccaagcgggagatggaccggtaccacaaggagcagcaggagtgggtcaaggccgagctcgccgcccatggctacgtctagtgcgagatcgacgacgacgacaacccctgcacctgcggctgcgcctatgctgccgaccatgaggaggaagaagaagaagaagaacaagaaggagacgatgattgttatgaggacgaaactgaagagaagaaaatctgttcgggaaattagacggctggaacctcgatcactgataatttctgcattatattttttaatatgattatgtgtgattaatactagcctgctgtctaccagttttaatagttaaacagcatgattggaggtttcttggtagccatggctgcttgtttgaactttgaacttgaacgttggggaagaatagggaggatgcgttggtgggaagaagaaagagaacgacggtgatgggcttttgatgggccatatggagacaaggtgtcctcgtacggaaaaagtacgtccgaggtccctcatcttgtcaccgaattacaaaatcgtcactcaactaaaaaaaccagatgtataagatccctcaacttacaaaactagatcattccaggtccttagacaacattgatcctggttttgtccgacatgacgactgagtcaccatggaacccacgtgaaccccacatatcaaggtgaccacggcattaccctctctcttatcctcttctctccctttctaccctttctcgtttttcttgtcgtcatttgggtgggctggctgtccggtgcggagaggaggaggtccgacggccgacgacgagcgacatggcggcgctgggtagagggaagcgtcgggagcgaaggaggctggcgaggtgaggtgggagaggaggcaaccacggtgaccataccatggaggagggcaccggcggtgaataggagctggatggcgcagaggagatgggcggggtcatccgcggaggagtggagaagcttgggagagaaatggggaagggcaaggtgcatacctcgccatcgtcctcatgtccttccttcctgtctgacgcaagaaaagagaggaagaagagagaaaaggaataaggggatctgatcaattggcccacccatttttattattttataatttgtttcttgatgaaaccgtcacataagcgccatgtgagatgaagatctagtcgaaggagccacattggtgccttgttagctgaaactggggacaataccatcgaaggattttgtttgcactggttttaaaagttggaggatacattgtatttggttttttggttaagggatgattttgtaaatcggcgacaagagtaggtatctccggtgtactttttcctcctcacaagtcacagagaagtatttggtgggagcctgggccggcacacatgggcgcggcggagaattcacaaaggaaactaggagcccgaggccgagtagaacacgggcattctggcccatttatggcgtggtcccgtagcgatccatgaatccatcagaaaaatcccaacaaatccagattctgccggcgatgaactggagttggtcgtcgcaagccgaagggatgaagaagataatgaagaagctgaggaagtggaggatgctgcaggagcagatcgaccgcacatcctgtcacgatgtccgccccgcgaccgtgttacagagcgaagatctggcggcgagcgaggcggaggaggaggcgctcctgcagcttggacgccgacggtgcggaggccatatatacggcacctgaacgagtactggaaggagcagcaggagtgggtcaaggcggagctcgctgcccatggctacgtcgagtgcgagatcgacgacaacggcgacaacccttgcacctgcggctgtgcacacgccggtcgtggagaagacgaagaggaaggctatggacagcgactgtggatgcgatgacgacgatgatggagaagatgaacgggaaagcaaccgaagagacgaaggaaatttgagaatttgcgggatatggacagagaatttgagctaattggacatgattttggccaactaggattacatcatattaccattaccaatgttcaaatattcaagggtcaaaatatatctacacaataaagaacagaagcttttacatatggcagaaatttgcaactcttgagtcatctgcacttctctttcagtactttggcactcttattacagtttgagctttatcaaacaataatttatactagtagtaaaactaaacaaacaaattgaaataaaatataactccacagccactgtgccgtgtgcaacttgcgaacaacttgtccttaaacattaattaatggcgcgacagatttgtcgcattggtcacatcgaagatcaaagcaccacatcactcctgcaattcactcaaaaagaaaaaaaaaactctcctccacacttggtgcagcaagagatggccggcgttgaccgcagccgccggtcgtcgtcgtcgccgccgccgcttccgtggacggtgcgcgtgcagcttgctgcgctctcggccgcgcaccggtccgacggcagcgtgcggcgcctcctcttctacctcggcgacctccacgccgcggccagcccccgtcccgacgcggccggcgtccgctccgtcgacgtcaccatcgacgcctcccgcggcctctgggcgcgcgtgttctgcccgcccacgaacacggcggcggtgaagctcccggtcgtcgttctacttccacggagggggctttgtgctcttctccgcggcgtcgcgcccctacgacgcgctctgtcgccggatttcccgcggggtcggagccgtggtggtgtccgtgaactaccgtctcgcccccgagcaccggtttcccggcgcctacgacgactggctcgccgcgctccgctacctcgacgccaacggcctcgcggaggccgccgtcgagcttggggccgacgtcgacctctcccgctggttccttcgcggcgacagcgcgggcgggaaccatgtg

SEQ ID NO: 22076 - DNA, 2069 bp, Oryza sativa
aatcaatcctacctataaacattgaaaacatgctttaggttcgtaggtaggattttttttcgacagagtagtatgcaatagacttaaataaactagctagtggggttgtatgatttctgtatgtatcaagtaatgaatcatgagagagatactactcctagggcctgtttgggatctttaaattataagaagcagctgtttggtagctagtttttgataatctagaaaagctctgaaacccagcttctccagcttctgattttttagttcatttttcagaatttgtaactacagattctcagaagttgtggactgtttgaggcaacttctagcagaatcagtttttaggaaaaactgcagctggaacaagctcccccaaaacaggccctagactttttccttgtgagttgtgagtttcgtattcgtttttgtttttaccgttttgccattttctccagatgaatttctctgaactcctgtgtggcacgttcttggcgagtcctaggcagcaactatctgccatgcgtgcccagttacccacctgatagacaagaagtgtatcacacgcagtgtcctggactacgtagagtctttccattctggtagtagtcgcttgcaaggagattgagacgaagacgtagaggagatctcaaaatatagcaacctgaaattagatgagatacataatgatttcatgaatctggatagatttttttattcacattcgtattcattgtaaaaagatacatcctgttcggtctcagtttactatatattttatgctgaaaagaatatttgagattagagtgacctttgagactctaggacgccagtgacattgaatgtatgtttgatatttttttaaaaaaaaagttacaaaattatttattttgttatgacttgtattgtttattgaagttgttttaagtatgatttattatattcgcatatttacataatttttaaataaaatgaatagataaatatatatgccaaaaccaaaagtactttaaatttagaccgtgagtgctctaaatatgtagtaccctatacacatgtatttagctttgcaagaccatcatataccatttgtacggaaacaactctcgtgcatatagcggaagtcctaaatagataagaaatgagtcacataaaataaatacagagccctcaaaaccgacgatcgtatctatgtttatcttcttagttctacttaaaaaggaaacacctaaaaatataagtacaagatcccagaagtgaaggacaagcctaataaaaaaaatatagagcaacctccaatctcgccgaatggattctcgaggaagccaaaaatagctaaccaacgactaaccatactcgagctttacattgatacgctggtacactagattaggttattctctactttgtacttgtgatagattgatatacgatggcaacaccagctccggtcaacagaaataatgctattactcgtcatcaagggtctacctatataaaaatccctttccccttgctccatttacagatttgtttgtatcctcctaacaatcaattcctacgtcctccaaacaatttgtatatgaacgaatcatgtgattgaggtataacccattgacacacactttactatagtaatataatcgtatatcgacgaaagggcaccaaatgcaagtgggaaccattatgattaccaaaggcgcgcaaataaccgcagatggattttggcctcccatgtgaggcctccattcttggcttttttttaaaagaacttaaaacttgctctatgatatttactcatcttcaaggttgttatttatttctcatcccatcgagtattccttaggaatgaataataaaatttatttctcgtgtactgcctctcacagtattggtggcgtatgattgcgttgttatgcgtgttgtcatatactcctcccgctaaaaaaaaaacccaacctatgaaggtgggacattacctagtccagcgtatccggacatatgtttgtttagatacgctggactaggtaatatcccatctctaattagattgttttttttttgggacg

SEQ ID NO: 22077 - DNA, 1528 bp, Oryza sativa
cgcttgattgacattcgagctcggtacccagctcgcggcagatgcggcggcagagcctgtcgtagtagcaggaggcggcggagaagagcacgaagccgccgccgtggaagaagacgacgaccgggagcgcctgcgccgcctctcccttcgtcggcggcggggagaagacgcgcgcccagaggccgcgtgaggcgtcgatggtgacgtcgacggagcggacgccggcgcggcgcttggccctgacgtggatgtccaagagggagaagacgaggcgccggacgctgccgtcccggcggtgcccgagcgcgaagccggccgcctgcacgcgcaccgcgcacggtagcgacggcgagcggcggcggcgcgtcatgtcagcgtcggcgggcatctctcgctgcatgcgtgcagtgcaccaacgcaatgagtacatccgctgcgttgtagcgtgtgcattttatatctgtgacccgtgcaacattgcgtacgtgtacgtctctgttgttcaacgaaaggttgtacactgttgtccgtcccagtcacatactcctaggtcacataggatgtttagatactacctccgtccaaaaatacttgtcgttttgtgttttttacataacttttgatcattcgtcttattcaaaaattatagagttattgtttattttgtttgtaacttgctttattataaaaatactttaagtgtgacttattcgtttttatatttaccctaatttttaaataagacgaatggtcaaaggttgcaagaaaaaaatcaaagcgccaagtattttgggactaatgtagtattaaacatacactacttaataaaactaattatataaatgagtgttaattcgcgcgacaattttttaagcctaattaattcataattaacacatatttattgtaacatcacataggctaatcatgaattaatttggatcaataaatttgtctcgcgaattaactaggatagaataagttttgtcaatagcttacgtttaatactttgtacaaacatccatccgatgtaacaccatccaaacagggtcaattatttttgttcggttgcacactctctgtagtcctggtgcggatgatcggcagacggcagctgcagaatgcgtgcacgttgtaaaagctttagatttttgtttttgttgatgcaaagcaagcaggatccaagactccagttccctgcagtccgtagatgactgcaacataatcagtcacgttaagtttgagcgatttggaactcttagccaatcatgtgggtaagccaatatttcacttcaaattttaagcccgtatccgaagttcccaacaagggagcctattactaatccttccgtcctaaaatataagtatttttagactttgacatagtctatgagatgctattttgaccaataatatctataaaagtaatatgttttaaataaaaagagttacattaatgataaatttagtaacatcaattttacatgattgatcctttttattcttttgctataatagtcaaagttac

SEQ ID NO: 22078 - DNA, 4592 bp, Oryza sativa
  unsure (1)..(4592): unsure at all n locations
ctcgctccgcctttgtacgcttggaatgtgtctaacggtgcttcgccggctcaatgcgagatgacgctcggtctatcgtcccgctcatcgttcttcgtactctgggcgctccgttctcatcttttcttcttcttgtctcccannnanacaagagcattgaatcaaaaagttttggcattatgtgtagataggacattttaaaacaaccaccagctaatgaatttagtatggtacataaactctatggttgagccggactatcatgttaccgggccggatgcccttgtcagtgccaaggcatcgcacaatcatgaacatatttgagaaagagcccagaatccacaaggatgtttttgttgctcccagtgcagctgtgattggtgatattgagattggacatggatcctcaatctggtatggctccattttaagaggtaaactcttggtcgatatacactgtagtattattacacatgtgagtaagcatgggctttgtcttgataatttgtttcccatttctttctttgttacaccttgtttactgtacatttttgtttttggaataaacttgcttctgactgcagtacactcattgttatgatgaatggtactacatagacaactgacagaaccaccagtcgtacggagatgcacagttttatcaaacagctctagtacactcatcttttcattgttgggctctcaactgacacttcacatgaagttcgagtttttaacctgcaacgatgatgtgttgggctctcaacgatgatgtgggaaggttctcccaaccataaagcattaagtactacttcctccgtttcatattataagactttctagtattgtccacattcatatattcattaatgaatctaaacatatatgtgtgtctagattcattaacatctatatgaatatgggcaatgctagaaagtcttataatatgaaacggagggagtaacatactagtagctcttaagaaaacaattaggtgagaatggttttgaccaatgcctgtatggtctcctttacaaccaaatccaagtagaaaaaggattcaagcagcttcattcacatgataacgttcctcctacaccatatgatcttttatcatggtgtgaggcatttgtgctgtcatacatactgggttaaccctagcatattgatatttaaagtttcagtaactatagtgttgaagttgtactttggatacttccacggtgcggtgataaccattttagctccttttcattcttttgtcctcaggtgatgtcaacagcattcatattggagttggaacaaatatacaagacaattcccttgtacatgtttcaaaagctaatatcagtgggaaggttctcccaaccataattggaaacagtgttacaataggtcagtagagcacttcctatcttaattcgtaatatacactctgatatgctattgaagttgtgatttggcttttctggaagacattaaccacatggcatcatttatacctgataaaatcgtaaaaatatggtttccattgctgctttgtgattgatttacgagttaaaattctgagcttcatttcgcatggactattcactgtgacactgtgctatgcacctacctaaacaataaagcttctgccaggtcacagtgctgttctacacgcatgcatcgtcgaggatgaagcttttgttggtatgggtgccactctgcttgatggagtggtggttgaaaagcacagcatggttggtgcaggatcccttgtaaagcaaaacaccaggattccttctggagaggttaccttcctattttcttgctaagcaagtttttttttttcacttgctatatgagaaatgtgcaatcagctgccaacattttgtaatgaggtaattctcagagatgctggtatatgattacaaaattggcatgctctttgttcagaaaaatacctaattgttttcgaataatgcaattgaatgattctgaggtagaggtttagtctgcatttttcccttaatttacagttatgatgtgttgacacatattttgcatgaatttccttatttataaaactgtaatcggggactggaggattactaaacaaagctgctggctgcatgtttatactgatgtccatgttttatgttccacacttgttgtgaacagctgcaagatttaaatatgctttgtatttatattttatggttaagttaatacattgcatggctttattaaaccatatcgtttcctgacattgctaggtctgggttggtaatcctgccaagttcctaagaaagcttactgaagaggagatggcgttcattgcacagtcagcaacaaactatatcaatttggctcaagtccacgcagccgagaatgccaagaccttcgatgagattgagctcgagaagatgctgaggaagaagtttgcgcacaaagacgaggagtacgattcgatgctcggcgtggtccgtgagatcccaccagagcttatcctcccggacagtatcctcccaaacaaggctcaaaaagctgttgctcactgagtgttttcttaaagctcccgcttgggaagctttgctgttattacatgttgacttgtttatgacagttttgtctgtccgtagaggaaaaggaagtcaattggttcccctgcttttgacttgcttgcttgatagatgtgaagttcaagttatttgatactaaatagctgtagtgtgaaaaagtcagtgagctcagaaagtagaaattttgaggattttcgtgggtgcagaactaatttatgcaaaattcctgtaaaatttctgcgttcaagaggactagaggagtcatggaagacgagcaatctgaaggaagatgctccctgctgatcagtgagtaataagcgagctatacaagcataggccctgtttggaacattggtttttaaaggatttttggaggtttgcaatcctttggatctttttttccctatgagcttgtttggaacaaaggaatggggttgttgaattccttcggaaaacatttcctccattttgttaggaaatataaaacatctactttgatccaaaggaagattccctttgcttcatccttccatccgtctctctctctctctctctctctctctctctctctctctctctctctctctcttttttcatgtaaacagcctaaacttcttctatcatgtgttttgaatttcttagttatcaactttacactatatcatattcctgcattttttttctattcatgtgttttcttcgtttatttcaaacgaggccttaaaagagaaaataatcctatgagaccagtttttttcaagtatggattaattttacctgctctcccaggattattttccagcttaaggccatgtttgattcagcttagtattattataatctaaattattagaagtaagctgaaataaacagatagcttattataatatattattataatctataagtcaaattactataatctggtaagccactctaaaggtgctttttttagattaatgggtggctaacagttaacaaacagataataatctagagaaacaaacagctagcagcttattttatgttagcttattataatctagcttatagtaatctagttcaataatctagattacaataatcttaagctaaaacaaacagggcctaagaccttgttcggtttgagggagattgaaggggattgagggagaataattcaacaccacaataggtgtggaataatttccctcgaatccctgcctcatgggaattgaccgaacaaagccagttgcttccaaggtacagtcacaacaagtggcagtcttgcccaaaggtcatcttggcatcttgccgaggaccggccaagggccaactcacccagtattgagccctgcgctgcacggcaccacaacagtgatgacgcttcacgcacgttccgcggtaaacttgctcttaggagagctttacatttcgaaaaacagctattgagaattaaaaaaactgagttattcaagagaggtcgagattttatgagaagcaccatctaccataagctctccaaacagagagccaagataagcagaaagggggatagtccattatgtttggtaaacagtttcatgaacaaagttacatacactagagtactgacacagctacaacatgcgtgggtgtctctctctcagaaatgagaaatataatgtaccaactaaactagactgacccgcaaggcagtaaaaacgatgccttggcgaacctactactactaaactacccctcactacaatacacctcacagatcagatatgtattagagtatctaactacaacgacacagatgtacaatgattccaaacacagggtctgagctcgtacaagaggttagctggtacagttcgtcttcatcaatcaccagtgagttttatccccaggaccagcaagtatgatctgcattcggacaagcaaagttaattactccgtgatcattgcgcacaacacagtccaaaaaaaacgttggggaagaaacaaaattcctcgagctggagcaacagagtgcgacaacttcttgttgtttttttcttccca

SEQ ID NO: 22079 - DNA, 6553 bp, Oryza sativa
  unsure (1)..(6553): unsure at all n locations
cggccattgattgcgcatcttgacgcctgcagncgactctagaggatcccccatctacaccgcctctcataccacatagctgaaatgaacaacaatgcaactcaaattttagactatatcatagtccaatgatgtggaatgaaagctatcatcagtgagatggaagcaagtttctacaccatcttatgagtgctaaaagtgttgcctaaaatacctgcatcgttgaggagtagaattcttttgcaattactgtcttcccttttgcgagtctcatccgcagtttcccgatggaaagaacatgaattgaatcggtaggctgtttgattccattcacttgaagaacaacaacctgccataaggggcaaaaataggtgtccttaaagaatgactagtaacagtgggtaaagctgacttcatgagcagtaaatacacagttcttttattatttttagtgacactgaatatttgatacaagcatccaaatagaatgatttcttgacataaaagcagcagatggcatgccaactgggaaattatgaaaaccaaaatatctgacaagactcagtaaatagcaagatttataacaaattatgtaggtataatgcagaaacaaaaatggataaggaaggaaaaccattacattatattcagtttcaggattccttagaagagtctctacgtaatcgaccaatcctgcagctgctcgacaaaataacgttagccatgtcataataataaaagcgcattaatgttaccagtcaggaaaactaaccaggatccacagggccagcagtcttcacgacagagatttcaccgcaatggttgatctcagcttgcaaataccgcccaacatcatgtggttctggagcatatgcttgctttatggcacctatagaagatcggtagcaagtagcaacagtcatcagtgttacatcgtatgtagaaacaagatcgttttgcttgatggaaatagtttcacctgaaattatctctttcttgtttccttcaggctgcacacggaaccactgtattgtacttcttgataaatcaacatatccatcactctgggaaactatgcgcaacattgagcctaagctttcaaggccctccagctcatacgaggacacatcgttttcctcatagctttgatgcaggtgtaactgataaaaaggacagccaatcatgcatggaaataaataccagatcttgatctctacataccgaaattattcatgttgggaacttcacagatttgagaagcaacatagaataaaagaaacgattcgatctaaagacactattatttgtcttttacggctgatcatccaagtagcaagataactcctatagaaaaacaatgacagtaaaagtaggcatgaagcagcaataacaaaccactacacgctctttggcatcgttctgcttatttgcacaagtttaaaagaaagaaagcaagctacagagttgatatatgattctatcttcgcaaactttgacatagaattggtgagctcttgcggtgttttgttttcaacatgctccacagtgcacggtgtgattcaccgcaaattcatattgcaatagctggtttcaatctggcctactgtagaaatgacaactgaaattgccaaaatcagcatgtgttaaccatacctctttcaaaagatgaacacaatttgaggacttctcagctaattgttcacgtaggacttcaatctcattttcaatgtccattgcctaaaagataattaaaaacttgaaattggtcatttagaaaccataataccatacgatcaagtatgcaacataggcttgcaatttcacatgtagagtgacataataagtgcattctaccttgctgggacaatgcagcattttcactctccgtgcttcttgagccttttccttaagttcatcctcatcctaacaaggtttcaaaaagaaatggtaaacagatatgtacaattcagcttgaaactagaggaactctaaatatggaatctctcttagcataaatgaatcacaagacacaggcagctggaaattaggggtttagggttgaaagtgcctaagacatgtaggaaatgacaacaaatgtaacaagaagaagatatctaccaacaaaaatgatttattatgacttcatacatcaatgtttaatgttgcatatatctcatagttatttcaataaaataaaagaacatagtgttcctaccacctacctgtttcccatttatttgaggatcaatttcttgctctttaactaattgttcaactttttgtacagcagctctagcattatctatctctatgcgagcgttagatcttttttcttcaacaattctcctggcatcttcagaagcctgtatgaaaaaacagaaaaacaagcaatgattgaaaagggatgaacacatgaaggtataccaatggatagatctacccaaggcgatattaaacacgattctacaagaagccggtaaaaaaacagtaattattgtcagcatgcttatatctgaaccatattgaggaaatcaggtggaagtcctaaaacgtgttattcaataagctgtgattacatgtgactgaaatttcactctgtattttgaagggaaaccactagtacttcaatagttcagttccatagtataatacagtcccaacataagaagcattctattgttcattagtactgcatattgttcataggaagaactcaactttccttactagcaatttagcgaaacagagaacacttaaaaacaatggaacctgacattttgctataacaataaaaaaccaaaagtgaatgtcacaagatgctaaaagtatgttgaccgatgttcatagcatgcatacactactgaactacaagaaattttggacgcaccagtttcaatgaggttgcaattttggcaacctctgccttttgctgcagcaactcgtcttctcttttagacagctgaactgttaaaacatccacctatagaaagtaccaaactattaaaacagcccacagaaaaggcaccatttttgcatatggagcttggagggaaaaaaaaggacagaatagtagcctcttttgaaaacacatgcaacacaattaaagataaatagcaacaccattagaaaagttacaaattgagtagcaacaatccttggtgaaaaatcaaaatatggttcataacaagaaacaaaccatagaaagggactcctcaatttcatccttatgtttccctgcaactcgacttctcagcgattctaatacactctttagatttttcagaaggatgtctcgctccaataaagcagcttgtctccatttaacctgagagttcaagatttcaaggtgaggccagatagacaactttgatttatataactccattcattcaagtattgggccaatcgtcaaagagcattcaggaggacagggcctaaaacaggtaaaagttccatacctcattagacaacaatgtggcagtgttaagacccttctcaaatttcatagcaagctcacggactgaaaggcgctgactccgatgaagtaggtctgctgtttccttggcaacagcctctttcagagatggcatttcttgatcatctgtcaatttgataactatcccattcaaactcttcttgtatgtagggaatttatttctgatgaagtttgcaggacgcaatggccctgaccagaggacatcattatgtgtcttccgcccgaaatcaattgtggacgcccgcgtcatttatacagcaccctcaaccttgactaaatagcaggctttacccctcaatagtttacagctggccacagtaaattatcattagttgaaatgctcgataattatagtttgtttaaaatgtgcatccataatcattaggggaagtcaacaccatcaaaaaaataaaaaggaaagagtacaaataaaatgcagtgtccatagataataaaaatataagacaaaagcaagtgctggtcggtttcaaacaaaataagtgctggatatcatagtatcatctagctgcacacaagtgctaccaccaaaccaattaaccaaacctcatgcgtcgcaagtattgaagtataaacaatactggtcactaaactcaaagttacaaatctgtattggaggctacagaccaagtaattgttacacttaaattccactatgaaggacagttagtagtaccagatggtaaagctataaactactagtgcaaatttgtcagtggaatagggaaaaaggacgttcatgtatgattaaagtgatcggtggggaacaaaaggttaaccaatcaccaggtagcatcaagtacagttggaaattttcaaacattgtagctggcatcagccaaaaaatagtagttactctaatcttgcgaacaacaaaaataatttggagctgaaagacctttgcaattttattacaaatgaaactaaacaacacagttcagaattcatgggtaaacttaagcttagacatagcagagctattcaattcatgcacagttcttctgggcttctggctacacggcactcgtacgaaaattaaaactgaagtaaaggcgcatgaattcaattcactatcgggacatgttttctagtaggttcgttggcaaatcattgctagtatatactcctgcgctaaccacctcgccactccacgcaaatgcgagtgcaattccgtactaatttccttatacaattcttgtttcaaaaatatatataatttgcttaaattttcatcaaataatgcactatagcagactcatactagcaaaataaacagagagagagaaaaaaaatattaccttctgccaatctgcctcccaatcgtccagccattcaaaagcagtaagtagaaagatgaacaaacaaaaaacacacacaaaagaaaaagagagagagaaactaaaaaagaaaaaacgcacagagaaaacaggagagggagctagaggtcttaccaaggagctttcagaacgcaaacccgccggcagccgggttaaatggcgctcgctcgccgggatcccgcggcagctgcacccacggtggcgaggctgattcagcgaggaaaatgtggcgcaaatctgggggagagagagagattttggtgcgggtttgcctctctctctcctctcttttctctcttcttctctcgcgagcgggtgcgagctttgaatggcagtggcgactggcgacgcgggggtgggccctaccaaggaaaaagtggggcccacatgtcagtgggcccaccggaggatcgcgggtcaggtgagagtcatcacaggggcaagtgcgatccggggacacgacacgactcgactccgctccccccgagattccctccgggcggcgctgcgggccgtaggatctcgatcggacggcggaggatagtgggaaggggtttcgcgaccgttccgttgatggcgcggggcgcgtcgtggaccccacaccttccaccggtagtactccgtagtagtaggaagttgggataattcttgtctgtttctgtctgcacttcgaatttttcttcttcgtattttttttcattttgattgaattttcaggggagctgaacttcatctgcaaattggaatattcaatttgatttcagggcgtttgggacgcatgatttttcacagggttctcatgtagtgctaacttgctagtaggaagttgtttgttcagttgtgttgtcagtcttcacaagccacatgtgtggttatttataaagctgaagagttcaccaaaaataaaaaggacattgcgtcgcctctgagcatcgtcaagttagaagttaataagagcatcgtcaatcacatggttttaatttttttctcctctttttttttcaaacaagagtaatagatgtggttagcagctgcatctcgttggtgctacgcatgtgctcggctttgacttcgcaggattgattgaatcgatcccgggaacagcgggctatacatgtagctagcgcggttggtatctgcaaatctgctaacataagtaagagcaagtttaatagtatagtcaactactgactttaaattatctatatctaatttaatagtttgtttatattatctataaaccattaatatatggtcacgcctcgaaccttttagctctgctcatttctagtaacggaataggggcgcagcccttgatcaaaaaaaaatatggtcacgtctctcatacacacaacgtattggagtttgttgtgcagttggctataaatctgtagatcgctttccttctttcttctcttctctactccacatgtgcttacaactgactttactccctccgtttcaaaatgtttgacaccgttgactttttagcacatgtttgaccgttcgtcttattaaaaaaattatgaaatatataaaactatatgtgtacatgaaagcatatttaacaatgaatcaaatgatatgaaaaaaataaataattacttaaattttttgaataagacgaatggtcaaacacgtactaaaaagtcaatggtgtcaaactttttgggtggcgagccgatgtcaatcaaggccagcg

SEQ ID NO: 22080 - DNA, 1364 bp, Oryza sativa
agggtagtaaagaaggaaattaggtatatggggtagtagggagaggaaaagtaagttaggattggggaaatgaattggaagggagaagagtgatgtgattttataaataagagggatggaaaaaagggtgataaaaagtcaatggtgtcaaacattttgaaacggaggaagtatcatgctattgtactcgctctgagaatgccgtgctagcccaatcgcttcgcctgcactcgattataagctataacacttattaaaagaaataaaactataattaaaaaaccatcaaatcagttttaaaatttaaattttaactacatcttatagatttagcttaagagtaaatgaacaatatctctttagaaattaaccatgtgttgttgataaatccaaacgccggggtcatgaagccgccatgctcgccaatcgccagctgctggtgttgatccgatcgatcgatcgatcgatccatgtcacaccataacagcgaccacgcatttcttcgacacaagacatacaattactactagctatactagagtagccaatcactataaaatgcttcagttgctttctaccaataatattataatctacgagcatatcctctctttgtcccctaaaatataattctagagatgaaactggacaagcatcgaggagtacatctctagctagtacagtagctgattagccatgttacgactcaagtcgaataatcaaggagcaatctttgtcatgtgtcttcaaaaaaaaaaagaatccttgtcatgtctgcaatcatgcataaatggccgtggatttaagaagaggatgattatccattgaagagaagtcatgggtgtccattatctacgatgtcctgaactgataacaatcataagttccaataacatactccaacattggagtatttggtgattcaggttctgtatctttctggctgagctgagttcaacacttcaacttgaagcaatcatgtactccaacattggtagtacataaataatggcaacgaaggcagatcaatgtgggacaaaagaaggtgaaaggataaattctgaatctatcaacgccgtgtttagttccaaaataatttttcaaacttccaacttttctatcacatcaaaactttcctacacacaaacttccaactttttcgtcacatcgttccaatttcaaccaaacttctaattttgatgtaaactaaacacagcccaagtgtagtacctggatttttcacattttgggccttttgaaaaacttatttcgcaaatagacccctgaaaaaacttatcccagaaatgatccttttttggacgccagagtggctggcgggggatcctctagagtcgacctgcagg

SEQ ID NO: 22081 - DNA, 1957 bp, Oryza sativa
  unsure (1)..(1957): unsure at all n locations
ctagaggatcccccacttaactaagtctgaaaatagctagcataccacttagtctactttgcaccttcactaaaattagaccataattcctttagtaaaactctttgatcagcatgttaaacataatgcactctaccactatatgaaattacttaatctaattcaaaatataaccacatgaaatgacatatataagttaaacagtacatagagatgcaattttttttatttttatttcatttttttgatatttttttcacacttaggagaacataggaaccaaccgtataaaaaataaactcaaacggataaaatatgtgacttgtagaattttccaaaactctaccgaaacggacaaaatatgttatctattaaaataggcgtaactttctcatacgcactcagaatcaggcaaataatatatgcacggacatctacagaaaatgttacatccgattcttcccagctttgctgggttcggcgatattaaaaccttcaaattccgcttgcaagattgtgtttttgaggagagaagtttttcggtagaactttggaaaattccacatgccacatatttcgtccgtttgagtttattttttacatggttgaattcctgtgagttcctaagtgtgaaaaaaatatcaaaaaaataaaataaaaataaaaaagttgcacatctctcctttgcactagttcggagagagaggagaggagaggaaaaattctacaggtcacatattacgtccatttgagttcaatttttctatggttggtttttgtgtgtccctaagcgtgaaaaaaatatcaaacaaataaaacaaaaataaaaaatttcggggggggggggcgccagccactctggcgcactccctagccacctcagcatcgccccgccacatcggcaaggggacggcgccagagaggctggcgccatcctgttggacgacggcgccagccactctggcgtcccaaaaaggaccatttttgggataagtttttctaggggtctatttgcgaaataagtttttcaaaaggaccaaaatgtgaaaaatccacagtgtagtaccaagatggttttcagttttcacctgaggggtgatccatgtgacagacgtacagtagttgtagtacctttgcaggtgttctgaaccagtattctccattatagtgccataattgacaatcggtacatgataatcggtaatgccgtgcagagtgttttttttttctgaaccagtattctctatgtcctaccatgtgtactcctaatttgtccaatacaactatactgcatttttactgctacatatctgcaatctgttagcaatccaaagtcccagagcttcagagagaggggggagttggaaggaaacctgatgcaggatagcagtagcaccaatggtcagaataagagcagacaagctttatatcatcctaacccaaggaccactattgatctaaccgtaaagacaaaacaatgacaaaatgacaagagaaaaattagagctttgtggtagagaccatgtgcttgagttccccagatgagcaggtttcaacactggctgggttcttgcgtcgtttgtgtagtactccctccatttcacaatgtaaatcattctagcatttcctatatttatattgatgttaatgaatctaggcatatatatttatctagattcattgacatcaatatgaatgtgagaaatgctagagtggcttatattgtgaaacaaaggaagtactataatagtggaaaatgctagaatgacttacattgtacagcggaggaagcactataattctggttgctttgtccgatgcgagtgtcaatcaaagcgcgcgggggggggggggggggaggtncataataaggagggagaggganttgattagcggcgccgtgagacacgggtgagacaggacnncataagggtcatcgaggagggagaagaacggg

SEQ ID NO: 22082 - DNA, 5655 bp, Oryza sativa
  unsure (1)..(5655): unsure at all n locations
taaacctttaattgaagattgaagcccatggacacacggttcgggctcgtcaacgcacaatggcattcgcatcgtgattatcttctctcttcctgtcaccactcacgcccccgccacgggctaagattccccgcgcatctttgcctttgataaccccgaaagttttcccggtttccgccagagcgaacccgagccgcgccgtggccgttccccccccaaaagcttggtcatcaagcgccaggaaattggcgcaaaacccgcattcaaccgtccatgtcccggggaccgaggctcctctaacgtaaagtaaaagacccccccttttttttaagggtctgtttggtcaggtcccaactcctaaatataattttaaaagttaaatttagagtgaagttgtgaagctgcttaaacccagctccacaactttagtacattttgtaagagagcttcacccagctccactcccagttttagtggagctgaaactatttggctgagctctagctctagaaaaggtaaagctgaagctgtgctaaacaggccctaactttatgtcagagaagcctcttccatccccggggcggggcgtcgtttcagggaatgggggacattgctatatttataacgacacaaaatcagcttacaatattattgtttaatgtttttttaatattactgtttaatgttagaggatatgatttccgttttataatgtaagcaaaatttagtcaaagattgacaaattcagtgtcgctcaagagctcaactaactacaactgcaaaccctataaaagaaaaactgaaaactgcagaccagtagtagcagtacacggaacgcagcagctcagcaactgtggttcattgtgttttgtttatactccgtagtaaagcgtaacgaaccgttgggcgtaaacggcggcggatcacacgctcagtggtacgtaggagtagcggattccacgaatacactagtgtagccgtactcgtgcggagcaaataatgaatagtagtgttagagtagataatagcaggctataagccagctataaacatattttaaagaagtaaagaaagagagagaaaagtagcgggctatagatctatagctagttgcagtacggactttaagacgtaatgtgtgtatgacaggtaggaccaggtattaatagtatagtaagcaactattgtacgaattggctattacattggctatagatgatttgaagctagtagttggatatactattaaacttgcacttagaagaactagtactactgtactaggctttcttctccaccgaaagagatggtcccatcgaaaccacgtgggcgacacgcacgcatgtccttcggttggtccattttgttaacgtgttccatgcatgttttgttttccttggcaagataagcaatgccccgtcccctgcaggaataacttactctttaagtgcaagcacaataaattgcatattagtagtactaaaagcacccgcaatggtaaagtaaggtattatctataaaaacatgtacatctcagcaatatactagattaatagtaaaccacttcaatagtatgtctacatgggtatctatagctctctaatccattgcctcgtttttctctatagactatctccaggttagtagatagctttgctctctctcttcatttaatctcttccaagtaggaaaatatgctgacatatatctctcgtagagagcctatatataaccattgtaggtgtcctaagtactactgtcagcgagtcacctgagcagtttagcatcgtaatgtggcctttcagtatagtatatatttggcactctccattattcttctctggtcacaactctttctccattattccaaccttcgatgtggcctttcagactttgagtacaaactctttctctagccacaactctttcctgggcaggtagtagtagcctacagtatttgcctcgtggtgctccgttgtgcaacgcaacgcgactccgagattcgtggggcttgatgaaactggtagatacatatttcctccgtctcaaaaaaaaaaagacaaaccctgaattttcgtgtccaactttaactattcgtcttatatgagattttttataattcgtatttttattgttgttagatgataaaacatgattaatactttgtgcgtgacttgtctttttaatttttttcattgatttttcaaataagacggacggtcaaacgttggacacggaaaccagggtttgtcttttttttttgggacggagggagtacacactccacccacccgacacatcgggttctcttgccccatacccacacccacgatgtctaaatactcccacttaaatacccacacccgtcgcgggtacaaaactgtcctcatacccatacccatgcgggtaacgggtatccaacgggtacccatacccatataattgacttgtaatatttatagttttgtactataattagccatattagagctgtaaactatcaatattttctctagcaacaatgctattaatattagtgttcaaaggcgagtaaaaaaattatacaaccatattacataatcaagaaatcaaataataatttcatataactagactaagcaatgctttaagatgtgaaaggagttttatgctatgatttagtagtcgttgagagttataatactaatagttttagattcaatcaacgggttttttctaccaacgggttggtgggtacgggtgggtaaaaaacagacccatacccacccgttagtagacccatgggtataagagttagaacatgattggctcctaatagagtaaaaacccgtcgggtctcgggttatgggtacattgccatctataggcgggaagacacggaacacctggcagcctagcctgcctggccgagactctcccgtacacgcgtcccctgtgttgacctgaccccatccatcgcaccgttacaagaatcacacgcacgcgcacgcgcattcgtcgacctcgacccagtctgcacagcacaccacagcacagcagcagcgcgtagccgatggagccctacgcgtacgcgtgcgcgtgcgcgagcccaaggcggcgagcgagacggacatgtgggttgctgcggtttgctccccccgcgaaaaaaaacccaccgccaccgccactccgtgccgtcgcgcggcgcgcgggggtttgtttgggcttgggccggcggccgtccaaccaaaaggctgcagcgagtggcccactgctctgacgtggggatggaggtggcagtggcggtggcacggggggtgacgtcaggttggttgggttcacggcgtgagctgaccagtagtagggagtaggagtagctgctagcggtcagtcaacctagaaaaggcccaaatttgacaaccggcagcagtaataactcctcgccataagagcaagttcaatagtatagcccactaccagctccaattcatctatagccaatctaatagctcatttatacaatagttacatactacactattaatatatggtcccacctatcatacacacactgcgtcttggagttcgtgctacagctggctacaaatctgtagcccactacccttctctctcctcagttatctccttaaaatatatttgcagctggcttatagcctgttattgtacctgctctaatcggcctcctcccactttttcatgcagtggttcgtttccctgtaaaaagatcaatttatacagcactgtactaccactcctaattactcctatctaacaccatatttagacactaaactattactgcaacgaatataatttcattacactcgatattgtttaattgtattagtatattttaaaatggatgaagtataataatatagtactgaaatatactgtactggtattccagcatttttgcatctggttttgccttgatcaatggtcactatttcgttttcttttttcttttggtcaaagcagagtactagcattgctttgcttctcggatagttggatgtcatgtttgacagactgcttctacagatcttttttaaccttaggcgtccattactgtgtgttgagcagaagatgcacgaagtcaaaccgcatgaaaaaaaaaactaaccaagtccatgtatatatgcaaagatattcacggtggtattaatcctaattatcgtactactaatagtacattttgcatccccgcaaaaaaaaataatagtacattttgcagttggaatatactacaagtataattgaacttgtttgctgttcggcaaacggtggtccctcgtacaaactggaccaactaaaattggatgatattaacgtcctctgatcctaaccaactcgatcatgatttattcctctccaaatatacgaaattaaatgccgcatttatgcgagaatggacattgaaattgttatgaaatgaattagctccactaaaataatacatgtgctctctcacctgttattttctttttcagtagattccttttcacaaattagagacaaataatctagtattgaaatgttggcgggaaccaatagcatatgtaacttattgggtagaaaaggatttgtcttgaatgtttagacgccatttgatcacacaccacaagttcttttttctctttaaaaagacttactagattttatctgaaaggtgatgagaaatcatcgtagtatacgatcactactccataaaaacggtaagtaagataaatcaatcaaacacacctgacatctcatacttaattatcatcaatattgatcggtaactctccgagagcaataattcctagctaatttggtgtacgaacaacaactaattagctgatatatagcaaatttcaacaagtggtaaaaggcacatcaatttttttatatctcaaaaaggtgttatcacactacaatcactactccataaaaaaggcaagataaatcaatcgagcgcttcatacttatcatcaatgactatctctgataaataactcactgagtacgtgaatttctaatttgctacggagacaacaactagccaagtaatagccgatatgtagcaaattccgataagtggtaaagttgtgcactaagaagaaagtagcaaatatattctatttatgtaactacatcgtttcttctcgattttatctcaaacaggtaatgagaaattaccatagtacaatcactaatcacgaaaaagacaagtatgagaaaccaatcaaacacatccagcgtcttatacttatcatcaatgactatcttcgaccgttaactctctttcaacaaaaattcctaatttgcaacacagacagcaactagccaaaacaatacccgatatgtagcggattccgacaagtggtaaagttacgcactaacgagaaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaa

SEQ ID NO: 22083 - DNA, 1099 bp, Oryza sativa
  unsure (1)..(1099): unsure at all n locations
ttcccttgggccgtaccgaagcggcccaaaaaagtctaaatcccatccctcctgcatttctatccaaaggattaataatcctttttttttccttcctttgtcccataaatcaattccttattcccaaaattccacaaatcatttcctttggtcccgcgcgtcagtgactgtcaataatattcttgagaatattatttctataaattccataaaccatttctcctattccagaaactccaattaaacttccaaaattcatatcacctaattcgcaactccgattgactccgttccacttccagtaattccgtaaaattgagatctatttattggcactactaattagtctaaataggatctttcttttggtcctttgtttaggttttcgattgtttgcgtatagttgcggttatcggattttcgtcgatcgcgggtttcctcgaagattcgtgaagcttcgtgaagaccttgagcaaggcaagtcaccctttgatcaattgcccctataattgaaaattcattattattttgtttgcaacttgcattattagaatcacacacttaacttgcttggcctcggtttgcgtgccaaaaccgacggacctacccagtagtcgcactaatttccgtaggtcatactaccctgattccttgtcgctccacccttgtggtacctcggtattcgtgttctctgagcacgtataccaaatatcccacatacaccattgtttgtcgaaaacttgggaaatgggtttgggaagccttcaaaacccgacatgtggtgtcggtgtatttgaaaataaaatgaattgtgaaaactcgcgatgcgggggttgtgcctatgtggcactgtcccgtatttgcatataaggaccgattcctgtgggaaactcattgaaacaattataattcaaaaaaaggttgggtcctaaaaaaaacccccccctaaggtggaatgggacaccctggctaaataactaggcggttcagggaaaccttgcatgccaatagttgggaacgccgnngcggggtcggacaaaccgggtttctggnaaggnnnngncnnnaagcttgcttacttaccgattaaggtggttgg

SEQ ID NO: 22084 - DNA, 2551 bp, Oryza sativa
  unsure (1)..(2551): unsure at all n locations
naattgtccttgatagagttgactccattatggccagggattttctggactgcagatatttttcccaacacatggcatttaacattgttggctcggctctttttggtgatgctttctttgattggtctgatgcttctgcctatgaggagctgatgatgacggttgcaaaggatgcttgtttctgggcttcttatgcagttcccccattttggaaacctgattataggaggtacagaacactatgtgctcgattgaagctattaacacaaggcatcgttgcaaaatcaagaaaccaaaatggtgtacttagccttattgatctgagttcctgtcagagaagtgaaaggatgataaaagatccatgcagaggcttttctctgcttgatggtgtgatttcaagtcgttgtctcaacgaggcagctgaagggcctctcagctcagaagaagaaatatgtggtaacattatgggtttaatgttgcatggaatttccacgtgtgctaacctaattggcaacatcctaacaaggcttgccttgtacccaaacttgcaatgccaggtacacattatttgctttatttctctgttgcaaacaatcctggttgctctttatgtgatgattggtgcttgttactgcttttttgtttcaataggtagttcctttacctaaacagatctctcccagttatatatatgttacaatgttgcatattgtccagtattgctccttgttctttgcttatgcaatatatttctgcccttcatgtagtatcatgatagtctcaagttattctggttttgttatagcattcctttgttaatttgacaaggctgaacttgtttcttcatttatcttcgttgacatggaaactgcttctttcaggcggttgcattgtatttatgctgtttctctgacttacatgtgctgttttcctacagctgcattcggagatagtttcaggtcacagtgaatcatctgagcttaagatagatgatgtgcttaggatgaaattcctacttgctactgtatgtgaatctgctcgacttttgcctgctggacctcttctccagagatgttctttgcaacaaggtatacatatcttttcaataaaacttaaaaagtaccgatcaatgaaaaatgaaaaaatattaatagtgtacatagcaccacgtttcataccctgtatttcttgaggccatttttattaatatataaattttcttatatgtcctgaaatgtcatccatatcatattatcatatgattttaaatggagatgtcttttcttcatcctgatcttgctgtactgtattgagattatgctttggttctgaggttccttaatatatccattatccagttgtaggagaaatcaggtgtacttttatttcatttatttttagctcttgtgtgaagtgtgagctctagaccttttggattacctgctgtacattattgatctccttacaatttccttgagtgcagatgttaatcttaattccagcatcacaataccagctggagcaatattggttattcctttgcatctcgtgcaaatggaagcttctacatggggaaatgatgcttgccagttcaaccctaatcgtttcctcaaaaaggaaattaattttgaaggtctctccctctgctcccttcattttcctttccgcttgttcatttgtgcattatctcaatatgttttcttcttttacttgttttactgcagagatattagcggcagcacataaaggctcaaatgggatcaacctcttcactgacgagtgtgataagactgaatcattccttccatttggctctgggagtcgagcatgtgttgggcagaagtttgcggttcttgggatcgcaatgttgattgcttctctgcttcgcagttacgaggttagatgtgataattttttctgtatcttggcatggccatgtgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtacaacctcatccagctttatcccaagaaatggaatcattagttgacagcaacagccttcaccatattccgaacccaaagatcatcctcaagaaaaggagcatctgaagcagcaccttgacaaattaaagcttgacgcatttacccttgattacaatatatgttttttactggtggcatgccaggatatggtctctgttttttttcagaagcaatatggtctcnnnnnnnnnnnnnnnnnnnnnnnnnnnnnnnnnnnnnnnnnnngggtaccgagtggatantccaaagtcaatcaattctctttttttatttatgactttataaccaaccatataaatacaccgataaacacaacgcgatataggaaccacggacacaaacaccacaacaatactaaagccaccacaagta

SEQ ID NO: 22085 - DNA, 1025 bp, Oryza sativa
  unsure (1)..(1025): unsure at all n locations
gtgagttttattctatcggtgacactggtcactatagttaangngattatnatntattgtgatatagtagtgttgtgttantngtggtaagtgttanggtgtagtacgtgtgngtantcctctatacacacccccaccnnnnncagtgtttggatagtcagcttgcacacnaacaaatagatgtgaagtgcacgtgaggacgcaagcagcaaaagagcgatgaaaagttgaaaacgataaagcaatgaaaacgatggtgaaagtttggaagggaagaggagaaaagaaggcggctcccagcatttggaaagaaatatactactccagtagagatgaaggcagagacaaaactgtagcacttttaataggaccaaccatatccaccaataggggaggagcatacatggaccccatggcattcaaccccacctgaaagtgggatggcctaacgcatctcatgtgacgaaggaaacaccctggagtatacaccatgagaaaacttcctaatactacatccgataaggccccacaatacagccagcaagagtatatagaccaggttcaccaatatgcaaccgagaaaaattgagccaatgacagcacgcggcctgcaccatcccaagctgacaaccgcactccccgagctgacaaccgcactcacgctcgtttgcgcgcaagatcaagcatgcacagttgtgcctcactacataggcacattccatggtaggtccgaaagcaatgctaaccatatggcctacacgccagcgacaccaaagccatagaccaactgcattgacaatgcatcgcccaccgtcaaacacaccgaaaattcacaaacgcaattgaacgacaccgcacaaattattacggataaaggccgcacgatctatggcctgtttggttggtgccacattttgccacacttgaggtatgttagtttgaccaaatgtggctagcatttggtttgtttctataacttagacaaccacactttttctcttttggccccattaaataaagacatg

SEQ ID NO: 22086 - DNA, 5551 bp, Oryza sativa
  unsure (1)..(5551): unsure at all n locations
ttgctttcgctgcgatggtaattgaataatatggataaatattttaattatcttcttcaatgtgtggttcgtagttttaaatcaacaccccnaaaggatgattgcatctgcttgcaccccaanngcatcttgccacacctttggtaaaaaaaactatggtaaattgaggtgggcatccaaacagcccctaaatcaaacggatagggtggcaagcagccacaaaagcccaccaaactcaccaggatcctagtcgtggttgacatgtgaggagtcaacagcatccatggagcggcaaaccgtggtggggaagagcagaaaacatcaatgctttgggctcctgcatgtaaattctcccatcgccgccaagctgctactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggtgtggacgccattgatgagccaccggatccgctggcaaagaaatcgcggctgccgcatccaacacccacagcctccccttcgagtctgcgtcagcggcggcgtagcaaggagagcaccggcagtgagggcgctgcgaggacaccacccatccacaacatcgatccccttcgagcggagaatggcagcaacgtagggaggacacccggcggcggccacggcactgggaggacacccagcggcggccacggccaagccaaatccaggcgccgcgcaggagagagcgagagagatgagaggggcatggcggctgggagttttttccttttttttttacgcgcctgggattctcgcgaaggggagagagagagagaaagaaaaggaaattttgcgaaaatgcccttcagtttctaggattcagggcgcagtccttttttcctctttttgtctcctttgtattgaatttcgtaggatgcaaagggcctaaacgcaatattttaaaccgagaaaagaacagagaggacgtataacaaaatatctataaaagagagggcttttctgtaaaatttgcagaggcgacgcggacgcatgaaaggccgtgaaatccatccgctctccagcgcgcgtccacgcgtcgcgaccccgtgatggccacggcagcgcaaaacgctgagggcgctgcatttcccagttggtttgaagactttagatagtcgaacaaacaggcgacaaatcgaattttcgaaaaaaaaaattgtccgtgcaaattaacaaatgagcaaatcccaaactggcttaagctagctagtaggctagtagccgtggcatctggacatgatgggcgggtcggcgaacgggccgtcgagcacgccgcgcgccatgatccggtacaccgcctccgtcatgtgcaggccgtcccacgagatgcgccgcgacgggtccgcgcactgcgtcgcgccggggtcggagcagtgcacggtgaagttgccgttgtacggcccgccgccggcgcagcacgcggtcagggcgtcgtcgaacccgctcgccgcggggttcgacacgagctccatcacctcgccgtagtagtcggcgtaggcgatggtgacgcccgggtgcgcggcgcggagcttggcgaggcggcggcggaggagcgcgttgtggagggcggcgaggccgtcgttgagcccccggaggcagcccgtggcggggtcgcggtcgccggcgccgccgtcccggaagagaaaaaggaggcgcggaacgcacccgagcgggaagaggcccgggacgtaaacggtggtggcgccgagcccgacgagctcctcggcggcgccggcgatgtagcggacaacgcgcggcaccagcgggcgcacccactccagcgtcttgttctggaacagcgggtggaggtagtagttgccgccgaactcgcccaccatgaacacggacctaggacatcgcctccttccgctctgcaaaccattttaaccattttggttcatcaccacagtcattgctcgaattttcagtgatttttttaaaaaattaaaaatttcgaaaattttgaatgaaaaaaatgaatttgaacaactttgttggtagggctaaaacaaattcgattttttggcctggagtttcagaaattacaacgcgttccaaagttggtgttcgctttttattaagataaagatgaagttatggcatgaaaaacaagaaaaaacattagtacataattaattatattttaattattacaaagctgaaaaaataaattatataatattttaaaacaatttctatataaaaatttttcacacgaagtatatcgtttagtaattttaaaaaatgttatcagaaataacgagatctgactacagtttatgggctattctccgtacgttcgtgattaacagtgccgacagtaatgcagttcctcgcgtacaaacaaggtacactgacctacagtctcaacgaaatgctgctgattcaatgattcatcggcccaacattccaacaaaatcatcgatataattcgctcatcgtcgtgttacattaacagtgaacaaattgaatcgtacacgcagcatgcgtacgaattaaacagcaacatcaacatcaattccagttaattattaatcatatcgctgagattaataatcttatctagtttcatattataagacgactgactaagtcaaactgtttcaaatttaatcaaatttataaaaaacatagtcatatttttttacctaagataaatttattataaaaatatatttaattattaatttaataaaactaattttgtaacataaatattactatatttatatataaatttaattaaatttaaagcaatttaaaagtcaaagcatcttacgaattgaaatagagggattacttaattagtataaaattggcgatgattaaccttgttctgtggaggcgagcatggcaagaaccttcttgaaccagccgacctggacggcgagggagtagggcgtgatgccggcgacgctgaggtgcttcttcttgaacagcagctggttcagcgccgtcccgctcgccaccgcgaagttggcgccgtaccggaagtcctccctgctcttcccggccaagtacggcgtccagtacgggaaccccagcctctccactgcatcaatccatcacatcgtcgtcatcgtcatcgtctccggcggcggcggcggcgctaggtagagatagctaagctaagctcatgggtggtttgcgttaccgatgaagtcgacgatgaggcggccgtcggaccagcggccggtggggcggcggaagaaggtctcgccgtagggggagcgggcgacggggcccggcgaggtggagtagtggatgaagttgccggtgtcgatcagcgagttgccgaaggtgaacaggtggctgtagcacccgccgctcggcgccgtcgccgtcgtcgtcgtgacgttcgccgccgacgccgtggctgcgcacaaggctaaggcggcgacaagtatagccgccactgcgggagcagacaaccgcgccggcctcgtcgccatggttggagcttggatatgcaaaatggcttctccagtggcgcctctcctttctcgatttgagcctatatatagagagattattatgactcggctcactgcaaaaaaatgcttacgccaaattaattaccaaaatgtttcggttagaatgtggctttcatcgggaagaagacaattttttaaaaaaaatattacaaaatttcgaaattagcttttcgatcgagctggattcattggttatgatattttttaagattgcggttgactttctactgcgtttaaaattttccatttgttttgcaccgtatttcgtcaactcatgcacagtgatcaccctttaaagtaatgctaagaaggatttggcagttggggggtcagcataaacaagaatctcagacggattaaaaatataaaatttgtactataagttgtaattgatgtggcgatttggtgatcgaagaactgaagagaaacaggaattatcatctgctgccttgcgagtatagtatgagtgatagagacgcgatcacgcggtcaattaatttcgtacagaaggtgtggttcacgtggcgtatatattaatcatttgtgcagtagactgcttgttttattctaattaagaaatgacgttcaagtgcaatccttctgaaaataaaatataataatcatatcgagtgttattagccttactccctccgccccataaaaaacaaacatagaaatgaatgaaacactttagatatacatatattcagatttgttgtaataatgtcccgttcatttttttatgggactgggagtatggttgaagagacatcacctgcaaaacattatgaatagtacgaacgattgattttgcctgtatctacgcggctacgcccatgccttcggccccaacaataatgggcctcacgtggccagcattacccttttggcccaataagtacggccccacacgtaggccgcaatacattcgggcccagataatatgggccgcatgtgagcccgcgattacgtttcggcccaactagcggtctacgaggcccataggcgggtgagccatcgcacctatagacttgccgttctcgcgacgtggcctctcccccgatctctctctctctctctcctccgcatcaccaccaccgccgccgacgagctccggtcgccgccggcgagaggcgccgcgcgatccgggagatgccgccgctcacggggcccaagtccggggacgctctcttcggcagcgtcgagcgcgtcgtaagttcccgcccctcctccccccctgtttgcttcacagggagtcagaaacccccactggatctgggccctgatctgcttcgttttgctcgcagaacgcggagctgttcacgctcacgtatggggccatcgtgaggcagctgctcacggatctggaggaggtcgaggaggtcaacaagcagcttgatcagatgtatgtgtggttcttctcttcctcggtgtctaattttctggttcaattttagggagtttcgtgggtactttggaccgatcgtgttataggagtaggaattcggaaatattcactttttgccacccctcaaattacagtgaagcagctgcaatggcctcagtaagaggatctatgtagactttgctatggaattttgagcaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttaattcccgggtttcaaccaaaaattttttttcccccaaaccccccaaacccatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22087 - DNA, 878 bp, Oryza sativa
  unsure (1)..(878): unsure at all n locations
agagggacagctaatatgtantggtaatttaatttntactttcacatttattatatgttacgcagggatgagtaggggtaatttncctgttcactactcaccccccaggatgatgtcagtctgcatccagcacngacggaaacagnntaatngaaggaaacacaaagaaaaaacancaanccaattncggacggccgcgaacactctagaaatctttctttatgttgggcccataaaaacctgggcccaaatcttaataggccgggaggcctttgtgatgatcgggccggatccaggcccataaaaaacctgggccaaaagctgtttgacctcctcttcctttctatttctttcacacagttacctttcacctcgggggcgggcggcggccggcggctaggtcctgacagcggagggagcaagcggggaggaccaggcattgggaccctggggcgggcgatctacacggcggggaagtggatccgcggcacggggcaggccatggaccgccttggatccaccatccagggcggcctccgcgttgacgagcagcgtaagcagcagcagccgccgtctctctctctgacaatttggcagttgttattgggaagaaattggtaggaatggattgggggtgactggattcgaggagtttcgaaatgaggcctaattatcgtcggttatttggaagttctgcattccaggttttcaactagtgatcgatcttagtgtgtgaacactgttacagtaaaacaagnnnnnnnnnnnnnnnnnnnnnnnncatactgcccattgggggagtgtcacattggcaatttggcatggccaaatttggagtggttaggcgattaattcttggggcgtaacattatgaaaat

SEQ ID NO: 22088 - DNA, 3781 bp, Oryza sativa
  unsure (1)..(3781): unsure at all n locations
cgctcacggggccccagtccgggaactcttctatttggcaagcgtcgagcgctttgtaagttcccgcccctcctccccccctgtttcttcccagggagtcagaaaccccccctgaatctgggccctgatttgcttggttttgctcgcaaaacgcgaagctgttcacgctcaggtatgggccaatcgtaaggcagctgctcaggattctgaagaaggtcgagaaggtcaacaagcagcttgatcaaatgtatgtgtggttcttttcttacacggtgtcaaattttctggttcaattttagggagtttcgtgggtactttggaccgatcgtgttataggagtaggaattcggaaaatattctctttttgccacccctcaaattacagtgaagcagctgcaatggcctcagtaaaaggatctatgtagactttgctatggaattttgagcaaactaagtaacgttcaggtagtctgaatgattgaagtatttgtaaaggtaacttttagtaaacttcttcatgaaggtgtattacagcgatttgggatttagaggttcacccttatacctggataatctgactttccaatttagtgcagattttacactgcgacaaaatggtaattgatcattttgatatgacatttcacgggctcacggcaccttatattcacaacactttcatgtgtcatggtccaatgtggggaaataatatgtacaaatttattatattccagttttggaacttctttacttagttaagcactaatggggttagtgtgccacgacaattaatatctccatatgtaaggatgatattaactgaatcttgactttgaagtagtagataataaatcaagtggttatctggcgaatattgggattcttatttagtaatcaatatctatggcttgctggctgcattttttcataatttactactaccatctgcctttgccttttatctgtttcctaaataagtcacagctatatttattttcacttcgcaggggctacaacattggaactcggttggttgatgagttcctggccaaatcaaatgtatcaaggtgtgttgacttcaaggagactgccgatgtcattgcaaaggtatttcgttaaacttgttattatatggttcagattgaataggaacattatcagtcggtaacattattacatgtttccagagcttattgcccttattcagatatcccagacttggtggtgcattaagatatgggtgtatggtctaaagtttttttgtctctccttaaaacagcttggattcaaaatgttcttgggtgtgactgcaactgtcaccaattgggatgctgagggtacaagctgcagctttgtattggaggacaatcctcttgtagattttgttgaacttcctgatacttgccaaggtcttcagtactgcaatgtgctaagtggagttattaggggtgcactggaaatggttagtttttcagctacctctaccttctccttccctcttcatgttgaacgatctatagatgcatgacaggatgttgtcgttttcgtatcagaattctcatggtcttgttatacatatttaagttagttcataatgactagatgactgttaaggtgccatcagcaaccaacctgctctattatgtggggttatgccctcgtgtttctcaccataatagcataccaaaatttcctttatcagcacatgatatttttgtacttgtttatcagtcgagagaaatcttttacaagtgctactctgattgaattgcaattgtcatataggtttctatgaagacagaggttacatgggtccgtgatatgcttcgtggggatgatgcctacgagatgcgagtgaagcttaccaagcaagtcccagaggaatacccctacaaggatgatgactgacttgacgatttcgtggatagtttctcagttctcacatgatgcttgtttgctcgtctggatttcccttcttttctttcctctgtgactgtgattctggttcgacttggctggatgctacatgagatagctgtgcattatattttacacttgcactttgcacggcagcatgtattgtagaaatctatcataacttctgaatttgtttgctaagtttgacaaagcgtttacgatccatatgagatttcttctagctgtgctgcccggaaatctatataaagaggctttttagcctgatttcatggcacaccttgttcagcggttgtgcttctccctgataacagattgttagggaatggtctcatgtcagtgataaaggcaccgtgtttttaactacagatgatctcaatcctgacgataatggggttaccccttctctgtggtgagctgcggttaccgagtaaaagcaagaaaaactagataatttttttatcaaaaagtagaaaaaatgcttaaattatttttaaacttggtcaatatacatgtgtttcttttttcagttacatggagacgcgcaaacattactacacatacaacaacacaccagagaatgtcccccctaatacacacttaaagagatggaagtttgcgtcatatctctggtctcactaaatagaaaattctgttgaaagctcacttatgtacataatctttgtgggcaacaggatttgaacctaataggagtatataggtggctccccttaagtacaagcaacgataaaagaagctcgcttcgcggtttccaaatagaatcagctctactcctcatcgttgttctatatgaaatcaatcaattcgaatattcaaattctaaaatttaattttaaagttaattttaaaatgttttaatagtaccttttttggtgcaaacttttaagtctctaagaatatactcataaatattttttggtggctaataatcggacccttctgttcaaaggaacggttaaatggttaatgaataccccgtgttgctgtggaaaattaagttacataattgtacaaaactaaaaataatttgatataattttgagcctaaaagtaattgagattgcatgtttttaaaagagaagaaagaagagacaatttagattatagatctatctttcaaatgttagaaataattaggatgatataacttatcgatagaagagaaaaatggtactacatccatattttaatgtatgacgccgttgactttttatacgtttgaccattcgttttatttaaaaaatttacataattatcatttattatattttaacttaatttatcatcaaatattctttaaacatgatatacatatttttatattttgtataaaagatttgaataaaatgaatggtcaaacgtataaaaagtattaactaaggccgagagtgcgagtctgcgagacagtaaaactgtaaaaattccccaatctttcacccacccaaccagagaagtcgagaggaactcatctccttccgcttgacttgcccccattcgattcaaaccgacccctttttctttttgctttctgcgttcctgtcaccccttctcgcccctattattcctcctgtcctttcctttcttcgcctttcctttctttattttcttgtcttttttttttttaaataatattctcttttctctttttacttatttactttttnnnccctcccgcccccccccctttttatnnattnttttttcttttaatttgttccctctccctcttccttaacaactacgccttttccttttttactttgctttctttattttctatttatcctgctctcttcttttcctctctcccctttttttaatatcg

SEQ ID NO: 22089 - DNA, 5429 bp, Oryza sativa
cttttggccggcccgccccacgccgccctggtcgccgccgccctcgccgcctccgggatcgacctcatccacgtcgaccaccccgagttcgccctctcggagtccgccatcgtgcaggagcaacagaccaagaggtctcgcggggatgtcgataggctgttctctcatgtgggaaagggagggaaagctcggattgcgcccatggaggcgccgcgggattgtggtggtgtccgaactgttcgagcaccagaaggcggcgctggggtggctggtgcaccgtgaggagtcatgcgaccttccaccattctgggaggaagataatgatgggggatttaagaatgttcttccaaatcagaagacgaatgagagaccgccgccgttgaagggtgggattttcgctgatgatatggggctagggaagactctcacgctgttgtcgctgatcgaaaggagtaaagctcgcaatgtaggtgggaagaaggctagaggggcgaaaaggaggaaggttaagaagccggtgaaggagaagtcaagaacaacgcttgtggtgtgcccgccatcggtgttctcatcttgggtgacacaactggaggagcacacgaaaaccggtagcttgaaggtgtatttgtaccatggagagcggacaaaagagaagaaagagctgttgaaatatgacattgtgattaccacttatagcaccttggggcaagaacttgagcagaagggctcaccggtaaaggaaattgaatggttccgtgtgattctggatgaggcccatgtgatcaagaactctgcagcacgccaaaccaaggcggtgattgctttgaacgcgaaaaggcggtgggtggtcacagggacgcccattcagaacagctcatttgatctttacccgctcatggcatttttgagattccaaccattctcaatcaagagctactggcagagcttgatccagctccccttagagagaaagaataacggaattgggttggcacgattgcaggtaagtttggaaaattgtttgccttgtcattacatgtcatttttttgtaattcacaattcacatgaactagtaactatacttaggtagtactttaataatggtgttggaaaggatctgaaagagtcacgtgcatacctgcaatttctgataattaaattcttcttatctgcttattacagagcctcctaggtgctatttccctgcgcagaaccaaagagacagagagtggtagcaaaagcttggtcagcattccgcccaaaactgttttagcttgttatattgagctttctgcagaggaacgtgagtactatgaccagatggaattggaagggaaaaacaaactgcgggagtttggtgacagggattcgattttgcgtaattactcaactgtgctttatttcattctgaggctccgccagctctgcaatgacatagcactatgcccattagacctgaaatcatggcttcctggcagtggcagctcccttgaaggtatggcattttttcctgtttgtaattctggatttattttgtgatgatataatatggccataatacactcatcaaaattaaactgtgctgtttagattgaaccatcttgttgccaaagagatttcgcacactaagcattgtatgatagtagtatttcttttgatttttcttagaactgttccatcttactgtagagtgtcaaactagcaagttgagtgtaattggtttatctatttgaatcgacaaattgcatcagtacattgctgcttgccagcttaactttacaaacttgctacctatccgtcattttctccaatgggtcaactgctctgttgattatatcaatataacttagtaaaccgcagaaatcgctgcatagccagtgaaatcatattcccatattcctttgaattattttctctagtccatttctgtttatacttctacagataaaagttccgctttctgaaatgttttccttgtttatataacaatattagcagtaaggtcctcactccttacatttttttttggtattttcagggattactttatcttatatccagaaaatagtaaattctgtttttttaaccttttcttttatactgttttgattgatatattaggatttattggaagtccaggttatttggtgagtcgcttgaattaataatcaccatttgtatgatatgatttatcacttttctggatttgttttttaagtgaagacaagcacgcgtaaattttttccattttcagactttgttttgttagggtattggactcctaaaaacaagtattgatgagatcgtttgttttctatcctctttcaattcttatagggttgcattgcttacatttatcaaccacgcgctataacagcttgcatgttgaaaatatcatttacagagtaactgttacttatagtaaacatgttgcttgctgtagatgtgtctaaaaacccagagctgttgaagaagctggcctcattggttgacgatggagatgacttcgaatgtccgatttgtctcgctccaccagccaaaaccgtcataacgagctgcacgcacatatactgccagacttgcatcatgaaaatcctcaagagctctagttcccgctgtccaatatgccggcgctcgctatgcaaagaagacctctttattgcgccagagattaaacatcccgatgaggattcctcagtcaatcttgatagacctctttcttccaaggtgcaagccttgctgaaactactgaggcgttcacagagcgaagaccctttgtcaaagtctgttattttctctcagttcaggaagatgctgatcttgcttgaagggccacttaaagcagcaggctttaacatactacgactcgacggctctatgacggcgaagaagaggtcagaggttatccgccaattcggatgcgttggccctgattctccgaccgtgctgctggccagcctgaaggctgcgggagccggcgtgaacctgaccgcggcatcaacggtgtacctcttcgacccttggtggaaccctggggtggaggagcaggccatggacagggtgcaccggatcgggcagaccaaggaggtgaaagtggtgaggctgatcgtgaaggatagcatcgaggagaggatgctggagctgcaggagaggaagaagaagctgattagcggcgcatttggtaggaagaaaggaggcaaggagcacaaggagatccgtgttgaagagctccagatgatgatgggaatgaaatgaaatgcaataggtgcctcttgctgacaataggtagtagtagcgtttatcatttcgtaatagtgcctcagtgtcagtaaacaaagtgctggcttcaggaggcagtaggagacattcatgcgtgcatgtatttttgtggttaactgtggttaacatgcacggcatgtatgtacagtggtgcattgcatccggcatcctgtccttttccttttgcttatttttgtataccatattagcgggctaaaactaaaagaaagtttatgtatgtatatgtgtattcctccgaattccgatgcaatgttgagaagtatgtgaatggagctagggtgaaaaggtttgcgatttgggacttgggagcatgaacatccaaggcatagtgctgcatgccccttgtgaagggatggatgcaaaatggtcgaccacccatctacaatttttcacattttaaaatgtttaaaatatagagtggtgtgggcgtgtggctatgtgagtatacatactttgttagataaatacttcctccgtttcacaatgtaagttattatagcatttctcacattcatatgtctagattcattcacattaatatgaatatgagaaatgttagaacgacttacattgtgaaacggagagggtaggaaataaaatctttagcctatgaagtaagtatgggcgctccctcgatttgttgtctctagagatttcaatggtggttctgttctaagaaatgatagaaggaaaaaaaagcaatatttgatagtttaagaagccttcacatctaatttgtgatttaattgtttagtgatgcgtttaagattgaggtatagtgcagggacatatcataatattacacgcgtttggcgttgtgggctgctttctctgccctccctaccaccaccaccagtgggctttgggcacgaaagaccgcggcctttctaccaccgcacaatttgccaatgggccaacatgaccgcgaatcacacgccacatccacgcgatttgctgggccgccgcccgtacgcgggtctcgctcgcatcgtcgccaccaaatccgtctccttgaacaatcagctttagttccaggtagccacaaagcggagttgggcgaggctgaggcgtaggtgatcatgagatggatgagatccaaggttgataaaacaccgtacggttaccacgcgattatcatgcgctgtaaccttttcagttttcaaaatcacggtatataccttaaccgttaaactgtagtgtagggtgatgataactttacgccaaacggtttggtagacctaaatgggatctcgcgcgaggctacagcagtgaacttagtgcgccgacctggcgtggcagcgccttggtttacggctttcgccgtgcaagtggacagctttggctgaaaaaagatctctcgcattccttgtggttcacatcgatttcccacgcaatttgacggatcacgcgtcagtgctgttgctgctgctactacgtcgtcctcatatagttatcctttgcacgctgctgctagtcagatcacaagcaacgttctatagatcacggtttggggatcgaatcacttgaacatgatcgacatgacgaggcaatcaatcaatatgcaataagtaaactgattatattgagatatactccctccgtcccgtaaaaaaccaacataatatcatatgtgacacatcctaatacttatagacatacatatgtccagattcgtaacactagaatatatcatatccagtcctagatttattttctataggacactactttactacttccccgttctaaaatgaaactatttatattttaaaaggaagtattgcttatttaactccagaatccggatatgtgtacaaggctgttcaaattgatgccattttaaaccatacaattttttttggcaaagttgttaaagatatgcctatatatttaggttttttttttgccaaactttggcaaatacataagaaatcatgctaaaattttgatgatattatcaacttactaaaattttggtatttggtaagatttatattggctataatctgaacagcctctacgtgtcaaactctggatagtttttttttagcttatgaaggttgcatgttgtaggcttgagaggacagttgtaacgctccgcttttcgtgagacgttaaggggatcctc

SEQ ID NO: 22090 - DNA, 770 bp, Oryza sativa
atattcaacccattcttgtttgtggcaatgcgcggggtggaatgttaaagcgacgaccacggctcgctcactccgttttggcttcctcttcctcgtcttcttgtcgttgttggctttccttgttgggaattccacgtacggaacggagcttggatttggagaggagaggagactgcctctgcctggctctccctcgccgccggcgcacgccattctgggcctctcctctttgccgattgataagaggagaagccgaggagcctccctgtttcaattcgttccggcgggtcgctgcaatccggcagcgaagttgaggtacaggtacgcgcgtgccgtgtagcagtcgattgattcatctcctctcctcgccggagatctctcgggcgcattgcccatttgccttgcctggcggcggtgggagggatggaagaggaggcgggggcggaggtgccgttgctcaagatcaagggggactaccaccaaggttgccctggctgtgcctatgaccgcaagaaggaggtctacaggggattgccttacaaggagttcctctatctctggatgatctgcctcaccgccggtatgcatggaacattccctccctttttcgcaaccttttgactagctctggagattcattctggggtaaagttcttcaactttttaacccatggtgctctaggaatttcccttttctagtgtagtacgaatgaatatcctcaacaaagagaatcttggtaccacgtaggaccatgacaacaatagggaat

SEQ ID NO: 22091 - DNA, 754 bp, Oryza sativa
  unsure (1)..(754): unsure at all n locations
ctgtgcttggttcgacnnnnnnnnnnnnnnnnnnnnnnnnnnnnnnnnnnnnnnnnnnnnnnnnnnnnnnnnnnnnnnnnnnnaagaggagaagccgaggagcctccctgtttcaattcgttccggcgggtcgctgcaatccggcagcgaagttgaggtacaggtacgcgcgtgccgtgtagcagtcgattgattcatctcctctcctcgccggagatctctcgggcgcattgcccatttgccttgcctggcggcggtgggagggatggaagaggaggcgggggcggaggtgccgttgctcaagatcaagggggactaccaccaaggttgccctggctgtgcctatgaccgcaagaaggaggtctacaggggattgccttacaaggagttcctctatctctggatgatctgcctcaccgccggtatgcatggaacattccctccctttttcgcaaccttttgactagctctggagattcattctggggtaaagttcttcaactttttaacccatggtgctctaggaatttcccttttctagtgtagtacgaatgaatatctccaacaaagagaatcttggtaccacgtaggaacatgacaacatagggaatcttggtacctgcaggaacatgtcttctttcttgcaaatgctacatgttactgcaatgtccatgtgcagtccatatgggtttggtccgtgttcaatcatgtcgatgattcctgttcctgtgggaaatcgctgattcttataata

SEQ ID NO: 22092 - DNA, 2747 bp, Oryza sativa
  unsure (1)..(2747): unsure at all n locations
cgcgtagttnccatgaananctttgatatacgcgctcggnacccaatcaaatccaccctttactaccaacagatacagaaatcacttcgtccatccccttcccacacgtgatctctccccacatgtcgctctctcctcttgtcatgcgaaaattgggagcgatagcgtctcccagcttatagagagcgagaaaggagaagaaaggcggaaaggataattagcgatcgatcgcttgcgggatcggaccgcgatcagatcgatccctatactcctctctcttctcccccttcctcctccccttcttctctttctactacagtataccacgaacttcttttaaaaaaacaaaagttagaaaaaaaattatgtatagaaatattatatataaaaaatttgaattaaaatttaaatttgaatcgggtatataaacttttgacttataaactttgggtctttaaactttaggtgtataaactttagatgtatagaaatactatatatataaaatatttgaattcaaattcaaatttgaatcgggtatgtaaacttttgacttataaactttaggcctataaactttagatgtatagaaatactatatatagaaaatatttgaattcaaattcaaatttgaaacgggtatataaacttttgacttataaactttaggtctataaactttaggtgtataaactttagatgcatagaaatactatatataaaaaatatcaaatttaaatttgaattagatatataaacttttggtctctaaacttagatgtgtaaacttgaggtgtacaaactttagacgtataaatttactaaaataggaaagtaatacggtgccaaaaaaggaaactatgtggagggagggaggggggaatctgatcgctacccctaatgccaaggcgattgatcgcctattagaatcccccattgaagaaagggactccattttttaatacatctatagggaactaaagaagcattttttttaaaaaaaatctcaattttagtgttgttggcaatgcttttaggaatcctcaggttctcaatccgtgaatttgagggagagcacgtaggatcatcgacaggggcgaagctacactcattcatagaggtcagttgaccccaacgatcttttgcgaacctctggtacccctctttattttaccatctatgacctcggtgaagagaaaaactagaccccggtgatatcgttgattctttcgtcaaaatccaactagcgactaggaacggtactaacaaacagcaaattagctagcacttataatttatacattacccgaatatacatatatacgattgggatttggatccaaaaataacattggaagcccacaactccacgagtttctcttcttgcgtcatcgtattccttcgagcactttgtcctgcaccggcattgtgcatcttgatatcttatattccctccatttcaggttacaagacgttttgactttggtcaaagtcaaactcctctaagtttaactaattctgtagaaaaaaaagtagtaatatttacaacatcaccatagtttcattaaatctataattgaataaattttcataatatatttgtcttgggttaaaaatatgaataaattttcataatatatttgtcttgggttaaaaatattactacttttgtctataaaattaatcaaacttagaatagtttaattttgaccaaagtcaaaacatcttataacctaaaacggaggaagtaccatcttatttctagcagaacagaaggcaagaaattagtggttttgataatctttggtgcatttggtgtcttttacaaattaataatgtataatttttaataaatttgtagacatttcattttatcataatgtattgtcattaattttgtcctgtattatgtataatcttagatcattaattacaaactagatgacatattttcgatctagtattggattccaatgtagcgatatgacatttttttacctaattttaataagttttgatctagttttaccgtgaagtctcaaaaaaattcgaaaatttcactcagaatatacttttcgtcccacggcgaaacatcaaaattacatgatttttgatcagttttgatcgaaaacataacccctggttaatactggccccggtgaccatttatcctagctttggccccggtgaccatttatcctaacttcgtccctgatcgtcgataatgggggagatcgtgattgcaaccaccctttcagtttttggtcatgtgtttgaaagatgaatattttcacgcctgaggaaagactcctgtgccgatctcttggaaggcacaggaggcaaccagcctcgagcggaggctcgccggccacgtccagctcgcggattgggatcccctgcagtatgaacagcgactgcaagttaactactgcacgcgattacacccgttcattttggtgatgaatggaccagatcatcagctccagtgtcaccgcccaatacccaatatttttgnttcagtgatctacagtatccgggtgcatgtggaccgttagattcggatctaacaggtggcagtggtctgcataagttgtagtcgcggtnccaggtngnttcaaaaggtttcaacggnnnnnnnnnngnnnngtaatgnaatagaataataaatacgtaaggnggataaggtgaagtatgatagggtgaagagaggcatattacagaaggatgacgatcgaacagtgttgtat

SEQ ID NO: 22093 - DNA, 2292 bp, Oryza sativa
  unsure (1)..(2292): unsure at all n locations
gtgacactctaaacaatagtagaccttatctacttgaatnatggttcttaaactaatcccagtnactcggtatataatctaagatgataattatgtctgcacttcaagtctccnnncnccccncccccccagtggttttgattgcggntcaccatgnnacnnnnnnnnnnnnnnnnnnnnnnnnnnnnnnnnnnnnnnnnnnnnnnnnnnnnnnnncaaccaccctttcagttatttggtacatgtttgtttgaaaagatgacatcatttagcaccgcgcgtgggtgagaaagacatacctgtagcgcgagtctgactcgggatgggcaccaggaaggcgaatacaagaacgtcgtaggcggaaggcatacgcaccggaccacagttccaagcttctgcgcgaattaggggatcaaccctgcaggtatagaaacaggcgagctggcaagattaacctactcgaacgctgattacaaggcggacattttggtgatgaatggaccagatcatcagctacagcgtcaacgcaaaataccgaatattgttgctacagtgatctacaagatgcgggtgcatgtggaccgttagattcggatctaacaggcggcaggggactgcataagttgtagtcacagtaccaactgcacctgatgcaaatccccagctcgcgtcgccgcacactctgcgcactcctcgtgccgctctgcccactccctacgcctgcaaccgttgccctgcgcgcccatgacgccacctaggatgaaaacggtcggaaacgatcggaaaacagccaaaaccatttccgtaaccatatttttctcggaaacaaaatcgaaaacggtaaagtcggaaacgaaaacgatatcggaaatatcggaaaaccggaaacggaacaatacggacggaaacatgtcggtacagatcggaaaccggtaacaaatacggaaacattaaactataaaaatatatatttaactttacataagtatgttatatatatacataaattcaagcttatactatataaattataaattaacttcattttaaccatgtacaaaagttagagattttattgaagagtcattcaatctataagctgtgggtaaagtatagacatgtcctataatatcgacatatttagaatacggtaattaccatattataagaaacggtaatttccgcaagaatacggtaaatacggaaacgatcggtataacagcaaaaccatttccgttttcatttccatattttttaccatttccatttttgtttcggtcgattaccatttccatatggctcggccggtagaaagtcaaaaacgaacgccggtcggccggtaattaccgttaccgttttcacccctaacgccacctacatcgtcgccgtgccgcccgcctttgtggagagccccatccatgagccgcgcctatttgaacgatcaccagcttgtcctctctcttttctcgttccactattgtattcattataattaatttttatagagggccaggcgttttcgcatgcaaattatttattttgtaattaaagggttgttttggattgaaatcaaaatatgccctaccaaaattttagtaacttaaatagtaattgtgcccatacttaatttggctatattttaaaattttcttcaccgtcttactgaaatttagctttatattgggcatcaaaccgaacataggctagctaattttatcgtaccaaaaaattggtaattttggcactatcaattaattggtaattggtagggtagataaccaattaattgaatattttcttgaaaaaaaaagccgtatatacgtggcctatggcgtttcgatccaaactcccctttccttctaggcttctactgcgacgaggaagcccttgccctggcgtcgtcaaaatccctcctccgcagcttcgctccagtgtcctgcctgtcaatcctccgggatcttggtggatctgcgggtagagtcggattccaactacgattcggagtcctaatcaatttcgttgcgtcccccatcgtcgactataaatctggtatgatcaagttgtttcattgcatcgtttggttgcgcatttatcccctcccatctctcccggccaagttcgcagtcncncgcttggtncgtagcagngtctaacaacaaaangtcgcggggggnggggggnnatgtggttgaccaagantggagagagaggtnnnagtagagggttggaatttggagggtagagagagaaagaggtagtcgaaattgttgagggttngggntngtgggcaga

SEQ ID NO: 22094 - DNA, 2774 bp, Oryza sativa
  unsure (1)..(2774): unsure at all n locations
cgcgcttgatgacagcctctacnnnnnnnnnnnnnnnnnnnnnnnnnnnnnnnnnnnnnnnnnnnnnnnnnnnnnnnnnagctattttcgcaagtggacctgttgtatgcctgcgaaaatggttgatttttgcaggcgttgatgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttagaccaatcatcacaggcgcgacttgggaactaggccgaaaccctaaaactcatcgtagccgacttgctcctggaagaactcctcgtcagcaggatccacttcatcttcttcagcaactgggggggggttatttatatagagcaagggtgagtacgggagtactcagcaagccaggggaaataagtgtttaatgcaggcttcaaggaaaggctgttgttttagtaattgattttgtttgaactcttttctaaaaggtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgagcagtttgttaacctctgcagagggggtacactttacccacacgacattactaacccggatcacccagcccgtggggatcagccatgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaagactcccctgataagctagttactcagccaggggtgtcccattccacccatgtggtcgtacttgtcttatgtttggatgaaattccaagggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatacttgcacagagtgcacgaatatatgtttgggccgcttgggaaaggtgtttttctagtagtgtacaccttaaaattgagttaggaatttcaaaaacataaattttgaaacaatttttgtatttatactgggcatgctctgagttgtggagaacgagatcagtgaagatgggttttcaatttttgagtatctttatggagaacttgttggagtttattttaaaactaaaagaaatccaaaatctaggattgggaggtgctgttgggcacggtattgtaaccgaggttcataaaattctaggattgggaggagccatcggttttcgtgttttttttttacgttctgacgtggcgctatttttattggaatttctaatgctttccgataaatcaaaatgtcaaacattaaaattgatcaaaattcagcggaatttatcgaaaagcggtcgaaaatcatgatacggatagagcttgaaggccccctttgaatcaaatgaaaaaccataggaattctagaggattttatcctatgggaaataatcctatagagtcatttgaaacaaaggattgttttctatcaattcctttgaaattcctatggaatgaactttactagagcaattttggaggaaaataagcatgaggtgatgaggtctcacctcatgtttttctctttatgtgtctaaggttcctgtatttttcctgtatgctaatcaaacgatagtttgaagacttttctgtgtttcaaaatcccataggaatccaataagtgtggcatttaattcctacgtttttcctattcctctgttttctcaatcctgcgattcaaaggtgcccgaattctagcggtcagctggtaaggtaaaccctgcttgtacagtacaatagagtaatagacaagccataaccacaaaagtactgtagtagtgaaaaaaaaaccagaaacagccgcaatcaaacactcttgaaaaccctaatccccaaaactcagcaaaacccaactcgtgtttcgttcgcaaagtgcctgtgcaaaggctcaaatccccaaatccatcgaagaaatcttgaggagacttcgtttggacgttttcccagcgcgctacagtgttttgcccccgcgcacgcttttcaaactactacacggtgtacttttttgcaaaaagtttctatacaaaagttgcttaaaaaaatcaaattaatccatgaggcgatgtcacacagggggggnnngggggtaataaaaaaaggccacactagatttataaaaaagacaaaaataaatgaaaatcagattataattataagacacaaccgtcat

SEQ ID NO: 22095 - DNA, 6481 bp, Oryza sativa
  unsure (1)..(6481): unsure at all n locations
agtgaattgttcccagctttgtnnnnnnnnnnnnnnnnnnnnnnnnnnnnnnnnnnnnnnnnnnnnnnnnnnnnnnnnnnttaaaaaaatcaaattaatccatttttgaaaaaaaaattagctaatacttaattaatcacgtgttaatgaaccgtttcgttttccgtgttactgtagcgcgctgggaaaacgtccaaacgaacacagccctaatccgtggcgtcgccgatggagcgcacggacgatgcggtggaggcggccatttgggtacttcccaatccgcccgactggagcgtgttcctgttacctcccgcaggagcacgggagggaggcggctacgacaacgacagccgtgtcgagatcagcatcaccacgggcacggggggacaccaggagcgaggcgcctcctcgtctgccggcgggctcagggaaggcggcgctgcgcgcgaggtggagcgcggtggcggagatgtaggcctcacggccaccgccatctcaggacgccgccgtggagatggaagcctcgcagcaggcagcagcatcgctggaggccacggcggaggtactgcggacgacgagccccacagcgagggcaccgtcgcgggtgcagtccaaggccatctcgctggagtgggaagcctccccacacccacagacgaggcatcgcggtttgagggcaggtatgaggatgactataacccatatgtggatctctacaaatttgggcgaccggctcctgatttctggtatagcgtctggatgcgtggccccctcgttttgcatgataagaaactgttactggctagtgattctcttggtgttcatagaggtggggagattcctgatttggcagatgctataactgatgttctagataatcatcctggaccagtttcttacttcagagtagattccaccacatggactgatgacaatcaactagtcaaatggtttgaaactctatccaacaagtctgttgtagagatcacattgctaaacattggttgtccagttagcacaatacttcctatcagtgagctcttgtctcctaacctcacaactcttcgtgttggttttatgaagattctcgattctgaccttctgtcatttgagtattcgtcgttaagcgtgcttcaactcattggttgctcatatcgaggagctgatctaaattatcttgtcagtactagcaatacactaattgagctcaacattggctattcaatggaagatctcacagttaattcacagagtctacaagaactgcacatatggaatagcagggggggctttctttccgtggaatatgctccaaacctcaagttgttgaccacgggccttagaccaaagaaaggaaaatctttcatctcgatcacattaaaaggggctccttccttgagagagattgattaccttctgctgccgtcatcgagtcaccctaaatgacacaatgatctcaaaggtataactcaactaatcatcttgtaacagcctttcagtgtgtcctttagattgttagtcatacataattttgtttgttgttgcaggagatacgatgtgtttcatctatcaggcaactccaagtgggtgtgaactttgcagaacgaagtcacagagctagtcttcgcaatatacttgaatgttttccagaattatcaatgcttgtgatttgggtatgttcaatcttttgttcaatgtatatccaaattatttggatatctgtagtagattaatggttgtttttgttaccctttttttttgcagaggatggatggtattgtctatgataaaggatctgatgtactattcgatagctcttttgtgggtcttggtagtgtctcttgtgtcaagacacggatacagtattttgagttagaaggttttcgtggtgggccagctgagatggacattgctcgtgggatcttaagacatgcttccaggttggctaaatttgtcctctcacatcacaaaaactacagtgaggaagatctggtggagcaacttgaagagataaaaacttgcattcgtgcttcagaagattgtattattgaagtccacccactaaaagactcaccttattaaagcacaaaggaaaaggtatactctctccttgttttttcttttttttttctttttggctatatggggttggatagtggcactcagtctcaaattttattgttttgaaccctttcccgtgctaagtgattttggattttggacttgttgcttatagattagttccccttgtagttaaccacttaatagttgtcagaactgggctgatgggtcatgtgtcgtgcacagcaagatgtgttggtcgagtcaagtagtgtctgaggtgttgatttagaatatggaacgatcacaatggatcctgtggatgttccattaagatgactcaattagcagtagctggctagcagttgttcatataatggttaaaatgacagataaaagtaatgcacagattgcttgaaatagaaattatccattcacaaaggatcatccaatttggttttatacttacgccctgtttatagagtcacaactgcctctatatctattctcgcgacaaaaatggagaaaagcatatagaagaaaacaaagactacatggcactgacagtgcttggcaatattaactatttagtgctttgattgactgcagtgtgaaactatgagttgcctttgtagtgccatgacttattgattaaacataagaagcattacaatcttcaagcaagagatgcttgacacagtctggagcctcagctaaccaaacagcactactgccgtagtgtataatagcatgctgagctagctcatgtgctaccttattttggtctctcttaacctttgctacacaaaccccacccagtaaactcatcaactcatttgcatcacttatgcagccagaattacaagaccaataaatacaactcatttgcatcacttatgcagccagaattacaagaccaataaatacttggtttgcaacgactgataagctaaggtgccttctacacaagctgcaaatccggtttcttccagcattgagcaatttactggccatgccaggaagataactgagtattgcctgcactatctctaatcacaaatccttcaccagctcgcccaatgacagccatgaaaccgccattcacatttaacttcaaataactaggatcagggggtccccatctttccgaagggttgggagtctgtatctttgcctttagttttaaattctccccaaaatcaaaattttcctttcctgtctttcccttcttgttcacatatttacattagcaagttatgcattgcttccaacaatcttatagcaccctctaaattaattccccttttccatgagtaatatcatttcttacattcccgcaaaaaaaatcatttcttacattccaattcttccaaaacacaaacattaattagctttttcatcgacagatattctatccattaataataagaaccaatctggaccagaggtttcatcctttggcaaagtctagtgctaccgcataccacgtagtaaatgttctagagtggggacaattaaccactgcatgataagttatcctccatagcatcctccataacactgccagagaaagtattagtagccacggtgttcatcacaagccaacctccatgcaaaattttaaccttcggtggtacctcagcttgccaattatatttgtaggaaggtctgtcccttcttaaactactaactgtatgcacttttgactgaaaagatacctgttttctcaaaatgccatgccactacatcatcgactggcctcttgtggatccttatcttaagaatttcttcagcatcaattggcaagaactcctaattaatcacattaggtaaccattcacaactagtagggtctataagattcgaaactacattaggtagccattcacaactagtagagtctataagattcgaaactattcttactgttgaacaccgctggcgagtaatcaaattcaggaagtgttcttgtgttatccagttatccagccacaccctaaccatctctcctgaaccaatcctcataataatgccctttttaagcaattgcactgttcaatactccctccgtttcacaatgtaagacattctagtatttcccacattcatattgatattaatgaatctagacatatatatctatctagattcattaacatcaatatttctagtgaaaatactagaatgacttacattgtgaaacggagggagtagctctctaggtgagaatgcattgccagcaaaaactgtatcaacaggttacctgatggaaagtatttcacttcagaagcattgcagtaaactatctagacagaaaactcggcatgcttgccgagaggatagagtttggttgaaaagctgctatctctcaaacttaagcctcccacaccgttggacaataacatattctcccaagagcaccagtgcgctcttattttaccattttctgctccccaccaatattatctttaccatgttctgctccccaccaatattatcgtgtcatttgcatgaactcctcttgtaacgatgctggcaatttgaaaatcctcatcgtgtaggtagacaaggcttgaataatagatttaatgaaaagtttcttacctgccactgataagttaccttccactcctcagctaatcttttccacaaatgtgcctgaaggctacatactactgacagtggttggcaatattaagtattttgtacttcgattgactctagtgtgaaactgagtttcctttgtagtgccatgataaatttgatatgactgtattcggtcaacagtatcaaacaatggcttagcaataacatttttggtgggagcatgtaagagcaatattagttttaagtgaaaattatgtgcccgttaattcattgcgataccatatctaattggtatgtaaggtgaccacgaggccgccgcacgcgaaccggttgatctgcaccagcagcacatgcggcgtcggcgcgtccgtgttgaccggcgggtggaggcgcgcgagctccggcgacggcgcgagcgggaggtggtcagcgagctcggacgacacctcggcctccacgacgagtgcgccggcgccacctctgcccgtgacgaagaacgggcggcgacgggcgccgcggcgctcgaggcgcgcggtgaggagcgggaagtgcgggagcatggcggagagagcgtcaaggagggcgcgggtggtcgggttgggaggcgagaaggcgaagaggacggtgacgtggtacgtcggcgcgacgaggtcgaacacggtaagcggcacctcctccgtctcgcatgtcggcggcggcggcacgaccaaagtcctcttgacctgcacttccattgtatcaatctggttagacagatagataaacgatgctcttgagtgatgaatggatggtggcaatggttcatgtatatatagcatggccggtgccgcttgtgtacatgtattgtatagagtatgtcactaggagtggattttgattgctcgaggggccctcgttatttgcgtattactcaaatggttataaaaaagttttaaaaaaataagaagatgtgttattatgtgatacatcactctacaaatattctctcgagggaaactatcttgatacatcacataataacacatcttcttattttttttaaattcaacttctacatctcatagaagaaagacgagcggacattctctcgagggatcgagatagtttcccgtatgtcactggctcagctgtcttgcgattaacatttgaagtgtgtacgtgtcaatccgttgaggcatgcaatgcttgatttgttgggctgccaggaattcaaccgtgcatacgtgcgatgggtcttagttgtacgggagacaaaaatacctactacgagtactaggaaccggacgtatatacgttcagatgaagcaggtatacgtagacagtgatcaagattgcgtggattactccgactccgatcgaatccgagtcctaatcaatctcgttgtccctcacatcgtcgactataataaaaatctggtactcatccagttgttgcaacaacgcaaaagctggtctgactgctgcaggcgatggatccgccggctcgcagattgatggattctcgggcggcgcagttggcggcgccacttcctgatccatactcggcagaaacatttgaagacctactccgagaattgggagtcgaccctagtatccacaccatagtccgtagcgccgggagatggatggatccggcagcggcagcagcacgagttccagtgagattccaccgcacgctccaacccccacggaatcgaccccaatagcgaaaaacgaagcatccgcgacatgttacaagaggggatcctctagagtcgacggggaggcgttcancattccatttggnggggtgtccaatagactgcattatcgc

SEQ ID NO: 22096 - DNA, 28543 bp, Oryza sativa
  unsure (1)..(28543): unsure at all n locations
gggcggtttttacttttgggagcagagcagaaaccgcatggaacaaaaaaagccacgggaagaaagttagaagacgaaacaggcttcccgttgtccaaatagtatatgattgtaaaatggatttttgttgttcgaggctacgtttctttacttgtgtatgtcggtgtatgccattttaaaaaatcattaattattttaataaaaaatattaagattaattaaatatgtgggggtgtcactcgacaattatgtaatttcaatttgatatatataattaaaaaataaatttaactatgaatgacacattttattcggagccaatttattattttcatttcaagctgaatttgagcttgtattttatttatatattgtattattgatctactttttattaatatttttgtgatttttcaaaccgtataaaaaaataaaggagtgtttccttaagagacgaataaactttctcacgttacatcatgtataggctgtgtttagatccaaagtttggatccaaatttcagtctttttctatcacatcaacctgtcatacacataacttttcagtcacatcatctccaatttcaaccaaaatctaaactttacgctgaactaaacacagccatagctgcactaatccaagtcggaattgccacctgctctgcagttgctgccaatcttcttaaacagtacggtatgtactgctcctagtcagagtatatgacaataataacaattatgtagttgaagtttatttttttaaaaggtagttgaagtttattaatccatcgtacatcccatcgatagattacgtagaaattaaaaaatttaatggtaacaccattgctgctgcaaccgtaagataactagttaatcggccagacccaacagttcattaaattttaggttaattgtgtgctggtaaccaaagtcaatcagctgctgcttgaatccagcagttccttaatttcagtattaccatacatgttagcccagtactgctagaaataagttatcatcaaacagtaaaacactactagtagcttattattaatgaggatatatgtgtttagtttctgaaattggggagaagttcgggggaaagttgatagtttagaaaaaaggttaggagtttatgtgagtaaaaaagttttggatgtgatatgatgtgatgaaaagttgaaagtttaggggacgtttgatgtgaactaaacagagccctggttgagcatcagtagcaccaacaatgtgcaactaacttggcatcgtcagctcctacgtcagtcagtcaggccggccggccgctaggcccgacaggtcgttgctacttcaatcaactcactctcacattgccaatcaattcactactttcacattgcctgaaccacgcacacatgctgacatgcatgccaaacaaaagattactggagtacaaaatggcacatgcatgcatacaggattttatttatcagtctacatcgtcagcttgtccatatgaattcaataattgcatattgattttgtgtggcaaatatgattaactcccagcttctccatcactcatgattaactacttaacaaacatgtgcgtagagtgcaaccctcgatctttgtgtaaacaaaaccagtactatactcattattttaccttggtcaaaagtaataatgtttaattagtggcttagatgttgcctcgttttcatcagttagcagtagatcactttgtatgctgattaattgaagaatgttctcatgtatactaacatttctttatagccatctttagcaatcatggtttaacgtaacatatacaaatttcacgtattcgattaagctacaattaatcaatagccaccactactagaaaaacgatttttatcgacgttggccttttattttccaaaacgggtatgaccctcgaagctaaatatccgcctatgaaaatataaaacggggtggatttcgtcatccacctgcgaaagtcctccaggcagaggtctgcctgcgaaaaataactttattttcacaggcggacctcttaagtggtccgcttggaaaaattgattttcgcaggcggaaccttatgtggttcgcctgcaaaaatcatacctgccccaaaaatatctttttaagtctttcttatcttctcctccacccctccccacgggccaccactcatttccctctcaactctctctctctctctctctcaccggcccgtctctctcctcccatccccttcctccctctctccctcctaatccgaccggaggaggggagcgacgtcggcggtgcaaacgcggtggtggcggtgtggatgacgacgttggcacggacggggcgatggtggcggcggctcccccctctccttccccagtcctagatctggccggaggagggggtgcgacggcgccagcgcggacggggcggcggcggcggcggctcaccctctctccctccccgctcctagatctggccagagataaatttgaagagtctttttagaatctaaaaaagttagattttctagcttctgacttctattttattgcgtaagattatacaactacaacttattagaatctgaatgaaaaactaaattatttggagagcttctgattatgagagaagctatagttattcagaatctctccaaaaaagccctcagtgtcatgcccaaattcaatagttggttgaggttcacgaatctcaaagcaattcataaaattagtagtaattgttaatttaaatattttgattaattgaagggcctgcattagtatgtatatgagaaaatcccctgtgtacccttggaagttcacctaatcccttctgtacccctgaattgtgctcaatcccttatatacccttgaattttagtttggattccttccatgccctttccgctagttaaccgttaaattcttatgaaaaagtccattttgccctttggtataaagaagcatataaattaatagagtatattgttagagcatagaaatttgttatatgagactattatgtttatgagatagttatgcaccatattatttgcgataaatatacttttagatatgacataaaaaattaatacttatttattagttattaaaagattttttttagcatatgtgttctgaagtaataaacaaatctgttgtattactatgaaaacacatatgctacataaaagaacttttaataactaataaataagtatcaactttttatattatatgtgaaagtaaatttgtcacaaataatatggtgcatcacatactcataaatataatagtctcatccaataaatttttacattccaacaatatacttcattaatttattatgtttcttcatagcaaagggcaaaatggactttttcaaaagaatttaacggtcaactaacggtcaactagtggaaagggcatggaaaggatcctaactaaaattcaggggtatgtaaggggttgagcaaaattcaggggtatagaagggattaggtgaactttcatgggtacataggggatttcctctatgtatatacttctatatagcactccaaggtggtatgatcaatggagaacatatataggagaaattaaacacaaactcatgatataactcgataaaaatgtggacatcaattgaggggagggggaatcgaatcaggtgcagatgcgcgcgattgatgatgcatgtgggtgagtggaagagagaagaatgaagtgggggttacctgtgcagagcgtgatgatccagacgaagaggaagctcctgtaggggatgccggagctcgcggccttacgccggtcgacgccgcacctgggcacctctcaatgcagtacccattgccgatgccggtgctgcccttcttctctagcagcggcgcctctgcctgccgccgacgtccatgatcagcttcctccccacttttcaattcaccaatctcgctcgctgagatgtcgatctctcaggctggcattgttgtaaatttgatcataattcggtatattttaatctaaaataacaagataataaacataacattcacaatagtaagtaatctagtggtgtgactaaatagaaatatgggcatgcttttcataacataagcataagcatcatcaacattcacataggattgtaatcctaaggatagcatgattaatatataagtaacatgaagaacatcaattagagatagaaccatatacccagaaaacagtgcagaggaggttgaggcatttgtattgccttcgttggtattgtctcctggagcactgccgttccctcctcctcctggagcactgccgttccctacagctcctggtgcgccatctccaatggaagccatcgcgatgcagaggaagaagtcgaagcagaacaggagcagttgcgccaatacgctccccaaaaacttgattgcctgcctactcgtgcaagtacgcaagcagacggagttccggaacaggagaacagccgggaagaaagtgcgagagaggaagaacataagtgtgagcattgtgtctgttcatcccgttagcggaggatttgtagcgcatgcaagagttaagttcggagaattcaatccacgcgattaacccgagttaatgcgattaatcgaggaggatttgtagcgcatgcgagagttacattcggagaattcaatccgcgcgattaaccccgttagcagaggatttgtagcgcatgcgagagttacgttcggagaattcaatccgcgcgattaaccccgttagcggaggatttgtagcgcatgcgagagttacgttcggataattcaatccgcacaattaacccgagttaatgcgattaatcgcggaggatttgtagcgcatgcgagagttacattcggagaattcaatccgcacgattaacccgagttaatacaccagaatataatgcgattaatcacggaggatttgtagcgcatgcgagagttacgttcagagaattcaatccgcacgactaacccgagttaatgcgattaatcgcggatgatttgtagcgcatgcgagagttacgttcggagaatttaatcggcgcgaggcatgcgagagttacgttcggagaattcaatccacacgattaacccgagttaatgcgattaatcacggaggatttgtagcgcatgcgagagttacgttcggagaattcaatccgcgcgattaacccgagttaatacaccagaattaatcatcgtccgttacaaaacaagagagagagcatccgcgcgattaacccgagttaatgcgattaatcatggagtatttgtagcgcatgcgagagttacgttcggagaattcaatccgtactattaacccgagttaatacacagctcggttaactactagctccatatttaagttgagatctcttcacttaaattttcaaggtgatattattacccatagcactaaatttaggccattgaaatttattgggatttaatttggcctagcccattaatctaatagacatctatcaattcccttaatttttcgatagaaagttttaaattttacatggaagtttatttcacatatagatttcttttcaatatgtaagtaaacaaaatctttttcttaattatcattattattctaaactaacttggttagttatgggagaagaaaaaatgcatgccaccactctattagttacgggagaggagaaaacgcagggcaccactcggttagttacgaataggcatctgcatggcacggtcagccatggagcatcggtcttctcgagctggccgccgccgaatccgtcaatgtacactcgaagtgggtctcctatttgtggagactaaaaatagcagattgtgtggatctggcgtgctgatcagttacccaaaatcaaagctacattacctaccgtgctcttgcgtttacacttggcatactgcctgcttcttctttttttatataaatatatagaagtagtgccaggttgatggagagaaactaaacgggcgctctcgtacactgaagacaacacactccgcacactgaagacaacacactcgcacaaaacaccacgcacgcctgccattgctggatcgatcgagatggtgaaagcaagtatgaagccttattttgtcgccatcgtcgtccaactgatctacactggcatgtttgtgatatccaaggctgctttcaaccacgggatgaacatctacatcttcgtcttctatcgccaggcagttggctccctcatcttgctccctacatttcttctagaaaggtactccttccatctacttttgatagtcatatttttaaatctgaaaattttatttttgataggcatatttcaattcaacaacctatcatcttcatgactttctcggatttaatgcatgactctccattcttccacacaatattggctacttgagcatcgtgaaatgtaaatattaatgaatcgcttgtttacgagtaatgactagtagcatgtttaaatggatgataagtagaattacttatcattggtctgtgtgccaagatgaaatatgactatcaaaagtagatgtagggagtatgtaacaacccatctctctctcttgcttgatgcatctgaaatcaaatcaaacaagatcgtgaaattaaaaaaaaaacctagtatcggatggacaccgacgtcaccgtaaaatcggtgccattgatccgtccggatcgccgccggtagatcgcgttctcgccgaggactcgatttaccaataggatggtttgggagagaggtatttatgcgcgttcaagaacgccccggtatgtcgattaatgtgggatagttatgtcgtactacggatttttttctcgaatagaaatcaaaacgggtccacatgtgaatccaatagcgctcttcatcggggctgccttatatggacggtagtatagaaccattttaatttataggatcattgttatgtactcccgggagtacatactctctccccttagtggataaccattagcatctaattaaactggtgggaaaagaatgaaaatattgtttttctctaatcgctgcatggtgcatgcatgcacaggtacaaaccgcatttggtgcacaattgaacgtagggatcgcggagtgtgctgttagtttaaatttgaataatgaacgtaccatcctctaaacagatggatcttctaccattcaaactgattagaaaaagggttataaatattttaagtatataccttttttttaagtactagcagcataaattgtactcacttaattagagcagcatatactattttcttaatcagttatactgattacttctccgaaagagtatgtactgaattcttctcctttgaagagttagtacagtatataccttttgttaagttaatagtagtatatactattttgtaatgtagtaggtatatactatttttaacttagtagcagtatatactttttttaaatgttagtagcatgcagtatatactgtttatttagttactagcagtatatactctctctgttttttaatagatgacgacgttgactttttctcacatgtttaaccattcgtcttattcaaaaaatttacgtaattataatttattttgttatgagttgttttatcactcatagtattttaagtgtgatttatatcatatacattagcataaaattttgaataagacgaatggtcaaacatgtaagaaaaagtcaacagcgtcatctatttaaaaaacggaggtggtactattttatagagtagtagtggtacatactgtttaatttttaacttagtagtagtatatactaaattctaccagtagcattatatgtcatatttttacaatagtagtagtggtatgtactgcttttcaactttgtagcattatatactaatttttaagttaatagcagtatatgcttttataaagtagcagtatatattactccacattttaggttagttgcggtatgtactaatttaattttatctatttttagttagtataaatatagtatatgctattagtataaatatagtatatgctatttttaaagatagtaattggtatggggttgcttagaccctgtttaaatgggactaaaacttttaagtccctatcatatcggatgtttgaatattaattataaatattaaacgtagactattaataaaacccatccataatcttggactaattcgcgagacgaatctattgagcctaactaatccatgattagcctatgtgatgctacagtaaacattctctaattatggattaattaggcttaaaaaaattgtctcgtgaattagctttcatttatgtaattagttttgtaagtagtctatatttaatactctaaattagtgtctaaagacagggactaaagttaagtccctggatccaaacaccaccttagatatgaatcacagaacacactagatctcagaaaaaatcagaatacattaggacatgagtatcaccatgagaagtatctgccactgacagattcacaaacaaaatcactagaaaatatatttgatgctgtagcagcaaactaaattctgaatggagagtatcagtacatcttttcgccgatcaaaacatgcaatacattcagcagatagcagtgccactggccgctgggttgagagctactactggagaacgatcttttgatcgatctgccaaattttacaatagttccggttctgttataaaccgggactaaaaatgatatttcgttctggttcaaaactttttgatcggactaaagtttatttttagtcatgattaaaaaaaataacagaactgccgccggagtcgacatgaattgccgccggccgacagccgtctgcatgcccaattatagggggttaatcagtcaagtaactaattaaagaataaattgaattaccgtgaaaaagatacatcacaattcccaaaccaccaaaatcactgggcatctatgcatccaacatatgtgctcttcccttatagatccaacaggaaaaaataaggatatgctcgatcggcaagagaaggcaaagaaaataggatagaagagaaaatggtgcatgcgaggtgcataacacaccaaggtctggatgaatgattttgcaccgttgccgctgatacttcacgctgccgctggcgtcggcttgccgtcgctcgcgaatcccgaattggttggggactgggtagagcgatctgccgtcttctgggatttatttgggtcgtttgctgatccgattaatgagggaaaattatgtattatttttttcaaataaaacacaaaacgggtataaagtgtagatccgatagtaatcttgatcgggacctcttgctgatggatggtggatgaaagctggagtacgtactcctgggagtatagaatcattttcctatattgttatattgccacttcgcttagtttactatattgtttgattagctgagaaatacaggtccgtttgattatatttgtaggagaagtacacgacccgccatgacacttggggtgctcataaagctcttcttttgtgccttaatcgggtatgcgctcatctttgcaaactctaatttattggtacaaaacaaaacaatcgattgtatactcatggcatgtcaagagtttaattagtccctggtttacttgtggaaattgcttttcaggattacgcttggggtaaatctgtaccatgtaagtctcaagttcacctctgcaacagtggcatctgcagtaaacagctcactcccagccatcaccttcttcttggcggtgcttttgaggtttatcatcatcgatatcaccaaagcctaacttgagaatgtaccataaatagattcaagttagttgtgaaaatattaattataagatgttttgacttttctgaacacataaattttgatatagatatttagatatacaccatatcaacacacataataaaaggaatatgtaacttgaaaaaccaaaccgccttataatttgaatggatggagtagtatataataccaagattgaaatgttgcttgccaggacaggacggagtatgtgaagctgaggagctcttcaggcataccaaggtcactagtgtagcaatctgtctggctggagtcttcaccatcgccttcttcaccggcccgtccataagccctatcaaccatcaccgtgccttcgcctctgacacaagctcgaaaacagtagttccgaggggtgtgtggatcaaatggacattccttatggtggtcgccaacatgtgctggtctttgtggatcatttttcaggttcggatgcatgcatatttaactatttaccaaaaaaaatctgagctgttcttgcatgcttgtctacattgattcacagctgcaattgctgacaaatcggggtctctaatccttgtctattgactgtgtaggctgcggtgcaaaaggaatatccagataaaatggttgtgactgtgactcagtgcctgttcagcacggtgcagtcgtttgtcgtcgcggtggtcgcagagcgcgacttctccagatggaagctaagattcgacatcagcttgctcgccatcctatactcggtaagttgtgcacataaaattttcagtcatcctcttccactagtgtattcactattgacatggtcttcggcacacacatatgactattagacaactggtggtttgcttcagggtgttatggtgacgggagtgtcctactacctgcaaacgtggtgcctagagatgagaggccccatgttctttgcctcctggacgccactctgcttcgtgttcacaatattttgctcatccttctttcttggagagattgttcacctcggcaggtaaattaaatcatatatatactcactgtcagctgatcaaaggtgcaatattctaaaaacacgctaaaataaacaaactttccttttctgctcttcctttattggcagcatcttgggtggaattttgctggtcggaagtctttacaccatgctctggggtaagagcaaagagggtaatgagactgatgatgtcactgatgacgatattgagaaatctacacatatctaccccggagagcaacaacatactacaacagatcaggccaaagaatcgacgttgacaagctcgacagctttgcacgtccaagaactataattttatttttggcatggtagcccttttatttagtcaccttaaattaggtgacagtcggcctatttgaatttggctcatgtgttactgtgttatatgagaccgtggaattttaattccaccttaattagttgttaagggcagggtacggtaatctataagagtgagtacaatagcaggctacaagtcaactgtaagtatatgtggaggagagaagagaaaagagagaaggaaagcgggctacagattcgtagccagctgtagcacaaactccaatacattatgtgtgtatgagaggtgagaccatatattaatggtttatggataactattgtatgaatgagctattagattagctatagatgatttggagttagtagttggctatgcaattaaacttgctcaaaggctcctatagttcacttcgactaaatatagtcggcaatccactgagggggataaccacgatggtagattaactacgtggagggacgtgcatgatcagaactagatgatgaacacgaagagcagggacacgaagctttagataggtttcgggccatcatggtgacgtaataccctacgtcatgtgttttggtggattgtatattgatacaagatgaggtgtagttatcgggtttttgaggggttaccatgccctccttatatagccgggagatagggtttacaagtcggttaagatctaatctagttggtttacaatgataagcatcaatcaagggatctgatatctagcttatcagatcagatccctatatatctgctaattgccttatggtagacttgcggtgcacgccgagcacctccgagcgctgccgtgcgccacgggtcttcaggtactgggtcaggccattcctggtgggccggcccatgcaccttgttgtgggtaccgggggttataccctccacagctagtccccaagcgccttgtatccattgagcaacaccatcttgagcatttcggagcaagttgacttgtagcagaccagcctgactggtgatccgaccggttcaactggttatcgaaccagttagctgggaatccgaatagttaaactgcctgatagatcttcaattgcataatcaatggcttgccataaggatgtaaggagctccaagtattttttttaaacttctccattcttggtgaagtgtgcccactttagccattgaagaatgttctcatgtatactaacatttctttagccatctttagcaatcatggtttaatgtaacatatacaaatttcacgtattcgattaagctacaattaatcaatagccactgcgataaacaacaagcatacattatatacagatacaaagcataataaggtcatagctttatgattttatctggtaatatcgtttaaaatgtgtcatgcctatattactacttagaaattaacatggaaaaatataaatctatataatattatatggtaccttgccatttgtttttattcacacttgcaatttacgtgatattatgcttcatcttcgtgaaaaatcgagtatttaaattttacaaaccaaaggagaaaggtcatttaaatacttatgtataattacatgacaggatacataagtattgctcctcaaatatgcataactctttattagctaccatccaaatacccaaacaaacatatctgccgtataaacatgacatgccacccaacttatcgatgatctgaaagcttaattacttggggttgaagagaattactatggcacggccagaaatggtttgaaggtccaaatgagttccaaaaattcaataataatcaaaatgaagaacaccatttggtcacctgcgtacaaaaatgtaacaatgagaacacatcgaaaagatggcagacaacaatgatgcaaacaatagaaagatcagagttatggttccttcacaattaatcatgtattggtataagctatgaaggagcatccaacacccaataatcactacttttgataaatcactaacgttaagggatagaaataaatatccagataaaatcaaaatacgaggtaactatcataaagctcaagacttggtgcatttaaccagccacgtggtctattaaagcaatgatgatttttttgttacttatgcataataatgatgtcgtaaatttacctggaaagaaaaatgcatgttggcgtttttgtgcccacgaaaacctacattaaccaatcataattaatatgccaacaagacccatgatacatatcaattcaaccattgcatttttttataagcagtaatcagcttagttactaaccactcaagtcaaatatttattcattttaatgatgtaatccctctgtttcaaattacttcttattctaggtttgttttaatttaaacatttgtatattttgccatcaacttctagacattcatgtagtttaatatcataagatttatgtttgtagattcgccttgatatatactttcataatatataattcacatgttgttaacctatacgattttctagaaattaattgtcaaggatagatacgtttgccttaggacaatactaaaatgataactaatttgaaatgaatggaacaataaaatttattattatattataaacaagccaattaagtgtattttttggaccactaaaattccactcgtaaatcgatctcaagcaaaacctgaatgggctcacttggtcgtaacatgttgacagccctaatcctaaaattcattgcttagatgtgtggatggttttgttttcttttagcttgataactatagactaattctagatttttaccacagaaatactagcaaatatttttttttacttacagaatgcctgctcctgctggagcaaatgccttgaagaaggacattaaagtggtggctaagccatttgcggttgctctttgatgctggggctatttattcaatagagaaataagcattaaaacaataattgtatgtagaaaaggttaataaaatttaattagataacgggatacataccacagagttgttctgaagaatgaaagagcatgtattgatagtaacctaataaatatgtaggagcaaatgacaaagcattagtggccaagacttgtatgatatatgttattcatgcaaatatttgttttgcttataagatataaaagcaatgagttacactaatattatgagctcagtggcgaagccaaaattacacttatattttgcaattctacatttcacgtttatagtttcctatgtgtgattgctagtgtagcaacattttagaaaagacaaattacctagtaacagaattcctaatacttcaggagcaagaaaattacttgcacaaaaaaaattcttcaaatcttctaaatattcaacttgtttgttgaacctagaaaattggttagatgaaattaaccttgctcaaccaaaaagcaatcaaacaaattaaagtgtaccttaccaaagtttagtatgttactttaatgcaagagtagttgtacaatgcatgaggaaataatgagaggtaccacccttttattattgatttgtggcaacatattatactttagcattaatgatgtattccaatacttacttgtactaccatgtacaccggtagtttgcactaaaaagtgtggtatatgcaaatagagaaaagaaaatggaagtacaaaaacatccatcagtgtggtttgttatgagcatggatgaataaaactttaggttttatgtttactcaccacaaagttatttttaagcatcgatgcaatatttactactatggacaaccaaggtcttgagagatatgtcataggaggataactacaaagaattgccatagaaagaatctgcaacaaataagagacaaacattactaaaattaaattaaagataaaactttcactgaataatcaagggaacttgtacttactactgcaacccgagaagtgttgattattcctagaactttcacaatatgtgggtagataaatgtctggtatataagtatgctagcacctatgatataaaagaagatatgagactataccattaaatatggtttctacaacttaaacaaaataggaaaagttgatattgtataaaaaaatttggcaaaatttgctacaaggcactcaaaatttatagtctttgttgtaggatactcaaagaaaatgtatttcttacaggacatcgtgaaaacacagtaattagccgttgtacattgaacacattgtttttttgttatatctagtccaaatggagataaatattttagaaaagacaagtttgcccatagggcatgcttctttttaaccccatcaggtcaatttcgaaccaaacctagactagggagtgagaatgaactgcatcgagggagtgagaatggattggatctagttcgaaccagtccgagtcatcttacaagccgatcgatacaagggcaaatctgtattttccgtgttgcttctctctccatttgcatcaaatataataaaatagtacattaagtgtccaacagctaattaccaagtttttgcgatgttatgtagccaatatttatttctggccatgttataccaagttataatttatgcattgtcacgcatcagtagaaaaacgtcttgctcttcatttaaatataaatacatatcagtaaagctttgtatagtgtatttagctaccctgaatagaatgcaagaatattgaccaatttgataacttgacatgtacctgtaattgcaagaacttgaccaacatcctcagacgagaaatttagtccgccaaattgtttgtcactttcagaccatagagaaaatatctaaaatttgatttcaattatcatcaaaggttggaaaacaactttactaaaaataaattcaaaataacatgtgcaccatatttttatacagaaaggatgctatgaaattaatcatcgtaagaagagaactcccaagacaaaggagaaaaaattccaaataaaaaatattagatatctatacagttataataaaacatatagtagtagagaaatcttagcatatccatgctatcctaatctaatcattcaatttatatataatttccctatgatttcatcggcggagaggaacaaaattgaaatcgagtaattcatttgtctatgttcgtattaataacaagatgtggtgaaattatgaccattggtaatttctcaaatggttcattataaaaaaacaaatatggtatgtgtagagttgcctttaaaagcacttccacagtattataaacttaatagtttttataaacttgttataaaataaaatcaatgatgtagttttaaaagtttgactgaatgttaagcaccaatataaatagaaaatatttaatgttactaaatagttctttgggggcactcccctaggacgagcatgttcaagggcctcaaggcgtattggtagaacatatgtaggttcacaacttgcaagtaaaagaaagaaatgatagcaattatgcatgtaggttacctctgttgattaaatttatatgttataataaaacttgtatgtgcttcattgttttccatgaactaataagtgtgtgtccttcaactaaatgttattatcttgttatacacatggctggggatgaagatgggatgtgtctcatcaacaatttttttgacaacatctacaaaattaaattattacttgttcaacatataagtctatataacacaaaaatgattgtataaataataaaaatgtattaggatctagttgatgcatggtgagaaatagatatttcaattaaatatttatgatatttcaaacattattttataatgattaaataatcatgtggccctttcgaagtaaattaagtctctcttacataaacatagaagcattatttatagtgataacactataccctagttttgtaattgggtgaagtgtttaatcgatatttcccaaaacatggcaacttttcctcaattattcaaacatctggactcatttagctaggaaatactacaccattagtctagacatagttggtacatacctctgtgtaagccatgtcatcaaaggagacaatgcagaagagaacaatagatgacattaatggccaatttttaaataagctcttatctttagctggtccagtgtgttgcttgacaaactcttcggagtcaaccaaatgtgtactcaaagatccaattttacaatctccatttctttctgttgcatgtttatgtagtgtttcctgaaattttatgaaacacattattttgaaatgaaaacacattattttcctgaaagtattagcaaaatattaattaacttttgtattttagtagttaagataaattttagctaagagaagcataaaaacaagaattatgtgtgcccaaattaatatcaataagaataaaattagctagttgtgcacataccgggagccaaatgcaacttatgagaataacgaagcagaagatcgatatacataaacaaggtagaaaatatgggaacctaaggaaagattttcaagaatcagtcatttaaggagttataccatctagaacaattatatttcctataacaacgataccttccaaataatgagtttgctggaaatagaattggatatttttctgatggctgtcaaatgaaataaaagcatcataatagcgtcaatgcattgtttaagcatgcacccaactcatatggtattaaaatttagtaggatacctgtgcaagatatccaccgatagctggcccaacaatgagacctattgcccatgatgtgctaacctaatcataaaaaaagagtgtcataatgtaaagtgcaatataactatagtaaaaaatattatagaactttgtagtataccaatgacaatccaatggattgatgctctggtcgacaaacttcaacggcataagcctgtaaagcccggttgtagtatgctagatagttatagtatttcaatagtgaatagcaaatatgaatttagataatttaatcaccgtactcttattggtccaagtaagccattcaatgaacctataagaaatcgtgtagttatcgccatccaatagtgtgtacttagtccaaagagagtattgaatacaaatctgatttcacaacacaaggtaaagtaatcataggtggatataaataaggtaatacaagtaattactaacttggttcaatcggaactgaactaaaaggtacttaagctgaaaaaattccaaaaatgataacaggcttcctcccaatacgatctgctaccatcccccaagcagtggaagttaaagctctaccaaacatatatgacgcacctaatatgttgagaattataatatgtcatgtttgcgatagataaatgggtgtaaaaaaacatttgtcactactaagtaaaagcatgacctttggtattacagacattataatcgcttacctacaaaacctgcatagaatccaatgtcctctactctttttgcaacatgcaagtctcttatctgttgtggacaagagaaatatacaataaaaataaatgttataatctcttacctattgtgaagaagagaattaaactatgagcttaccttttattcaaacaatgattagccaaaacatatgagtatgagtatacatagcaacatatatatgactatacatagcttgaagaattaggaattaggtggtaactttactgttatttccgtttccaagactacaaaaactagttaatataaatggaaactagagaaatttgaattgctacatgaatgatgaatatcatttcacgaaaccaaatgataaaattatgcaaggtacaaattccgctaatgagaaatagaaacagctaatttacactgaaacttatacaatgtagagcatcttttggtgctattgtaaattttacaatcataaatacataccatgaagtataagaagggaaataacgatgatattggcaaacctgaaattcaattataaggatgaaattcaataaaaaaaatattgtaaggatgaaaggttaaaaatctaccatgaaaggctcacaagcccgcatcaatggaacgagctaagctaatgacaagataaataaagatgcaaaagagatgcaagaaacaacaatttagaattttgcttcaatagttcgaccaacggttacaagctagaactttccttttagcccccttaattttagacactaatactccctttatttttttaacttttaacgtgacatttgaccatttctcttattaataaaatttatatgactcatatttttttcatatttatactaaattcttgaataagacgaatgattaaacattatgccaaaagccaactgagtcatctatataaaaagaaaaaaatagaggtagtacaaaataatcctctataagataaattcaggtgaactagaaatgactgataaagcattcacattttgcaatgctggaggaaatgaaaaaaaatggatatgcaaacataatagggtccgtctaatacttgagcaaccatgggtccacggtgtgcacgatcacgtttacacacctaagatggatttgctaaggcgcgagcgcgacgactcagatttctcggtcatgtttccacgctcgtaggcttccacgtgcatctttttctctcttttctagaattcagcccaacaaaagcaacatggcccagtaaagaaaatatatttatatatagactttacatgtctaaaatatatatacatatatagaaagagaaattttttatatagaaatttgtgcatgtaattttttataaacatagatttcaactgaattcaacgacatgttaatctgtcccaaaaaataatatgtagtaaattttatacatagaaactttatgtatagaaacttcatacgtataaagtttgtatcatatatacaaatttaaatgaattcatagaataaaaaaagaaaaatcatgcatgcgggttgtgaggcctaactggttggtctcacctaaaattcaacttggtcaaataaaattaaatgggaaagagtaaagcctaaaaggaaaaggactagcctaaaatggaagaagtggctatattcgtattagagccaaagagaatatcacgcttcacgttatagatggccatatggcccggggcccgatggcctggccgaagacacggccattttgctgggcctaagcacggcatggcctgactggtgtcaagtccgtgtcggcatggcccgatagttgggccatgcctaggccgatgccttggcacggtgggccggcccggcacggcacgatagaagaaaatagtatagggatccaaaatagacttaatcaacaatataaggcaatgccaaaagagaggtgtaatacaaaatagacttatttctagtcatataagacaacccaaagagttgagggatgaaaaatagacttattctatgaagaaacacgatggtttgtcgtgccttccggctggaccggcatggcccgagtcttatagggttgtgcctgggacgtgtgtgcagcccgtgagctggcacgacacggcctaacatataggttgggccgtgcttgcccgactgacctcggccgaggtacggccgtgcttgggccgtgccgagccgggcggtccatttggccacctatacttcgcgtggcatgggattggtcagagtaaactgatcgcgtgggggtgggtgaacgcgagcgctcgtccattagctttttcgaatataacatgaataataaggagattggagaggcagtcaagcaggaagcgaagcatgcatgaacacgtaggagtataaatgaagcagtgatcgataggaggcgcgtacgtacatgagacgaggatgatgatccagatgtggaagaagcgcatgtaggggatgcccgggttgaccgccttgttgcgctccacggcgcaggcggggcagccctcatggtattggtacgccgtctccagcaccagcaatggcgtcgcagcgtcgcctgcagccatctcagcttcttcctctcctcttgcttgctgttcctgagctcctgactccagggtgggatgatgagatgtcttggttcacaaccaaactgatttattatgtcggtcgatagcgaactgacgttggctcgattcgccattaattactattgcgatcttgagcctgcgtggcattgctgttagtctcacactcgagctcaattaatctccatctccaccgcgagtccgacgaaaaataaatgtagtgcacagcacacagcgtatcaatggcgactgtttttgaatgtgagagattagcagatggtgatggactgatggctatggttatgtctctgttgctgtttaatttgctgatgtctctgccatggcaccatggcaagatgcacatatgcaatttgggcctagtttagcttcaaaagtttacaggcctcgtgagaaaggcccatcctaacatcccctctctgttgtcatcgtcttcctttcctttcctttcctttccttggcggccggccatggcctatggctttctctgccgtaactcgagttgttgatggtggaggaagaagagaagcagagcagcgtggggaggtggcggtgtaggtggctcgtcgacgtcggccggtggcgcccctcccccgctgagttccaagccgccgccgccctcctcccgccgcacgaccgccccgccatccacaggtttttccaaccaattcctcttcccccacattgattccacccactcactactgaaattcaattcagcctctagatttttctcctcctcctcacgagtcacgacctcaccgctgcaggttcgtcagagaagatgacaggaaacgggcgctcgtcagtcgccttctccaatactcgctcgtgcaccatgctcttggaatcccattccaccaaattcgcatcaaccgcacgcttgaagggaagccctacctggtagtagtagtagatattcccatcaattagttcatgtctgctctgcatcccaaatccatctctttcagtttcacgtttacagtctgtcagtttctgaagcccaaattgcaactgatcacgtctgctgttgcagcagaataaaaatgccaactttcctggcttcaacttcaacacgtcgcatcagggggagtacgttggcatagcatctgagcctctctgcctcgttggcctggacattgtgtgcatctccaagcctcaacgagaaactgccctggagttcatcaacaatttcacttcctatctcactgatcatgagtggaactgcattgttactgcaggcagccatgatggtatgctaactgagttctacaggtatatgaatttgttcttgttcaattttttttattttcagaacaactgcagggtgctgatcatgtttacaagccaaaatttgtggagttacttaagatttaacgattgtctgtttttgtaggtattggtgtcttaaagaagcatttgtcaaagctacaggtgctggcgttggatttgggttgcaacgtttggaattccaccatatgaattggactaatatttctctccgtattgatggagaagaggataggaaatggaggttttggcttttcaagattgatgaaaagcatttggtatgtctgaattttttcacaacatctacagtgcctaaactttggctcttgtacttctagttttggtcttgtgataggttatttgcttacgattatcaacaccattgcaggcatccattgcgaaagggcatccagaggatgctattgacagcttcaggagaacattatctgatgtggttattcaggagggagaattgcatacggcaatagaaattccagaagaagctttcactctattgacagtggaacaacttatacagttacatgattaaatggtcttcttgaattttgcggtgacatattaatgcaggactaaaatcaacaaattgtgagtgtatcctgaaagttaaaatatatacatagcacaccaaaattaggaaaagtatccttgtatttgctctcggtgcttctgcagaaatgagagcttaggggttagggcctgtttttttttttcataacagagaagacacttgatattgtaagctttgactagtttggtagtgtttgcaaaggcccatttttttaggcaattgtaaaggcagattgatgattgttcactggaaaaatctaatcaaaaaaactattagcagccaattgatgattggtcacaggaaaatctaaccagaaacaattattagcagccaagaatagcccgcgaccaaacctacgagacgctgaaaatccaaacggaaacaactaccgctcacttcttcccgccatttcctctcaacccatcaaactcacacacccatttcttccttctaccaaaaattctctctccgatccgtgcctctccgtcgccggagcaggcacgcgcgaatcccaccgacgccatgggccagtgctgcacgggtggcgggaaggccgtcgccggcgacgaggcagagccggggacctccaaggcggcgccgccgagccgcggcacctcctccaaaaatgggtccgccaagcagcagtccgtgctcgccggcggccaaggcggcggcgaccgaagcggcggcggcggcgtcttcctccaagaagccggcaggccccatcggcgaggtgctggagcggccgatggaggaggttcgcacgacgtactccatcggcaaggagctcgggcgcgggcagttcggcgtgacccacctgtgcacccacaaggccaccggcgagaagctggcgtgcaagacgatcgcgaagcggaagctggcgaaacaaggaggacgtcgacgacgtccgccgcgaggtgcagatcatgcaccacctctccggccagccaaacatcgtcgacctccgcggcgcctacgaggacaagcacaacgtccacctcgtgatggagctctgcgccggcggcgagctcttcgaccgcatcatcgcgcggggccactacacggagcgcgccgcggcggcgctcctccgcgccatcgtcgggatcgtgcacacctgccactccatgggggtgatccaccgggacctcaagccggagaacttcctgctgctgagcaagggggacgacgcgccgctcaaggccaccgacttcggcctctccgtcttcttcaaggaaggcgaggtgttccgcgacatcgtcggcagcgcctactacatcgcgccggaggtgctcaagaggaagtacggccccgaggccgacatctggagcatcggcgtcatgctctacatcttcctcgccggcgtgccgcccttctgggccgagtcggagaacgccatcttcaccgccatccttcgcggacagatcgacctcgccagtgagccatggccgaagatctcctctggagccaaggacctcgtcaggaagatgctcaacatcaaccccaaggagaggcttacagcattccaagtgctcagtaagtttatttgttacagattaattactcaaatctgctcctttttttttcatatagaggtacagtttggattaattttccctttattggtgtcagaattaaatttggattcatttggatcaatttggatttgcagatcacccgtggatcaaagaagatggggatgctcctgatgtaccacttgacaatgttgttctcaacaggctcaagcagttcagggccatgaaccagttcaagaaagctgcactgagggtaaatattactcttaatcacatcatcagggtagatatatgcatcttaattgttgttttgaatcttctgtagattatagccggatgcctgtcagaggaggagatcaaggggctgaaggagatgttcaagaacatcgacaaggacaatagtgggaccattacgcttgaggagctcaaaaatgggttagcaaagcagggcaccaagttttcagacaacgaaattgagcaactgatggaagcagtgagtcctcatagtgaagctacaaacttagttcagttcgagatgaaatgctaaaactgacaggactcctggaaattcctttcaactttcaggctgatgctgatggcaatggaattatcgactatgaggagttcgtcaccgcgacagtgcacatgaacaaaatggatcgagaagagcacctttacacggcattccagtactttgacaaggataatagtgggtaagttaaggatagcaaaaactgatataactgaattctgaacttcagggatttgtacacatttatgccatccctcttgcaggtacatcacaaaggaagagctcgagcaagccttgaaggaacaagggttatacgacgccaacgagatcaaggatgtcatcacagatgcagactctaataatgtaaggaagaaatgctctttaaattgtgttcatgcaaaacagatgaaatcgataaagctgaaaatatttgtcctatcaagagacgctgaatgcatttttcacatgtaggatgggcggatagattattcagagtttgtggccatgatgaggaaaggatcaggctgtgcagaagcaacaaacccaaagaagaagaggcgagatctagttctatagcgaaacagggtagtgtgtatagtggctggtttgtgcacaatttcaaacatgatgtgcatttaccacgagtgtaatgtatacaatggaattttctttccaattgcatatttgcatttcaggttgggctcaggttcatgtttggtcttgcacattgtcctggctagttgttgggaagatggatttgttccttctttctgttcagtcatcttgtacactacatgattgaatcctacctgattagaaagcccaaaagattactggtacattcaacaagaacagagaaagcatgcctctactgcttgttgacagataaaccattgagggaagaacagtaaaatggttggaggttttcagaactttcaaacacgtaatgaagcactctgcaggatcagttgttaaacatatgttccttccaccccaggaaataactaagttaataggatcctgatcagaataaatggcttgagccaaacagtggttttcatttactatgttatagccagatgagtatgagacgataagagatacataaaggtagtttcaagaaacaatattcatcagatctagtttcctcggtaattttacaaggatgtgatgatgcagttgagtagcattatgaagcaagacctggagtgcggagatctactcatatctgaagagcatcacaatattacctgcctataaaattttcttcactccatatcaatgaagaatccagggtttcatcgaactaaccaagtaataaaacaactgaaaatttaaaatatacaatgtcaattcaaagttaaacaaatgcatgcataaataaagcataccaaaagcaagttcactatcactagggtgaacaaaaatatatctcaagttttttaccagataaattggggattctcaccttcctttcacatccaccaaattgtgaagctactcctaaactggttataaaaatgaacacttccatcaaacagatttttctcaaggagtgtcacgcacatacctaggaataaaatcatttagcagtttgtagagaaccattggcttgtagtgcttcacgctccttttgacgacgttctctctaaattggccacgagattacacatcaagaaaacttcaaattgtatgtaatatatcaagaacatggtatagaaaggaagaacatcataatagcacaaagatggtcctagaagggcactctttattgtaaaaatttgtgggtagggaatatggaatttcttcaccaaattgtctgtcgaaaggaagagttagggatggtttgttcccgaaatctatggaggtagtcttttttttttctgttaaccgcaccggcggcacgtaagataatgattgtactaagcatgctgatctccggttcttaaacgggtttaatcaaccaaaattgaacagccctaggcagagtagttgatatgacatgataattacatggcagatacgatgttcccccaaactaatattcaaaagtgaaaattgttgggtcaatgcagcgaacacgaactactgaattagtagtccttaagcccggcaatggcatatggtgctaatcataaaatagaagaaagttgcagcacagccgcgaggcatttccacaaacagctggcgcgcatgctcgagacaagaaacaatcaacagatgcacggatcaaacggtgcgggcaaaggcttgaccaagctgtagtagggcaagaggatcaaagcgttggcttgggagatcggagtgggggatgaaggtgggtgaagaagaaaagagggaggcggcgtaccctgcgttcccagtaggggtggaagcagacgaagtcgtagacgggggtgatggtgttgaggagcaccaggttgactcccgtgaacagcagcagccccgtcatcggccgcgcgcggtgcggcatcctcccctcctcctttcctctcctctcctctcctctcctcctcgccttcttcccgattagtcgacaactaaacgcagaggttggctgggcgacctcgctggcgcgccgtccacctcctgtgctgctgctccttcgccggcgggtgtcgcgagttccgccgctggccggcgcgccggcgtgtgacagagtgtgcggcgtggaagggttttctccctcctcctgacgtgatggtgtacatgggcctcaacatgcggcccaatataaagcccacgtacgtggctgaggccgaatacatggcccgtaagcagacgtccagcccacccctcggtgagcaagcccatcttagagcagagcctagctggctcgggagcgaaaactccgaccccgccacctcagcggcatatgtcacgaaaatatgacatgccattgcttagaacacagtatgtttcaatgttttcaatggatggactcaggtacaacaaaactgcattacaaatttgcagacagatgcatttaatacaaaaaaacaaaaaacaaaatgaaattcgtgttgatagcctctcagatcatcagaaccaacaattgcaactgatggcatagtcttctaacaccaagtagtaatacagtggaggtttctgaggctaatgcttcatgatatctatctagtgcacaatggatctgaaaatcttcggtcgagatccttcgagttcgtaaatccttctgataaaacggtatttacaccagctcacatggtcctgaaataatctgctagcctccgacaactatctaagtcgtacaccccacaaaaaaaaaactatctaagtcgtactaatatcaactttgctcttggaaatttggaannnnnnnnnnnnnnnnnnnnnnnnnnnnnnnnnnnnnnnnntcgactgtcaaacaaccacg

SEQ ID NO: 22097 - DNA, 8667 bp, Oryza sativa
  unsure (1)..(8667): unsure at all n locations
ccgtgcatttggattagaactncagctcggnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattttggcatatatttcaatataaaatcatgctgaatatcacacgttgtctgctgaaatgcatattatttctagtgattaactgagtgtaaaccacatgagctaacaatttatatgcaaagcagtagcaaaccatccgtagacaatagcaagaacaatacctctgtataagccatatcatgaaaggagaagacacaataaagaattatggaggacatcaagggccaattgctcaataagctcttcttgcagtccaaactaccattttggtcagccttttcttctggatcaatcaaatggctctccaaagcttcaacagtttgagatctatttgcatcagctttatgcttgtgtaatgtctcctaaaatacatttcaagatactttacaaccatacaaaaagaattaatacaaagtaccaaagaattatcctttctcactatgagtcatgctaaatattgatatttctgctaatgcacaagtttttaagagaaaggaaatataaatttgacttaaaaaagtaacaaaagagactattaattcctgatgaaatggaacaaccacattaggataaaatgcatattatctccgttataattactagtaactgattttggttgctaagcatgcagcaaaacttttgatttcttttttcagatccatgtcataagatcttccacagtgcaaatatatcaaatacaactaaatatatgtcaaattacactgattgcatattttgtgaagctagcaattatggaatctgacttaccggcatccatatgcagcctatgagaacaacagcagcaaagactgatatgcacaagcagggtaagaaatatgggaacctgaaaattttccaacaaaagtaagtattctgtagatgaatcataaaaaacattttgttgggcgttggtacacaagatagaataccttgcaaacagtgagtcaggggaaaagacattgggaaatttctctgcaggctgccataaaagaaatcgtattaaatgtagccacattgttaaaaaaaaatccctaacactgttcaattctctgtgacatacctgtgaaaggtagcctccaatagctggaccaattataagacctattccccatgccgtactaacctaatattaaaaaaaatcaaaatcaacacaatttaaacagaaaaaaattaataacagaacagtatggcatgtatttacaagtgacaatgcaagagcttcatgttcaggtcggcaaacttcaatagcataggcctgaaaggacaaatataaattgatcaagatcaacatgaccaggtacaagcattggaggaaaaaaaaacatgaccaggtacaagtacaacaaaggaaagtttcaactttattgtacctttattggcccaagtaaaccatttaaagcaccaagaaggaatcttgtagctattgccatccaataggtgaaactaagcccaaatagcgtattaaatatgaccctggtaccattataccaagaacttagttagacaaacaccaataaaaagaaaaggaactgctataccggagtaaactaggttgtgccagatatcaactattatttcatatagaggaggaaaaatatcactaacaccgcgaaaatgccaaacacaacaactggtttcctcccaatacgatctgctgctattccccaaatagttgaagtcaaacatcgaccgaacataaacgaagcacctataaggcaggtaaataaggaatcagtcaaggtgagagccagagttaatcttaaatttgaacaagcaattcatgagaaatttacccacaaagccggcatagaacccaatatcttctgtcctttttgcaacatgcaagtctcttatctgtgtaataagacacgtcttgaagacttaattgctagagtaaagatagttgtcaaaaaaggagataaactaccaacaagaaaaaaaaatctagttttagccatcaaaagaagacatgaagataggggaaatttaactatttgccactcttgtgacatggcaattaacgatttgccacaccgtgtctatgacatgtgggccctcatgtgtctatgacatatgggcctagtggcaaatcgttaagcaccactcgtaagagtggcaaatagttaaaagcccctgaagatagacataccatgaagtacaagaaggggaacaatgatgatattggtaaagctgaaaagggcagggacagaattagaaatcttgagtatgcactgaaaatttatgtaaaaaaagaatagatgggatatgtggttacgataaatacatttaaaacttttgtagatgcaagtggtgataacaatatttattatattattacttagatggtgatatcaggggactacttgagaacttctctacaaacaactaaatgatgctggtgagaacagggataataaaacaaggtattatggctagttgtacttgaaatgaagaaaatttgaagtgctagatgcttctcagattttgactgttccacgcacatttttttaagcaatactctgaaggaaacaagatagcactcaatatcctcaacagcagataggaaacgatgttcaagtagaaaaattaatttcatgttccactattgtaaaagagaaagactactgttcaatgcaaccatgatggagcttttcatctaaaaaccatgatggagcttatgcagaacaccagaacagcacatggaacttcacccctaaaaaatatgcacaattacatatgcttatataggacacgtgggaaacaagtcatgcatcagttccaagtttacagtttacacaatgacctttatcacgatttggagcggtataaaaaaatatgttaaaaaacatcattaaggaaaatcagttaaaggcattttcgcaaatcaatattgcattgcagactgtatgctatctaatctaacacggagtaggacattttagtgtatgcttctgctgactgttgacatagatgccatgtagtgttgtaaaaatttcagcaaccgaggtaggtaaaaaagatcacaaacacaatgaagaacctaaagatctgcaaggtctgaatcagcatcacctacagtcccattattggatatcctatcaatgaagttgggttggactattggtgcgatgaaagattacaggaattaattatgtgcccaataaggtttggatgactggcactatgacataacaggaattaattgtgcatctaatattgttcgcacagtgatgtccctcaaacaataaattttctagttaacataatagaccccccagctaacccacatcacatgaaccaggacgtggcattgcaagtttgcaactgtaacaccatggacaacgttatgaccggtgtaaacggtcgtcgtgtgtagtatgagtcggagcatcacatcacattgtaattaacggttgtaagcagcactgaaagcaaatatggagaagtgcgtggtaaaaacagcaacagcatgtcaacatcccccccccccccccattatggaaatcttgttgaggcaattggcttaactaacttggtcctgttaatctattatagagaatcagcgatttccccacaggaacaggaatcatcgacatgactgaacaccgaccaaacccatatggaactgcacatggacattgcagtaacatgtagcatttgcaagaaagaagacatgttcctgcaggtaccaagattccctatgttgtcatgttcctacgtggtaccaagattctctttgttggagatattcattcgtactacactagaaaagggaaattcctagagcaccatgggttaaaaagttgaagaactttaccccagaatgaatctccagagctagtcaaaaggttgcgaaaaagggagggaatgttccatgcataccggcggtgaggcagatcatccagagatagaggaactccttgtaaggcaatcccctgtagacctccttcttgcggtcataggcacagccagggcaaccttggtggtagtcccccttgatcttgagcaacggcacctccgcccccgcctcctcttccatccctcccaccgccgccaggcaaggcaaatgggcaatgcgcccgagagatctccggcgaggagaggagatgaatcaatcgactgctacacggcacgcgcgtacctgtacctcaacttcgctgccggattgcagcgacccgccggaacgaattgaaacagggaggctcctcggcttctcctcttatcaatcggcaaagaggagaggcccagaatggcgtgcgccggcggcgagggagagccaggcagaggcagtctcctctcctctccaaatccaagctccgttccgtacgtggaattcccaacaaggaaagccaacaacgacaagaagacgaggaagaggaagccaaaacggagtgagcgagccgtggtcgtcgctttaacattccaccccgcgcattgccacaaacaagaatgggtagaatataccatcatatgtttagctccatggaggtgggtggtagtggaagtcatttattagtaggcgaaatttaggattactagcacatcagcacaaagaaaacaaaagatttgcaacctcacacacacaatagacggcggcctacggtcactacctttctgcctacctggcatttttttatgtggccgtcatagaaacttccaatttttgcactgctcaaatttgtgtgggacttcctggcttctatgtggaatttgtgcattttcatatatactagcacgtttaagatatctagtattccgaactttatactcgttctgaaactttctaaatattcaaatttaattttttttctggacttgacatttttgtgtttcagtttgtactacttatgcctatatatgcacactatactcaaatctgtatatgttctattgtatgttcgaattttgaacatatattttagacttgaattcttttattttccttcaactttttcacgaacacattcagatccttacgtctcccagacatgtacaaacagtactgtcacattcatcttcaaatattttctgtggatttcaagactcagaatattcagagatcgagtaatattaaatatttgatgaaagcgaacttaacacatgcatgcatgtacatatgggttcgtatattgtacgtgatacacgccaaagttcacatgagctaccaacagttggacagagtgacaaaaactctatccgacttgggtggttggagctccacgtcacatatagctccatgcatatttggaattagcatgcaatgctataaactcacagtataccacgaaaagtgaaaataattatttaagggcacaaaccaataattagatgttaaaaagtgataaaacaaattatagaaagtatatcacggaatttctatataggagacttttgtaaaagtcatggtgtttaactgatcggaaagtgcacctttatcatagaacatgattgaaattatgggcgaacagggcttcagggtgtaggcagtgagaaatcacatgttagtgggtttttcttaaagagatggtgcttatacacatgtaaggacgtacggaaagagtacaaacgaacgggttcgctttttaagtagcagagatatcatcttacggtagacttcacttaaaacttaatggtctacttaaaaattttaactccactggatatgtttttgttctcaattcgagcatgagacggttatataaactagtatacaattcccttaatatatagcaagtttattaaacaactcattttattgttgcacacatgcagccaacggcggaggcacttcccgaacgggttgggcggccgcgtgaactccaccgctactgtctctattaccgttagctacttatacgagtataatacaaattgaaatatcgtatgagccgctatcttgtttttctttcaaaatatgggagacattatgaaaaaccatacggccaggttaataaagtaaaaaacaaatttacagaaggtaacgtggatgaagtgaagtctgagtaagcgctaatcatgcatggagcaatggttggcttgtgctaatcaagaaacgagaatataggtagtacaaaagcaatgaatgaaccattaagctcacgaatttaatctcagcaggtcaggtcatgtgcgagtgtgcgaccgtctgctacacatgcacacgcacccggccattggcagtttcaagtttcaacctctaaaaatctaatctatggactgcaaaaaaaagcttaaaattgtaccctccgtcccaaaatatatgtattttttagttataaatctggacaaccaaaatttatattttgggacagagtagtaataatcagctaatttgggccgtgtttagtttcccgtccaaaatttttttaagtatacactaataacaaaaacaaattacagattccgtctgtaaactgcgagacgaatctattaagcctaattaatatgttattagtaaatatttactatagcaccacattgttaaatcatggcgtaattaggctcaaaatattcgtctcacaatttacatgcaaactgtacaattggtttttttcttccatatttaatgctccatgcatgtgtttaaacatttgatgtgaaggtaactaaacacacagcctgggtagttatttcttagagctaaaaaattggttttctggctttctacttctattttattttgtgaattcaacaactataacttattagaatatgaacgaaaagttaaaccgcttggagagcttctaattatcagaagaacctacagctattcagaaacacctcaaataagccattgctaaaattcaacggttggttgaggtgcacaaatcttaaaacaaatcataaaattagtaattatcaatttaatgattttgattaattgaagggactgtatgtatatattggcactccaatgtggctgcatgatcaatggagaatatatgtatatataggagaaactaattaaacagactcattatgataagactcgataaatatggagatcaactgagaagaggaacagaatcaggtgcagatcgatgagatgagagcgcgattgatgatgcatgtggtgggtggatgagagagtaaatgaagggtggttaattacctgtgcagagtgtgacgatccagacgaagaggaagctcccgtatgggatgccggagctcgcggccttccgccggtcgacgacgcacccggggcacccctcaatgcaggacccatcgccctcgccggtgccggtgctgcccttcttctccagcagcggagccgccgcctccgcctgccgccggcgtccatggtcgcccatcaattcaccaatctcgctcgctgtgtcgatctctctgactcgatagaccttggctctgtctgaatggctgtattgtattgaataactgatgggtagttgttgagatcgattaactacgcctatatattgcctgctgatcgatcgatcgatcgggaatcagcaataaataaagagagtgaatggggcacgtgatgctcgcaactagctgatgtggattcccttccgtttccgtggcgatcaagtagagaggctggcggtcttacctctaggagcagagcagaaaacgcatggaacagaaaagccacgggaagaagagtagaagacgaaacaggctttccgttgtccaaatagtatatgattgtaagatggacttttgttgttcgaggctacgtttctttacttgtgtatgtcggtgtatgccattttaaaaaatcattaataattttaataaaaaatattaagattaattaaatatgtgggggtgtcactcgacaattatgtaatttcaatttgatatatataattaaaaaataaatttaactatgaatgacacattttattcggagtcaatttattattttcatttctagctgaatttgagcttgtattttatttatatattgtattattgatctactttttattaatatttttgtgatttttcaaaccgtataaaaaaataaaggagtgtttccttgagagacgaataaactttctcacgttacatcatgtataggctgtgtttagatccaaagtttggatccaaatttcagtctttttctatcacatcaacctgtcatacacataacttttcagtcacatcatctccaatttcaaccaaaatctaactttacgcttgactaaacacaggcatagctgcactaattcaaagtcgaattgccacctgttttgagttgctgccaatcttcttaaacagaacggtatgtactgcgtctagtcaga

SEQ ID NO: 22098 - DNA, 2175 bp, Oryza sativa
  unsure (1)..(2175): unsure at all n locations
cgcgatgattgacactctcatnnnnnnnnnnnnnnnnnnnnnnnnnnnnnnnnnnnnnnnnnnnnnnnnnnnnnnnnnatcttatgtaagtttatgcttctttcatgatactattttttttgcagtttgtttatgtcatttctttgctacatgtgctttacatgaaagtttagtgcattcgctgttcgcttgacaccattaaacctatcttgaatataatttaatggtgttatatcagaacgactaagttggcctcccattggtaataccatccatgagaatcctttttgttattctctagtactaagaatatgaaatggactagtgtaagacggttcttgtttggagtgtcatgtgagggacagaattgcaggcagggaaagaatgagagtagtacttctctttccataagttaaatgtgttttgagattggggattctaagaaagaaagggatgaattacattataatttacctatgccatacaatgttcagttgtcacaaaactataggacaacccaagaaactatgttgattttatctttattctttctctctgttttttcctaatataaatctttagttaattttagggtattcccgtgctggtttcttgggcggttaatgtgccaaagtggctggggtgccccagggaagaaggcacaagggacagtctgtagctaggcagttaagaattctaatccactgggttaagtttggcttgcattcctaactagagatgaactgacaaaggcgatctaccatgctggcaaaataagtccatagctcagtaaaccaacgcattacctattttgttgtgtccttcctcgtgtttagatggtggcaagaatggtgctttttcatcagtcttcgataatcctttgcactgtaaaaatatatgtaatgaatgcaactgagggctactgtgctgttattttttatgaatatgtacagataactgaagaaatagtgcagaaatcaattgatgttcttgtaaaagttgtcgagtctgagggttcagcattggcatccactgcgatggaagctcttggtcatattggtctccattgtttattgccttctattaatcgaaattcctctcaaggtaaaatgtgtttcctcgcacttctgatagacgtgaactgtgctactcaccagcttcctctactatgtatttgtttaagctaatttcgtttgtcttgcagctgcacttttaacaatcctgaatgagaagctggctaagctgctttcagaaaatgatactaaagctatacaaaagattttgatatcgctgggacacctatcttggaacgagttgtcatttgcacacctgaataatgcattggacttaatttttagtctttcacgctctaaggtagttcttttgataaattcaaaatttgtggttgaaaatattctgtatttgacaatattctattcctaaatatcattattcaggtggaagaagttctttttgcagccggggaggccctatcttttatatggggggaagttcctgtgaccacagatgtaatactagaaacgaactttgtctccctttcccaggccacaaactatcttactggtgatgcacccgtacttgtctcgagtaactctaataaagaaagtgattgtgaagaagcacacgcaatggctcgagaagaaattataaaacggttatttgatacattaatttatagcagtagaaaagaggaaaggtgcgcaggtactgtctggttggtctcacttacaatgtactgtggtcagcatccaaagatcctggaactacttccacaaattcaggtctgccaatcaataataacatatatttatcattgtagaagtactatatcttaggacaaacaagagtggtgcactccaaagtttacattagaattgatacaccataggttgttgtgtgaattattaatctgtcctaaaattaaaacaatgccagtatgctggacagggcacagaagccaacaactgttaataattgtgtacctttcatctaaaacatgtgcttgcttatagtataattcagagttcctcagaggtttcagctgtcaagctgtcactgaaaaatattaatttnnnnnnnnnnnnnnnnnnnnnnnnnnnnnnnnnnnnnnnnnnnnnnnnnnnnnnnnnnnnnnnnnnaagtcattcatgcgcg

SEQ ID NO: 22099 - DNA, 17291 bp, Oryza sativa
  unsure (1)..(17291): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctaccattgctaatggtattacagatattaatgtgttttgaagttcactttcagtctatcacagtaacttgaaatgcacatgttctttgaactgtacattgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcgtcatgggctgggaagagaaaggtgaagcctttatttcattatcttactgtccatacacataaaagtatcatagcttggaatacacttacagtactgtgtgctacttgcagtcagccaaggctataaaaaaactatgtgatgctctaggagaatccctgtctgtgcaccacaataatattcttgaatcacttttgaaagaactacctggtcgattttgggaggtaattagtactatgatttttctatctgtggcttatcagtgaatctttccttttattcatggaataaaacaggatggattgcttagagattttcaagaaacattatccatgactaggttcataattcattttttcgccatgaataaccacagggaaaagatgctattctggatgcactcgctgcactttgttcgagctgccatactgctatgagtgcagaagactctggcatgcctagtgttattctaaatgctgtttgtgctgcatgcagtaggaagtcaaaattgtaccgtgaagcagctttctcgtgtttgcagcaagtaagtatctctcttctctaccctgatctctatgtgaaactgaaatttgtggctagtggataatctaaagcattttactgtttgtggaccagacttttctttgataaaaggatttttagctgttagatagctgtgctcttaacctagtgctcaaaaggtttatgatcttagatgcaacaaaattgatgagaaaattactttcatgcttaatactccctccgtttcatattataagtcgttttgacttttttcctagtcaaatttatttgagttagaccaagtttatagaaaaacaatattagcattttcaccacaaaacaaacatattaccaaaatatattcaatgttagatttaatgaaactgatttggtattttagatgttgctaaatttttctataaatttgggcaaacttaataaagtttgaataggaaaaaagtcaaaacaacttataatatgaaacggagggagtgggtatttagtttgaagatctttccgaaaatattgcaaacagctctcttctcaaaatattatggggagcaatctaggttgtcagtgttatattttcacaaaagacattcatcgggtttaggtgttgcgttgggatggcattttgacattttctatatattagaatttacttagttttctttttctttctttaccacttttcaggtgattacagcattcaaagatccaggattcttcaatattgtttttcctatgctgtatgaggtttctaatcgatctgtcatttgtaaaacaaggaactcatcttcactcactgcatcctctagtgctggtcagtcattaattccagcccctcactgcattcaactaatgtcaatgctggatgaaacatcttgtaaatgaatactagaacttctattttattatctcattctttatcacataaatatgatatagtactgatagttgccatcacaacacaatgtttgaaaaccttgatgggatcggcttaacaagagtacaagacaactttagaactatacattgttgcccttaatgcagcatacgtgcatgacttcaaagccacttatcctcctttattttttatgtattactgccttctgcagagcaagatgaaactgaaggtgtttctgtttctcttgataaggtgctcaactgtgtagcatctttaatcactgttgctttcctgcaagatattatcaaccaaaggaagaatatcctggaaattattttaaattctctatcccccgaggagagttggcagagtatgtatcttgtatgcaagatctattataattctatgcaactgtttttgaatctcacttatttgatacatcaccactatcattgatgctttttttatggatttctatgtgcagttaagttgtcatcgttcttgtgtatcaaagagttgtgctataaattccagaatccagatggtaataacacttggcctgaggaaacaacttacttggttgaggaggtacatcacatagttgtttagtcctacacaactgtactccttagttcagtatttggtttcttcattttcctgacaaatttcttttaatttgactgttcagttatttcattcaacagcaccaaaagttgtggatgtcatacgcttagttaagattgctcaggtaatcatcagtatatctagccctcaccaattcatattatattgtgtttgctcatatttattacaatctcatatagcacttttaaagtttcaccataagataatttgttgtcttccttctaatgaataaacatattgtagtttactacttgtatgttttatggcaatgggagcatgtgaactgaaattgcactggacggagctgttgtgggtgttatactaaatttgatgattgcataacaccatttggcaccaattttccatttggcaccagtttttttatagattatttagagatgatacaaaattattcatcaaatattcagggaaaaataagaacttgtctttagaaaaaaaaaaggtggctggtctggtggtttgatgaaccctggtgcacatggtttacagattactgctttgcttctttatgtaacagttcatatgcttgtttttggcttcactgattttagaacaaacagttacaaggtttcttgcactgattgtaacatataatttatatcttgaaaggacgagctatccaagatttatgtaaaatataattgttacatactgtgctagagtatattagattactgtatattgcacaaaccagcagtttctggatatgcaatctgggtttgaattgccccctcatgactaacttcttctcaggttcacaccgctgcttccgagtgtctccttgagttgagcaaattgtatagagactttccattggttgacagaaaagggcccaagttctcaggcgaacttgctgaactttgtgagtcggaaaaaagcgagcaagcaaaggcatttttgaagcaatgcatggatattctcaaagacttcgaagatgccactggattagccatggagatggattaagtgaagctctcaaggttaaatcgtcttagtaaatgtcaaaaacaagcccgcacatgtataaagggcgcgagcaccagggaaggtgggttattctcgcaaactggaatcaccgtgtaataggatgagcgtttcattactgattgcatccgaaggaaattctgaagctttgcatccgcaacccacttgtgcaacatgtcctgccgctgttacgatttattgttattctccagaatggagtagcggtgagctaccagagattggtttcatgattctttcgagtctcaactttgagtgcaaaaggaaccaagacctaattagacccgagagtgatacttatgctaggaaacatatactcaaatccaagaacgatttttgtatgaagggcattgattattcaatccaagaaattaaacacaaatgtgtgtatacatatatggtttctgtttactttcacccatattgggactaaattgagacggtttacaagttacaatcacatatgatttgtgtaaaaacattaaactgacgccaaccgatgtatcttcggtcttcttttctgaatccctattatgatcatcagggacttaagtggttagcttgcggagagcagtggtggtcttggagcctgactgccttcccagatgcttggagatgtaatctccagcatccatgagcttgttgaggtcaacattggtctctatccccagtccatggagcatgtacacaacgtcctccgtcgcgacattgccggtggcgccctttgcatatgggcagcctcccagtcctgacactgatgagtccactatgttgatccccagctggtaatacaaaaggaaatgttaggccaagcagagcatttctgattgttttgtgtctgtttttcagtaagatggtttgttcattggcattggcaggatgtgaagtgtggttgcttacttggagagagaccagtatgttggcaagggcttggccgtatgtgtcatgaaaatggacggcgagcttgtccactggaacaaaagacattacagcttcaagcatagcaagtatgctacctgaaacaaacaatacaagagagcggaaaattgccaatgagatatgtggctcatactgtcatatagaaaaattcgaacaattgaaattatatgattagcaagtaatgtgtcagaatgtttgtagattaggactgcaatgcttttaaaaaatcggtatcatcactttaaaagtagttttaaacgggcaaaaatgtatgaaccaggaaatggcatgctgaaagcaataaaggcaacaaaatcagtacctggtgtaccaacaccaatcgtgtctccaagtgaaatctccgagcaacccatgtcataaagctccttagctacgtatgctacctttgatggatgaattgtgccttcaacagggcaaccaaccacacatgaaacatacctatgacgatcaaattatgcaaattctcagatcagattgctgtctgttctttttaactttcaggctcgatagatcatcaagcttatgtgacttacccacggattcgcattccatgtttcttggcagaagttacaacatcacggtaccgaacaaggctttccttgatggtacaattaaggtttgacttagaaaaggattcagaggcagatgcgaagactgcaacttcttttgcaccagctgcaagagcagcctcaaatccctagagaagtggaaacaaagttgattcatcacaaagatcatagcccttcataaaacaataatgtatagtctattgctgatatagtgctatgtgatagagttcccaaaaaaaataaaacagaactggacatactctgaggttaggagttaacacaggaaaccgcacatctggcacatgcctaatcccttgaaggacatcctttgcatcagctagctgaactccgaaatgagtgataagattagttatttgaaatttaactgataccaaatttgtcaaattaacagtacaaattttacaaattaaggtcatacaaaaaaataatagtaaaaggagttcaatataattatcagagaagtagtgacaacttccgatgaggatttccacataaaaaaatccggttttgaagtaagtgcaatcacatatgctagaaaaggtggattttaaatcaagaggtatcttgacattgttccttaaatatctgttaatttaaattaatatatgatactacatttattcacttaatctaagtaattacctgcggcacccattttggggaaacaaaacttgtggcttcaactactgatagaccagaagccaccaatttgtgtatcagttcaatctttacagaagctggtacagtactcttctcattttgcagaccatcccgtggtccgacttcaactatcttcacaaaccttggaagctcccacaaaacctgaaaaccagttattcatcaattgagaaaaaagagtaatttgtagtaatattttacaatcactacactttttcagccaccattttcacttattcagttatgaaggtaaatagaaaagactatgacatgttgaattgccgcagacataatgctacatgtcagttcattcctcgtatttgaggtggtctgatgaagagatctaaaaaaaggaaatgaaattgaatacactcataagccattccataacacaggatcaaaataccttccgtggaagagctctgaactccatatccactccattgcaggaggaatcagtatattggccttgcatatgccatgaatgagaactgctgtgaaagatcgtctgattgttgccaccattgtgatgcttgtaactgaaagtaggtccagatggtcagatcttacttttttttttcagggcatcctttggcagtaaaaattctactgatgataaaagaaggtgagaaaggaaaatcttcggtgtaaaacaaaataggaaaggaagaatctagcatctgtatggtttgcaagagtaaaacttacttgctggtgctacggtcatcagcacttgctctgcaagcatttggagagaacctttcaagtctgttaatactcaactttggaaggtccccaagaccgagcggctcctcgaggctcgacattctggaatcagatgttacaatgtgaagaagactgttgatatgaacacttgatatatgtcactgaattgagttataatctcaaaacacatgaagaacaggaggaaaaaacaatgtatcgggtcgtattatctcattgatcatatgccaactgaacaaacattagtttccgtttaccagttgggatatatcgctgcaacaagccactagaacagtcagaaacggtacactaatccgcatggaaaggaaagtttgaaatctaatccaatggaactccagaaacaatgtccattctcccggcatggtcaatgtgcaatgcctgcacaccggacctcgatcttgaccaaacttcttctttacgcattgaacagaacagcatatatacaaaatactcaccctaattatccataaagtggtttatttaaacattgaatcatgaaatggtatgcttaagcttcaatgaactaatgatgcccattgcacagtaattagtaatactagcagaaatggaacgacaccaacgccgctgttaattccgctcttttccctgtaagcactcatagcaattcaatctagctacaaaacctcacttgaaactctccaagaaaccaaatcaagcagccaaattgtcaccagctaagaagtagtacaaggaacagaagagatcagaaaggggaaaagtgcaagaagaaacaagaaaccatcgcacctcgatcgatcgacaaattggaagccaacccgatcaaatcgcacccaggattgagtgagtgatatagggcaccgaactcaacaagccttacttgaatccgacgcaaaggaggagagagcaccggagtccgaaaatggaggtcgcggctgcgcctccgcgtctccgccaagggaaaggaacgggtcggcgaggcagcgcgtggaccaggtctcccgtggaacgtctccgtggggcccaccgtgtcagtggctgttggtccacaagacccggtgtagggagaagtgcatgccggtttggcgggctgtgtggaagccgtggtgtttggttggttggtactccttttcaggtctggtgagcgaccacccaaccccgcgagttcttatcggattcgggctgtgaaacgttgttgtgttcacccgttaataacagtgcctgataaatatattacttccggtgattatgcgaatgccctgcttataatctgctcaatgtagattaatgtggaaatggatcttctggattttagtgatggtgattatgaatatattcattaccacctctttaaatatgagatcatgaatcaactgataatatacggattgatgatcttttgtgtcttgacagtaaggatacccgatccgcataatttgtatttaatgatctttgaaagtgtaaacgtggtcagcttaactccagagaaaagaataaatcagatccggagttgtggtggtgcccaaaattctattgatgtatacatgccgtcctcgtgttttattaggtggctaggaaccatcttatttaatttagagaaaattgcaaaaaccaccccaaatgtcactctgagtttgagatgtctccccataagaagatttgttgcaaatccccacatcctaattcatcttgctttgatttaggcaccttctcttcacacgtgcgtgattcttgaagaatctcgtggcgaaatcaaccgagtcccactcggcgagagcaagagattacgttgtttgttctgtataaggcggtcattttgttgcgttatcatggtcatttcactgtgtttttcatggtatactagctatatattctaaactgatatcatgtgtattgaacaacatatccttttttttcatggacataatgagcatatagaaacatttgaacatgaagcaataatcatatagccagattaaacctgcatgacttcatctattgcaattggtcagatgacccaaaatagcatgtgttagtataggttaatcagaaattaaggccacacaatctaatgcaaaacggacatgttgacaaatcatcacgatgggcaggacttggctaatttcgccatgagatgctccaggaatcacgcatgtgtagagagaaggtgcctaaatcaaaccaaggtaaattaggaggtgaggatttgcaacaaatcttcttatagagttatagggggcatctcaaacttagagtgatgtttaggatggtttttcatttttccctttaatttatagtataaatattttctatatgtattaatgttaccttcatttttaatagatagcaccgacaatttttttaataacatttaattattcatcttattcaaacatgtactctaaatatgctaaagtataagtcataatcaaaataataaattttgatgataaaataagtcacaacaaaaggcctgttcactttgatgccattttcaaccttaccaaattttgataatgttgctaaaaaagtggctatatttagtttgctaccaaattttggtaactatataagaaatcctacaaaaattttggcaagtatgctaaaattttggtaatgctaaaatttggtaaggttttttttagcatcaaagtgaacaggcccaaaataaacactatttatataatattttaaataagatgaatgataaagaaagtagaaaagttaacaacgttatttattaaagaaatggagagagcaatatttatcgttcattaatgaaacgtactcctacaactctcgtatttccaattttccaaacaactatcaagtcgtttcatcttgtactttagcaaatttaacctatcaacttgtgcaagagtcaaactacattttatatgccttagaaaaaaaaatattctctcgtatcaaaatataataacttttagtagctaaaatttatttgaaaatataacttcaattgaactgcaataattataattacgatggttcgaatcaaaatttcaagataatcatgaatttaaaagagaaacacaaatcatatacctcctgatttcctcctttcagtgaagtgttaaaccctagctagcccctcttctccgctctgcctcctctcctcccccatcccctctccgccgtctcaacctccgccgattcttcccacccagcaatggcgatggatttggacgagccgctcgacgcggagaagggcgaggcggcgctgcggcggctgcgcgacgccgacccggccctctacctctccccctccgccgacctcgccgccgccgcccgtgaggcctccaagcacctctacgcctcgctcgtccccttctcccccgcgcagccgcccccgctctccaacctcctcgcaggccccgccttcgacgccgagcagatttggtcccagattgagctgctctcccgccctctcatcccccacctgcgccgccagctccgccgcctcgagcagcaacccccgtctcagccgccgcctcgtacggaatcgaagtccgctgatgccgaagagaagtcagaggaggaggaggatggtgaaggtgacgaagaattggaggagttggacgatgtagatgatgaagaggaatcagaggaggaggaaaaggaagaattaggattggagggtgaagcagggaatgaagtggaggacgagttcttcaagataaaggatctcgataagttcatggtaaagggggaggaggcggaatatggtgggggtgccaagcaagggaagaagaagaagaaaacagagaactggatggaagaagatagtgattcggaggacgaggagtatcttgatgaggatgaagaagatgacgatgagcacttggatgtaagcatttcgtaatcacatctcttgttaaattctgagaccagtattagctatcgtaaagaagattgatatatagaaccactgatctagtagtatttcaggagtagacaccagaatttctgtagtcgcaaaagagaaagtatttgcattacctcaggaaattgagcatatggagtaagttctaaaacagtttcctgcttgagctaataggcttatattgggagctagcattgggtatggtttaatgcaagatgcatgcttgctaaatgtgattcttaagtatcgtattttgtaatgtagttggaagacttcgacgatgaagaagaagaagaagagggtgcagttggagatataatgtaagcctttatgctattttctgaaaatgctcatatcatgattgacagaatcacagaatgctttcgcacactatttttatctttaagtgattaaatactgggatatcagatggttttaactacattttaattgcttttgtgaagatcggtatgatattcgtagaaatggaaatggttgtcatttataaatttgaattgtagaatcacttgaataattcttcacaaccttttcctattttatcattttcatgctcggcacataatttgacctgtttaagttaattgtcaaacttacttattagatgatggctagcttttcatgagaccaacagctcagaaaagggcatacagaggcaaatggagtaggaaaacaattggctccaaataatggcatggagtggactcaattaaattagcaaacattaagtatgtaagacaaacatattacattttcacgtaaattgttaaaaaaatgatgatagcacaagaaattggatttatgaataacaattagattaggcataagtcaaagaagaagtctgttgaatattaaaatataggtataaccacatgtgtggccatgtgggaatagaatgctgtgaaaaaaaactgccatgttcacataactcatagaataatagcaaaggatacctacaagtttatatgtcatgtacaaaaaggttaagacacacaatatcaccctaaaaacacagctttttagcatatatataacctaggcaaaactgagccaagttctgtctacttcttagccactgcaaatgcccctggaaggataagtgatctgattagacaattccaagatctcaccatgcacataaatgcattacatcattctttcctgccttgtatttgtccagtggagcctttacagaagtttccatatgttgtattgactcagcaaagcttaatcgttatgcccagacttcggttgtatttaatatttgtgcatttatagtattatgctttgaccaggaaagatgatttttccaggtataaggatttttttcaggaagcggatgaccaaaaagtaaggaagaaaggtggctccaagaaagttcaattcaaggatgaaccagataaaccagaagttgatgacaaaaatgatgatggaaatgttagtcaagtactagacttaattacttcaatataaacaagtgaggcacatgtatattatcaacatattcttccaattctgcaggatgaacagggtttgtcaactcacgagaaggcgcgcctgaagatgcatgctaaaatagaggaaatggagaaagctaatcttgaacctagtacgtggaccatgcagggagaggtaatatataatatgtttatccattcattagtttctagaacaaaacaaagttttaactttgaactgttctgctattaaatcatcagttcatggtaaagaaaccacttgaaattttcttgtaggttaatgcttccagcagacccaaaaatagtgctctagaagtggaccttgattttgagcacaatgtaagacctgccccagtaatcactgaggaagtcactgcttctcttgaagagatgataaagaaaagaataatagaggtatgtgtgttgtttcctttttcgacatggcataatgggcagttttgcaacttggttaactttgtggccttgtgctacttatactgagggagctttacttgttgattccctgtagggtcattttgacgatgttgaaaagccttctcccttgcaatttaaatccccaaaggaacaaaaggatctggtatacttttaatcttgtccaataacataactcattgatgataacaataactaatcatgtatttgttgtcttaccgttatcaatattatttcaacaggatgaaagtaagagcaagaagggtcttgctgaactatatgaggtttgcactatcagaatacagcttttatttttttatattcaaagaagttgctacttaagatcagtttaatgatgatttattgagggctggtgtttgtgtttgtacaggatgattatgcgcaaaaagctggccttgcacctgcaccactttctatttcagatgaacttaagaacgaggtgagtttaatcgctttctattataatatgacaattggctttcatgggactaaggttgtacagtttctattgttaaggacattttttttcttttgtttaattgctgtgtgattgcatgtcatttgttttttagttaaaagcaagctgcaaaaagaagaaatcctacatgtcaaagaggaaatcttgagttcttctcattgaatacatgtcattctattatgaccttcccccaccccacacacacacacacacgcaaaaaaaaaaaaatcttgtatcaatgcatgtcttgattgctagtgttgctactttattcaatattttcctctctgtgtggtgatggtggcaaagatacttgcaatgtctttgagaaagatcttttgaaaggaattgataatgctgtacctcatgatcatgcaattgattaaagtttgttttttttatggtagaagcagacatcattttcttttgaaaaatagataagtgattacttgtgatcacaatgttgttaacttagtactaactatgtagcaataagcatgcaaatgggtcatagcgtcatactcagagatttttaaaactgtaattttttgaggtaccattatcaacttggtggtctttataaatttgttcccaccatttcattggtgctttatgcatatttttttcccctgtgatgatattagaggcttgctgcattgacctaacttctgtttccacttaggcaaagaccttatttaagagaatatgcttgaagttggatgcactatctcatttccactttgctccaaagccggtatggaatagtgaccagatattttacttaaatttgtaatttctttcagcgaagttaactaacaaggtaaatattcacttttcaggtcattgaagatatgtctatacaagcaaatgtaccagctctagcaatggaggaggtaaataaaatccttcatttctccatgatgtttatacggttgagcatttcatgtcatgatttctctctctttttgcagattgcacctgtagctgtttcagatgctgcaatgcttgctcctgaagaaatttttgaaggaaaaggtgatgttaaagaagaagcagaacttacacaagctgagcgcaaaagaagaagagctaacaagaaaaggagatatgcaggtaaattcccttatgttttttaagatgcattccttctagcttttagtataaatcttctgacctgacatggataatgctcctacttcctcattcaaaacatttcgttgttcattcaaacatggaagtagtttgagcaacacaaattcgattagctagcaatatttccaattgcaaagttgggtacgatagtagattgaggcctgctcgtttttcctacttttgtaccatacaggatcgcataaggagaggccagccaagatgcagaaagattaagtcaatactggggaaacgcttacattatgaacaagtagtcagccatttttactgttcagcattacctcttgacccaaggatccattcatgatgagtattggtgcaaatggcaacgcagcattgacagacatggagggagagagcaggctaggaaaggtagtgaagggttgggttggaaaggaagtgtgaagggttgggctccaatgcgtttgatcacaggatctgtactctggtggcacaacagacagatagctgttccaggtcaaagaccctgacgtaacccatctcccgtctcacaagaaaacgcgagcgaacgtattggaatgtgggatgggtaaaagaaatcttttatttctcgttacactagtcgtagcagtacttcatttttacagtaattttttttacactatagaaggaatatcaatggtttgcatgtattagagaggcatatgttttgtttttgatacgttatggaattggtttgcagatgtctgaaatttgcgtgcggtgtattagtatcattttgatcctttgcttttttgccgcattgagggattagattgatctaataaaggtgatttgcaagaaagcaaaataaaaatgggttatgggggattgtactctcagctacagtggcaggtagagatgcctgtacgcaggtcaagcttggacccgagaatgaggacgtagagttgggaatcaaatcatgttgtagatactctgccatgcgtcgtcatcgtcatgcacgttacaacgttgcacacgatcatcatcttccagtggagtacggtacacgtacatgtagggggagtatacgttttctgctcgttccgccgaccgcgtaccgtacgagacagggaggaaggcagcacgcaacgcgatgctgcaagactggagaggtagctgaacgagagtgacgcaatgagttgcaatgcaccacagcagcagcacaaactctgcacatgtgctgctgcgcaatgcagagttggccgtagagcaatgttgtgctgtactactagtctactggagtactactgcagactggactggccgtcgccattctactagcaaatatcacatttgtaacaacgatacactggagtatgcacagtggtgtaccgtgaaccagcatggacgtgcgaatgcacagtgtaacagcaagtgtgccccaggcagaggtagcaagcccgaaagtccaacactacactgcataaagttataggattctcccacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccggccgcagtaactcagcgtactactcgtactctactctactccctccattccaaaataaataaataaataaatagataaatctagggtgtgtttagttcacatcaaaattaaaagtttagcccttgtttagttccaaactttttcttcaaactttcaacttttctatcacatcaaaacttttctacacacacaaactttcaaattttctgtcacgtcgttccaatttcaaccaaacttctaattttgacgtgagctaaacatagcctagccctgtttagttctaaagtttttttttccaaactttcaactttccatgacatcagacctttcatacacacacaacttttcagtcacatcgttccaatttcaaccaaacttccaaacttcagcgtgaactaaacatagcccaaggcaaagttggaagtttgtatgtgtacggaagttttgatgtgatgaaaaagtggatgtttgaagaaaaattttgaaactaaactcgggcctagcactgaatgtgacagattctaatacaataaatctggacagagctatatctaaatatatcacatctagtactaaattgattttttatgagaaggagagagtactccttttctttccctgcttttacgcgctgcagcattgctccctactgcatgctccctaccctcttcgttaaaaaaaaaaaaatcaaattctggccgtaaacctgaaccacgctatacgtatttaccatgttttggctccctatgagttaacggttagcatgtaatatatattggttttaaaaagtaagaaagttatcttacgtgatgttgcgataaacgcacggttttataaatcttgtatatgattttgtagtataactcatgtataactagatatatataattatagataatcgaaaaataacatgttcatatgtttataatcgttaaaagtcataacgtgagtcagactcaaacagttagtagaccgtatgcataatatttttctttttggaccgagggttactcccaaccggaaaacagatccctgactttgcagtttgtagttgtaccatgtgggggccacatatcagtgacacaactatatgtcggtggtctaactacaaactgcacaaaggctaagtttagatccaaacttcagtctttttccatcacatcaaattgtcatacacatataacttttcagtcacatcatctctaatttcaaccaaaatttaagctttacgctgagctgaacaaagccaaagtcaggaccatcattctcccaacccagacgagccaccatgctagctgctgctgctgctagtgttgcccagtgaccttgcagctcgccatgctagctccgctgctcgctgctgctgcttttgcccaaagctgcacaacctgcattgcctctcgcctgaccctcttgccttatctgagtctccccccttcttttttcttcaacccctctttatgctcgtttctccattgcagctcacctccatcttctattctccccctccttggagaaagagttcgtgtgcctctaccaagaacaagaagaagccttttgcattggcagccatgatcaccgtggtggacctgtaccacgttatgacggcggtggatgccctgtacgtggcaatgacgctggcgtacgccatcgtgcggg

SEQ ID NO: 22100 - DNA, 4907 bp, Oryza sativa
cgcgattgaatgcttgaatcccactcgtacccggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgccctctggtgccgcctctccgcgcgcgggtcactcgactggctcatcaccctcttctccctctccaccctccccaacaccctcgtcatgggcatcccgctgctcaaggggatgtacgccgccgccgccgacgtcgactccggcagcctcatggtgcagatcgtcgtgctccagtgcatcatctggtacacgctcatgctgttcctcttcgagtaccgcggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaggatgcgggtcaccgtgcgcaagtcgacgagctcgcgctccgaggcggcgtgctcgcacgggacgcagtcacactcgcagtccatgcaggcgcgcgtctccaacctctccggcgtcgagatttactcgctgcagtcgtcgcggaacccgacgccgcgtggctccagcttcaaccacgccgagttcttcaacatcgtcggcaacggcaagcagggcgacgaggagaagggcgccgccggtggcgggggccactcgccgcagccggtggtggggaagaggaaggacctgcacatgttcgtgtggagctcaagcgcctcgccggtgtcggagcgcgccgccgcagcagcagctggcgcggtgcacgtcttcggcggtggtggcgccgaccacggcgacgccaaaggtgacgacacctttttggatcatcttttcgtgcactttgacttccctttttgtttgcccgcgtgtattacactgttgtttgcttctgcgcaattaatcactcttgtcttgtgctcttgaccatccgatcagtagaatcaacggtccagatcacactagtctgctcgttgtttggagaactcgacagcgcatacatatttaatactacattcttgaagtgatttttttttcacaaacttactttcttgaattgttacttttctgatcttaacagtgacattgactgttaactgctaagtatagatggatatgcagagttgaattgtactgttaagacaaaatcttaacagtaaactactgatttgacaaaagagaatgttctttgatggatgcacaggagctcaggcctatgatgagtacagtttcgggaacaagaacgagaaggacgggccgacgctgtccaagctggggtccaactcgacggcgcagctccggccaaaggacgacggcgaggggatggcggcggcgatgccgccggcgagcgtgatgacgaggctcatcctgatcatggtttggaggaagctgatcaggaaccccaacacttactccagcctccttggtgtcatctggtccctcgtctcctacaggttaattaagcaaacattttactcacaattttcacattgacatgttcatcattagccatctctgtttgctgcatgtttgttgatcttgtgaacaatgtgatgtaattcaggtgggggattgagatgccagccatcatcgcccggtcgatttcgatcctgtcagatgcagggcttggaatggccatgttcagcctaggtttgtttgttcatctctgatacatatgataaattgctgtaattttacatgcgttccatgtaggactgcaaataactgaattgtgttttggtttttgcaggattgttcatggcattgcagccacggatcattgcctgtgggaactcccttgcttcgtatgccatggccgtcaggttcctcgtgggtccggccgtcatggctgccgcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaattctcaggccgctcttcctcaaggaatcgtgccctttgtgtttgccaaggagtacaatgttcatcctaacattctgagcacagcgtatgatctctttaccatcttttctttttcagtattggaaaaatgtccccattttgaggtttcttttcttttatacccagaaatctctcgccctgtttcccggttcccttttccattgtatcacatatgccatgcactgaattttctgaaaaggggcgcatcttgcagcttttgatgattcctaatcatattgttttagactaagaaagccattttactcatgatttatcatccacaaaggcagagtccataacactaccattaaccataattgtatgctcatgattttgtatctgacatgaccatgaactcttgttctgcagcgtgatattcgggatgctgattgctctccccatcacattggtctactacatactgctggggctctgaagagctctccaagtctcaactcaactgtgcaagaacttgatgttactgacagtttgattaggatttatggttctgttttagttgctcagattttgtttggatgataggtcagcttagtgatgctagttagacaattatccgaggacttttgggttcaagtgacggccagccacggtttctgattgaagattaggaacatagacatcacattagtgacaacaggcatctaatttgtaagacattgagaaggtctgtttcaaattactgacaatgtagtaagacattgaacagtgcttataagcttatttagcattccaataactgatggtaatgcacttaaaggagctactctgaaggacttttttaatctcttgagagattagctccggattttttccttttggaatgtttctttagtttgagggctctgaaaacacgaaaatagaaaaatcgtaggaacatgatgtcatgctataacaaatattataggaaataaatttattaatttataggattttgcaaaaaagtattgtttattagtagcaccatcggaaaatcaaaggaactttaaggctgcgttctttttagtttttagaaacggctaattagccgcactaaaacttttgaaacggctaattaactacacgtaaaacgataagtgtgattagtatatgattaattaagtactaatatgtaaaagaattgatgaatatatttattagattttttaaacaactttatataaaaaatttttacgtaaaatgcaccgtttaacagtttgaaaaacgtgctaatgaaaatcgaggagtagcatgaggtctagtctcatgttttctttcaaaattcctacacaatgagcaataggaattttaaaggattttggggaagtcatttctatgttccaaaagatcatgttgggaaattttccaatggattttaagggttgtttggttccggttacacttttcatcacttgccaacaaaagttgttacactttgtttaaggtgaggtgaataaattcttagtcataacttactaagcctaagcctaaggaaactttaccatatttttttaagttattgacacgtgagacccaatttgttagaagagaattttattaactatggttaaacacttaccaaattgattaactaatcttaaatatggtaaactgtggtaaagtgtagtttccaaccaaacatcctctaatcttttaaattcctctttttttttctttttatccacttttcctttgtttaaaagaagcggaaagatggaatctttttgccacttttttcaagtttcaatgaagaaaaacatgcgtagcattttgagcatcttttcatactcccaagtataacaaaaagtttggccccaaaattaaaatgctaatggctggcctgtttgctcgaaacaacaggacagaaaatgatagtgttgggagtcagacaaaagtgtttggctttaggcatgcgcacttgaaggttgaagcagcatccgacaattatactccactcttctcgtctgtatgacagacttgacggttggatgtatctgaagcgtataaccaacggtaattttatcatctttgccgagacatatttttattataaaatttggtagtatactagtatatcgaatataaaaaatcttagtgtaaaatttagagtatcaatgcatggatcttctgaacaagattttttactcttcatcacagtcttagatcatccgacatagtacacggttactaatgtttattggacgtatccacggacctgatttgcaaaatgccaaaatcatagaataaattggttgagtttaagaaaaagcaaattcaaaatatggataaaatttctacgaattgtcaacgaaattgcaacagtttttatcattttttgggtttagatcccaacctatatattttggatttcttgtatatctcttctatatagctgggtattcgttttacattactatacctccctcagtctcatagtatagcaatctaggattacagattgaatgtgatatttcaaacctgtttagatttgttgtactgtgaaatgttctatctggtcttagcttggatggagggggtagggtaaaaatgagatggatatttcccgtatgcctgcccgctcgtattattttgggacaatttcgggtcaaaaatccgaataattgggtgcttgtacggatatcgagccgaattttactttttggtggatatgagaatctagttggagggcggtatttgatggatacggagtaccccgataaa

SEQ ID NO: 22101 - DNA, 3992 bp, Oryza sativa
  unsure (1)..(3992): unsure at all n locations
gcggcttaagnnnnnnnnnnnnnnnnnnnnnnnnnnnnnnnnnnnnnnnnnnnnnnnnnnnnnnnnnnnnnnnnnnnnnnnnnntctcctctagaagtaagcaactcgtcactggtcaaacgaacataaatggttttttttctcagtgatataattacaaatgtgattatgtgagtttatgacatatgagatactgctggcaagatttttacattgttaaaaactgccaatgattaacgatgtggagtatgtggataatattaggcaatctacgccctaagcccctaatatagtcacattatggatatataaaatagttgactggctatcttctactccacttggtatatatggttgttgctttgacttaatatcttaattggtattcgtaaccggtagcgttcatacccattttgatacctattcgtcccgtatttatgcccgctgtgtttgtattcatattcgacactatccatatccgacccgattctaattatcaatcacctatcaagacaaatcggacgctacgatgagacatgaaaacacccgatcctattctgacctcgatatatatgtggaatcgttttgcgccatatgtattgaaattgcacgggagacacggtcaaagccaaggttaagataaggctaacaaaatataggttagaatatgagaaatgcgagatctgaccgaaactaatccgatttcatccctatgagggagtagtagttgtttggtttttttgattgtgtagaattggatttttgtaaaagattgtataaaaacgaaaaaaccccttgtcgtcttctccattgcgacactgaaactcaggcggcgccaccagccagagtcccacgacgttgctctgctagggttttgctccaccttcctcccacctcgcgccatcggattccaccttcccaggtctcccctcccctcccgtcgccatgcctcacctcgtccgcgagcgcctcttcttcggcgacatcaacgacgccatcgccgcgctcaccaccaccgccgcggacaccggcggcttcacccacctcctctccgtcgtcagctccgcatccatctccttcatcaccgactgccgcccgggcctctccatccccaccgaggaggtccgccgcgtggtcgccggggaggagggcgcgccgccggtctccgccgtggcccccgggcggctgttgcgggtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctcaaggaggtacgattaatatttaccaacactaatgttccgagtaatttgtgcttttctgtcatctttagtgtcgtgtgctaatcaaagtgaagttcatctttagtgtcgtgtgctaatcaaagtgaagttcatcagatatttttagttctggaatgttacatatatctgttaggcatacttccgttttagccaaatggacattgtgaattttgttccaagaatttatcaattaatcataagcatatgatggaatgtgaatccctgtatcatgctctgttttgacaagttggatatttttgcctgtcctgatgcattggttataacaaatatattggttaacagcgatgtatctcctgttcactgttgttcatttgtaacaaataaattaatacttgtatatttatttgtatcttgttgcagtgctaccatcatcgttgcttatcttatgagaacagaacaaaaatctctggaaggttcgactattccaacaaaatgggtgatttttcagtcgttgctttggttattactccagatgaatacctgagttgtctttttgatacacgctggtgacatgccatgctttttgtcttgtttcagaagcactagagtctcttaaggaagtcaatgagtcagcctgcccaaatgacggttttcttgagcaggtaatcctttgtgatctgtttgcaccctattgctcttagatttcttttatttatttgttgaatgtgttgtaaattgcagttgaaactgtttgaagaaatgggcttcaaagttgatacttcaagtcctctatacaagcgtttccgtttaaaattgctaggttagtcataattcatcttggattctttgttactgttggacaggttgtgtggttattatgtcagggaaactgtgaagattctggccactggttagcatttatttaaaaaatggaaatgtaaattctttgttttagtaaatttcaacattgcatgtctgtgaatcatgatatatttgatgttttcctgcttttttttaattatccatgactaagagtgctattcatgcagtcctgttgaaaataaagcagtcatacacttctcaatattgcttacttttgtttcttacttatgaaaaatctttgacaaatggtcagatttgggtactttactgtttcacctttgtcctttctcttatgcatagtctcttactttgccacttttcactaaatctgtcaattttttttttacttctcgcaggccaatcctacaaaattggagagaaaataggaagctatgtatttgaagatgatcctggtctttctggacagcctaattcttctactcaggatttaccaaacaaacaaacccaacaaacagcataccgctgcaaaaaatgcaggagaattgttgctgtgcagggcaatgttgtgagccatactcctggtgagggtgaatcttgctttcagtggcaaaacaaaagaaagggagagcgatcatatagcaaagaacaagattgctcatcgttgtttgttgagcctctgaagtggatgactccaggtaattcaccctcgtaattcagccctttgcagttacctacggtcacaaatgacttttcatgttgatctcctattgatgtggttcatagcaaacctgtgtttactactgagtgctcgtccaatctgtcatgtgattctgtaattggtcggccaacctttggctgacccggcaaaaaaaaaagaaaaagaaaaaagattctgtttgttttatcatttctaattggtgcttttgttaatgatggaacagtggaagacggtgctttggaggggaagctatcgtgtatccactgcggagcacggctaggatatttcaactggtcaggaatccagtgcaactgtggcagctggatcaccccagccttccaaatttccaagagcaaagttgatattagtacgacttagatagttttttttttgtggggtgtacgacttagatagttgtcggaggctagcagattatttcaggaccatgtgagctggtgtaaataccgttttatcagaaggatttacgaactcgaaggatctcgaccgaagattttcagatccattgtgcactagatagatatcatgaagcattagcctcagaaacctccactgtattactacttggtgttagaagactatgccatcagttgcaattgttggttctgatgatctgagaggctatcaacacgaatttcattttgttttttgtttttttgtattaaatgcatctgtctgcaaatttgtaatgcagttttgttgtacctgagtccatccattgaaaacattgaaacatactgtgttctaagcaatggcatgtcatattttcgtgacatatgccgctgaggtggcggggtcggagttttcgctcccgagccagctaggctctgctctaagatgggcttgctcaccgaggggtgggctggacgtctgcttacgggccatgtattcggcctcagccacgtacgtgggctttatattgggccgcatgttgaggcccatgtacaccatcacgtcaggagnnnnnnnnnnnnnnnnnnnnnnnnnnnnnnnnnnnnnnnnnnnnnnnnnnnnnnnnnnnnnnnnnnnnnnnnntacctgnacantcaatcccg

SEQ ID NO: 22102 - DNA, 838 bp, Oryza sativa
  unsure (1)..(838): unsure at all n locations
tactaaagttatattgcactttacattatacactctttttttatgataaggttagcacatcatgggcaataggtctcattgttgggccagctatcggtggatatcttgcacaggtatcctactaatttttaataccatatgagttgggtgcatgcttaaacaatgcattgacgctattatgatgcttttatttcatttgacagccatcagaaaaatatccaattctatttccagcaaactcattatttggaaggtatcgttgttataggaaatataattgttctagatggtataactccttaaatgactgattcttgaaaatctttccttaggttcccatattttctaccttgtttatgtatatcgatcttctgcttcgttattctcataagttgcatttggctcccggtatgtgcacaactagctaattttattcttattgatattaatttgggcacacataattcttgtttttatgcttctcttagctaaaatttatcttaactactaaaatacaaaagttaattaatattttgctaatactttcaggaaaataatgtgttttcatttcaaaataatgtgtttcataaaatttcaggaaacactacataaacatgcaacagaaagaaatggagattgtaaaattggatctttgagtacacatttggttgactccgaagagtttgtcaagcaacacactggaccagctaaagataagagcttatttaaaaattggccattaatgtcatctatnnnnnnnnnnnnnnnnnnnnnnnnnnnnnnnnnnnnnnnnnnnnnnnnnnnnnnnnnnnnnnnnnnngacggcaatcaatccggc

SEQ ID NO: 22103 - DNA, 940 bp, Oryza sativa
  unsure (1)..(940): unsure at all n locations
cggcctgatgcattgcacgccagtctnnnnnnnnnnnnnnnnnnnnnnnnnnnnnnnnnnnnnnnnnnnnnnnnnnnnnnnnnnnnnncaaagctgtttattttaatcttcaattactagtacaatgcttatgttgctgcgaggcatatggagccaatgttttgtttgtttcagttgacatcgtggctgttgttaaccagcggccgtgccaataatgcttatgttttgtccattgctacaatagctatttttgcatgccgttgttttgatttttgtgtgcggtagattcgcccgtcgtgcgggtgcgccacccgcacgcgaaaatcttgcgggtgcttatgtcgccagcaagggaaaataaaaaatccaaaaaaaaataaaatttcaaaaaatggaaaccctaaccctagatccggacaccccgccgtcagatccgggcggtgggcagccgtcgccgctcccaaccgcctcgcgcgagtagagatggcaatgggccccgttcaccgtttcccgcggtgaattcacctattaggtgacggggatggttaatatgtattcaccatggggaataaaatggttacaatactctcaccatcggggatgacggggtgcgtcttcttactcctaatttttttgtatatagagcttacatatataaagtctctctaataggaagtctgacttagaaattctccccggttattatacatttaaaaaaattccgtcttcattttattaattctaaggaaaattatatgccctaattttttaactacacacgtaattttttctatgatttacattttcataggcctttattttatataaattttacatttctaagttcttatatataaaacttttttttttcaaggtttcacgggaatggtgttttacaaatttctttaaaatggtattaaattctctttcgaaaaatatc

SEQ ID NO: 22104 - DNA, 24328 bp, Oryza sativa
  unsure (1)..(24328): unsure at all n locations
tgccttctttatgcgcaagcctgaaaaaaaggggagagttgtttaatcaccggaaatgggggcaccactcccggccggggcattctcctcctcgttgtaggcggaagcggccaccgcgtcgcctcgccgtggggaatgcccgccgcgccgccagccgggtatgtgccaccccctccaccccgtgaagaaggccattgcgtctccttgctgtgcggggatgaccgcccgcttgccgccgccccgctagtcgctaggggtgaaaacggtaacggtaattaccggtcgaccggcgttcgttttcaactttctaccggccgagccatatagaaatggtaatcgcccgaaacaaaaatggaaatggtaaaaaatatggaaatgaaaatggaaatagttttgctgttatacctatcatttccgtatttaccgtattcttgcggaaattaccgtttcttataatatggtaattaccgtattctaaatatgtcgatattataggacatgtctatacttgacccacagcttatagattgaataactcttcaataaatctctaacttttgtacatggctaaaatgaagttaatttataatttatatagtataagcttgaatttatgtatatatataacatacttatgtaaagttaaatatatgtttttatagtttaatgtttccgtatttattaccggtttccgatctgtaccgacatgtttccgtccgtattgtttcgtttccggttttccgatatttccgatatcgttttcgtttccgactttaccgtttccgatttcgtttccgagaaaaatatggttacggaaatggttgaggctgttttccgatcgtttccgaccgttttcatccctactcgtcgccacccgctcgctgctcgccgcctcgccgcgcatgtggaaggggccgccgcggacgcctggtgatggaggaggggaagaggaggtagagaatagagataaggtggtgacggaggaggggaggaggaggtagagtatagagacaaggtaggagagatgagtggttaaggtagaataaaggggaaaaaaaggaagagagaggatatgtcaaaaatttgaggtgggtggaagggaaagaaatagtnaatttttctgtgcgggccagataaaaggcccgcgcgtgaaaattgatttttccgtgcgatcctcttaagtcgaccgtacgggataatgaggattatcccgtacagtcggattaagacgcacgcacgggaaaatgcattttcccgtgcgggcattttcccgtgcgggcgataacccggcgcacggggaaaatctatcatgtagtagtggtcacatgaggatattaattagcctaaaagttttgtcacgtggtggccgtcggcacgcaaaacgaagcatgcattattgcacgattaattaagtattagctatttttttcaaaaatggattaatttgatttttaaagcaactttcatatagaaactttttgcaaaaatcgcaccgtttagtagtttaaaaagcgtgcacgcggaaaacgagggagaggggttacactgaccaaataccagaatcctgagtatagctgtagttgcttatgcaagaatctagtcagaacttatttcaatttttgtgtttcagtttgtacatagccttctagtaaggaggctccacctaatttcttggggagtagggagttccatgaaacgtacaatatgtatacggccgctcttagaggcacttgtttggaacaaaccttattgcaaaacaatctcagtgatggcgatcaaacacatatgtaagtacaatttgccataactgggaagtccagataacatcatatagtattgctgtgttaaaactggtcagcaaatcatcattacagtctcacgtcatcatccatcaacttgcacgagcatcctacaattactatgtgcaagcaacaaagaacgcgaccatacttttcgttactggatgcagacatgcagtaatgttacctttacaaatttgagcattttacgaatgtaagttcttttatagacacataaggcgaaaacgcagaaatggctttgtctcgaaaaaaaaaagaaaggcagaaagggcaaaattcgtatttacatgatttacatatctatatcatcaccatctataaagtcttcatcaccatctgatcacgcttgggtctcaaaattctagtctgcttgttcgcatatatagcacatctctcaagcttgttccctgtattagtttaaatatgttagatccatgcccaacacatttatgatacatcagtcaaaggcaacatgttaagaacataagatatacccccatctattaaatttcagttacaaacgttctataactcatcatggaattcatacagatcagatcatttcagtggctaactgaactgcaagtaaatatggtgggaatatcatttacaagacaggaaaagtaccagaccatgtttctttttctattatactaagacaaaaggacatgcaattagataactaggagtttagaaacatcaagaaagaaggagactacagctacaacgttaaatgtggaagtagatttaatttgtatggtgtatttattaatggactcatctccagacacaggtcggaacaaagcttttggctgaactcaagtatttaagctcagttgaaatacttgtaagtgctacactaggtcactctcatcaaagcatacatgcatcattatcatcccgtttccacttggcaccaaattgccgctcatgctgtgcttgagaagtaaatggttggtcagagaaacatgcctgaattaattctagccttgaaatgaagaatgcttaatggaaactagtggagagtaaaaatggaaaaacagaccttgagatgttggtatggaaagttcactcaattaggggagactgacattgattaattctagcctaactggtgtcatcatttgtgctatccttttaacaaactgtgctatctttttaacatgcattacctgtatttgtcatagctgctcttccttatcttccgtatggttgatatctttcctaatgacaaatgaaggtatcggtcttgcatcttgcacacgaaattcaaaaatctcttcatcggcatcaatgcatgatgcactgcctttttgatgttcatgtgactgtttgtcaaatatacacgcattattcaaaatttaatatagaaattaatgtcattcaaaaaatagtaagaatagaaatattagtgcaaatataataaatagtgcaaaaattagtcttatttgaaaatataaaaatattttgcaatgtttaaccattcgtcttatttgaaaaattaatacaaatataaaaatgataagtcatacttaacttttgataataaagcaagtcacaaacaaaataaataataatttcacaatcttttgaataagacgaatgatcaaacgttacaaacaaaaactcaaagcaactagtattgtaggatggaggtagtaatgtaattaaactttactcgataacaggcttaccattacctctccaaggaagagcattggtctgctgacatcatcaccacctgcaggttctctcatattgcgctcccatgtttccaaagccagaaactctggaaaatctagatcttttaccttgttcaattgtgatattaggcgctccatctgatgctgcatcagtacagattcaaataatattaaagaatagaaatatgtaatacaaatgaagtgcaaaacacaagatgatcaagattggaacaagtataaacttggacatccaagagtaagaatagaacttcctttcagtctgcaccttcaggcaaaaataataccgagccaatatcttcaaaatttcttaataggtatagagatgccccactagtgttgtcctttctcatatattcatgtattaaaaacatttattgaaagtttatgcacaatttcctgcataacagaatgattattgctgaatgcagacataataatttagtcactctctgaaaagagaaggccctttcattacaaggaaacaaaccattgaaaaacaagttcatttgctattcaagtaattacaatttatattttttactacaagttgaacaattttggcattacatcattaacatttgatgtgcagaaaatcaaatgtttgtttcttgcaaaaaagggagcaacctccattctttgcagaaaatctttcagttttgcatgcctgtctcttctggcattatcaccatcacccccccttcctccccaagcaagatctccaaagtcttgactcaattcttcattgcaatgcttgcagtgaaaattgttatcaatatggcttacaagatccagtgcattgagggatgaatacctacagctcaacacagaaatgacagctgtgctaaaatcttttaggtggtactatatgtccatataacaatcaaaattaagctttactacctcctctcacagttagggcacacatagttctgaatcatgtagtttccatctaattcatcctttaatttcttcttcatctcgtggatcctatacagtgtgacatcatacacctgcattcaagaaaaacatacacaatgaaaacaatctttaccagattagattaaaggggtttggaaaattggataggactttgcttataggttatagcctacattaaacatgagccagtagctgaaaatgaaactaccagcacattactcaacctgtttagcattatgctaagagcagaaaaagaaaaaaaaagcaatattcaagaaacatgtagaaagaagtcaaccagcttcttcatttttgtgaagttttaaaagaacttcaggttcttcataactactgcctgacctcatttaggcaaatggttatatcatgaaattgactattctgtgttgccatcacatggtaacagaaaaggatattctggtatccagttgtctaattacagttcgatagtatccctaagatgcaattactgattgcctaaactttgatacactgcatgagtccaactgcttacagtgtcaaacaagtttatgttttcagaggtatataaagctcattgtgttatcccatatataaggacatgataaatactatgtgaaggtcatcattagttgcaaacacaaaagttttgtactcttgtaatgaaggtcagcatgcaaaagaccttgtatatgcaaaacacataaattttgtttttctctagacgagcaatatctttgaaaaaagatgcgtgtttgataaataacctgcccatagtgtaagcaacagtagggctgcatgatcatcttcaatttcccagctacattggtaggaacaagatgggcatcatgcgaaacatgggagggtgaggcagttgaaatgcttgcatcatgtattgcctgcgccgaaaacaacacaaggtcagaaggaaagcaagggactagtcgatcaaaacttatacaattatacatatggattgcatctaccagacccaccaacgaaacaaaagaagcaagttcagctctcctgaattctgatgctaccattaatgattctgtaaatatattaaaccctttggatgcttacctacataaatttaacctaaagttgctcctacttatttcaatagtgctgcatgcacaatgtgctgttgataaatgatcgattactgtaagaaaaccagtttaaacagatgacatttttttagtacacagtaaacagagcatgcctccatatatgaataaaaaagactacataggacgaaagaatggactaacttccttccgatagtatcttctcactaatttctgctgttcgagaaaatgggtaatctgacgcaatcggttgaatggaatcatcagacttcttgctaaatcttcctcccggacccactgttgcctgaggcaaaaaagaaaagaagataaaagttgcactaaatcagtacctaaaggctcatagaactgctcatgcacctttcacttagagaagttgtgagtacaagataatggaatcacattaattatcaatgctacaaaaacaccaccctgataaataccctgcaacagcatcccataaatccaacaatacatagaggtctgcactgattattccttatcactgttaaccttttacagtaaatctgagcagtgaattaaccaactcggccacccattgttctactagtgggactcccaaaaaacgtagcctaaaaaaccacaaaagccaatcccccattggcactcgcatcatcattcatcaattaggtaatcgcatccccaccaacaccgaagggcggacacactcacaacaacacaagcagcacggcacaccaccaaggtcagggctccgggtctggctcaggattaagcgatctcacctggtgagggcatcgaggacgacgacgacaatcccacagctgccgctgccgttgggtttggactggtcttcctcaagcgagacgtcctcatagaatcctcgcgccaccatcctcaccaacctaccaaaccaagttgccaaaccgaaacccagtaaacctcctaaacccctagaagccgaagtacgaagcaggggaggggcatatggagaggaaggcgaaggggaagggacctcaccgatttaactgctccatggtgtccatggcggcggaggcggaggacgacggcgagcggcgagcggcggaggattttagccggccgcgcagcgtggcgcggaggcttgagttgaggagaggagaaaccgaggagaaaaatggctaccccgaaatccgaatcacccaactcgacctgccctctttggacttcggagttcggaccgttggactcgacccaaacttcctctcctctccccctccttgcgccggaaggaacaggagaactcggtgagctgaaaggctacgtgaaccggcgcacgctcagcccacgcgggccttttccttttttttcttttttttttcctctcccacgccggtttgttcgaggctcctgcaaattggacgcctgatttttttaaaaaaaaaatcgagcgttattccattatagaccggaattgtttcactaagtaaatcaaaaatgtttcaatatggtaaaaagctgaaacacaaccaaatcacctcatgaaacattttgctacaacgtatgaaacaacggttttcaaaaaatgggcgatgtttcaccctcaatgtttcagcaataacgaaagaacatttcaattcttaaaaaaagtgaaacatgctcagatggctacatgaaacaatttggttcaatgtatacaacaaacgatttaaagccattgcaacacttaaatcccgtgtacatcaacaaaccacgtgtccatcaagatggaaaatattaaacggtacaaaaatccactgcaacatttcatccatacatagtaaaacatcacgagtatacttgctgaaacattgttggtgaaataaaaaatgaaacgaattcccttaatagggcgttttcgttatatcgggacgacggttgcaatggggacacgcgtggtgggggacacatggagcgtggtggagatgcatggagcgcgtgtgggcggcgggaggcgcggcgcccgatttttctcccacccattgggcgtccaatgtgcggcattttcgcagtttttttctcttccactccaggccgaataaggacattttcttttcaactccatttcctttttttatattgtgtgctttcaaataaatttaaatttgaaaatttcgagtaaagtttctactaaaatttgaaacctccaattcaaatttttaaaactttcaactcaaagtttggaagctcacaaatcaaaatttgaaattttatttcatatttcaaaattgtcaacttaactatttatttgttatttttattatagaaattatgcttatcgcggcatagttctagcgaattgagttggtaaggcctcttgtttcgtaacctgcctacctgagttcaaattgtaaacttggcatgtgtatttagatttacggctaattattctttcaataataggcaatgtacccgtcaacagcgagaccactattgtgacttcgtcaattttatgatatgcctgcctaatcttcaaatgtacttatatgagtaaggtgtgcgtgcgtgtttatagggggtgagtgtgcgcgtgtgtatatgagcgcctgcatctctacggtgggttttttaaaaattttttgtaagagtaaccaattactgaatcttttgcacataattgcaaagattattctattaaatgccaatgtgtaatttaaatggttttggcatacaaaagatataacccccatttcatatctcttgcttgcatttttttttcagtcttagttttagataaaccaataacttctgatacgtggtacagtggtaagcttagataggtcatagatggtcatagatttattcggtctttgtgtatccatcctcttatttgatcaatcttcgttgctaggcaacgatgtagtgctagaaggcatgacggaggcaagatagggacgataggtagacagggagccggtgagcggccggcataattgttatgctgttttttaaaaaaaaaaatttggttaattgcatcgtgtatagtataaactaactgaaattatcctttggacgatatacaattacagaggaaaaaatagtctcgtgcctatgatatgttaggtatgatccacaatgatctcaatatgagttgcacatgcgtgattactagttgcgaataaaggcacggcctccacggggcgacaatgagtataaacatgctatctatgtcaagtgccatatctctgaaactacagcttgtcaattgctatgtcccagatcacatcatatattgtgttaaaactggtaaatgacatcatcatatatttctggtgtcccttttctaatggctacttatacacaagcgaagaccagtgtatcattcgctactgatcctcagaaattgtagcatttgactactcagcaggaggtatacagttcttctccacaagcttgaaaagcaaagtgcggaaggcagaattcatttttagttgatttaagtcaaactagtttcatatactcacggtatgaatactgtgattaaatgtccaaccattggtaatgtatcaaacttgagccatcagtcctactgtcccagtgtttcaaacttggaccacttagcacattctgacattaaggaagtaagcaattcttcagccctcttcccattcataatcattacaacttacttcttgggtctccacattcagatcagcaaacttatatacctcttctatatttcctacagacacattagatccaaagtcaacacactaaaagataagatgaaagtcgacatgttaaaaaacatcgcaccagtgagctttcagttcaaaacattgtatgactaacatttttgacatatataaatcgggccatataattagctaactcaaccacaagtctgtgaaacaaaaaaaatggtggtaatatcatataaattcaaaaaatgataacaaacaattaccttttcattatagaaatacaaggggtatgtaattagattactagaaaatgctagactacagctagaatagttgttgattaatattttaaagaaatttttttggctcttatgtgaaattatagataggaacacaagttttgatcaagaaatacctgttgattgcctcactttcaattcaatgccatcatcaccagattcaccaccatcatcacgttttgatttggcacccaaccgcctctcaaactgtgcatcagaagcaaatggctggtcagaaatacatgctaggctttcttcttgtatcgcccttttgccctcatcttcctgccttttctggatagcctcataataagcttttgcgtatgcctcctacagcattaaataaaaggtgaatttatatttaacattcactctactagatagttcttgattgtgaaacttataattgatattgaaatgcaaattttatcagatcacctgtatgctcttcatctcatcttcctctgagagctgtttcttgtcactcttggcttctgaactttgatccagatttgcagtgttgttgttttcttctttatgttcccccgcgaggactgtgcgcttacgattcatccatgagtgctgtggctttatactttccataccagattcaacaccttcctgtgcaccagtacttcctaagaaattaacttcaacctggaaaggagaattggattaatcaggcagtgcaatatctagtttaaatgaagtaaatttcacgattagtacttacaggggcaaatcctaataatcaaaccattttattccaatctagaaagctagtagatgtttcaggaagcatagaaattctagcagtattcccagcataacaccatggtcatgctatatgcctcaatcaatgttgcctttattggctccacatttatctaaatttgcacctttagttctaatgaatacagctcaatgcatataccaggcttacctctgtttccccaaggaagggcattggtttactgctgtatcgcccttctgaattctgagatgaaccaactgcaccatttgcagatgcccctatagttgctctttcccaatcttgcaaactcataaaagatggaaaaggaagatcctttaccctgtcaagtactgctattagtggtttcaattgctcctgcattcatgcatgttcaaatgttagagcagaaatctataaaacgcagcatcacaatccacactatcatcaagattctagaacatgcactttgccatccatgtttaagctaaaaacttccttgcagtcagcatcttgagggacacgcttagccaatatgggagaacatacaccgttgtatttattttatatacgagaaaaatgcattagctgaatcataaacatatacaagtgatcagcgaagtgatgcttcatagatgacataaccaatatatatagaaatattttcatctttgctatagatgttgaaactatatatatggttcatatcaaagaaagtccttctcacaacaatgaaatgctatattgttatcgtgctattatcacaaatgcgataatggttagagagatgctaaactatgtattgtctatgtgcaatgtaaaaatttatagaaagtttatgcacaatttactggatagcaatctgattattggccaaaatgcagattcactaatttagtttttctgaccaatgtaaaacaaatttaattattttccgatagttatagtatgtaagctgtactaaaaactgaacaattctaacatcatttatgtttgatctatgctcccaaatttggtaacaaatttctaactgaataaaaagtaataacctccattctttgctgcatatccttcagtttatcgtgcgtatgctttattgcattgccaccaccacacacaatttcatccaaagtaagcttttcactttctggacgaagttctcctttgcaatgctcgcagtgaaaatagtcatccatatcgctgacaagttgcagtgcatcaaatgctgaatacctatggttcaacagagacaataatgtaagcttcatttttttatgtggtactatagatccagaataatcagaagtatacttagtaccttcttttacaattaggacacacataatgctgaactgtatctctgtcatctaagccatctttcaattttttcctcatgcggtgtatcctatatcttacaacatcatacacctgtatttcagaaaaatatgcacattacaatctatatcagattatgaccagatcaaaagatgtttttggatcatgggatgggtaaggtacaagcagattttattctaagactgaagatggataatgttatctctaacgctgtggtgagagacagattttatctcactttctgttcaacaaattttcagtaggattctgtcctaataattctaataaagccaaatgacttagattttgccaacctatggaagagaaaccaatttaatcaaaacacccaccatgcatgctgaaaaactgcaatgttcaattgaagtaatttatatgagaaggtccgcttgtgtgatttttggcccatgcggttttctaattatagttcagttatacccctaagatgtgattaatgatttctttattattcggtacaaaacattgcattaagtccaagtgttcacatcttataatgttaaacaagtttccatgcacagagtctatatcaaatctcagtgagctctaccacacgtaaaaacataagaaatagatatagtgctacaatgctacatgtcccacacatgtgctttgtggatcaatgtgaaaagtcaaatatcttgtttatgcgaaagatttcagcaaacaagtttctctttcattagagaagtattttttccctcaaacacgcaagagaattacgcgtcatttcgttaagagaggtgggggggggggcgatcccaccccaagagtcagaaaaaaacgtcattagagaagcaattgtattgaagattatatgttcaatcgataagtaacctgagcatagtccaaacaacagtaggaatgtgtgtgcatctttgctttctctcctcccttagtaaaaggatgcacatcaccagcggtggcagagacatcgttatatatgtttactccttttggttactgctatgacataaaacaacacaaggtgagaaggggcaaaaaaaaaactgagaatcagattaacaaacaaagatgactcctggatgttcatattgattgcacctccgaccacacaacccagaaaacaaaagagttcaagcaatgttcaggtcacctcatgctgtcattaatgatcctgtgaatgttgattgtcttaagctctttggatgcttatgttcataaagtgaacctaaagttactccttatttagcaatactgcacacacgaagtgattcagtgtgccaagcaaaacagtgtaaatagaaggctaaattttttagtacataggaaaacagagcggccttcatatctgtaagaaaatgactatacaagagtgtgtggcgcaaatggtatctaaagagccctatacaacaaccatcacaaaaaacaacaaaaaatccatggcacacatagatagtcagatttaacgaaatatgcatattccggaaaatgggaaaatgtttaatatggactataaaaaagagcatagcacacacatgtttatgcctctgcagtatcaaaacacagatgaaatatacatgacataaaatttcatttattgaagtcccacctaagttctgctgaacttttctgatttgtccatgtaagattatacaagtcattaatgcaccaaatatagttatgcaactaattcatttcccatgtatttccactaatcacgtacaagcttatgtgaagtaggtgctcaaaaacatatttctggcactcattctatagtctaaagaaataaaataataacaccactgcatataaatgtggataatttgtagaatatcttgacatcttgactcggttggaaagtggtcggcagtttttactttttaggataagtggaaaatggctgagggcaaaacaggtagagagaaaatagaaatgtaaacattttgcaaaaagaccccaacatgacaaatgctagagatgcgcaatctttaatagtggcgattcactactcacattgggagtgggtggcatatcctacagtgccaaactgagaggccgcaatcgttgtctcactcttctatcaggtcttgctttcagaaactactaataaattaacaacttctgttttaagtggagtagatggcgattccatgctagaataaaaaaaaaaggctatgcaaaaatgagaacaactttctctcagaaatttctaacctccttccgatgacatcttctcaccagcttctcttcttcaaaaaactggagaatgcggcgcagttgcttagaggaaatctttaatgctttagccaaatcttcctctcggacccactggcgccgcctgtggtaaaaaaaagtatcacaattgtgcattggcactacatataaatatataattagttacacacgaaagaagataataaatattgaaatgagagaaaaaatgtttcagagagagagacagaagaaagataatagatttactaagaagactaaactctttgtgatcagagttggacaattgaagcagcttctccaattgctgatttccatctctagtaaccaaaattttcttatttgcgaaagggcaggggcactgcctcatgcattgaataaaggaagaagagttatagtaagagagagtgaggagtggaagccgcctcctcacacaagcccgaaaacattacacatacactataggaaaattttattaggcttgacagaggatgtacactccggggtgcgaaagataggattaaggaggagaaaaaaaatgaatacagacgtaagggcatagtagtcaaaactgagcaagcagcattataaaaagaaaatgtgggacatcaacgagtaccatgtagcactacttatatggattaggagggaaaatgttctctcagcagttccacatggataatgagtcataagaaattatttgtttcataatgttgtatacaaactggatctagttggtgatagtggtgattaaccattatttcaagttgcatatttggaatgaagctatcaattctagatgccatagatttgataaacgacaaaccatgagcagcagttacaccaaaacagtacctaagggatcataacaaaatcgttcatcattcactctgaaaaaaatcttcaaaaactggatctacattaccaatgcttgtttgagcactgaacaggacgttgtggccaacctgctttaagaaacgaaataatcaatttaaccttgaaaaataaatcctggaccatatgccataaatttgacaatgcacaggcacaaaaagtctgcattaattatctgttactgtaaattctccttgcctaaaatcgcaagaggccaagagtgaagagcagtattcaacatgaaggtttcctcattggcgctagcaactagcatcatcaatcaatcaggtaaatgaaaccaacagaacatgtaaggaacagaaacacacgcaacagggcacattgataagcgacagcaccgaggtcaaagctttggttcaggatttaggtttgatctcactctcacctgccgagggcttcgaggacaacgacggcaagcccacagttgtcgccgcgagcggacttggggtctctggccagcgagacgtcgtcgtagaatgcgcgcgccaccatcctcaccatcctgccatgccagccaaaaatccccaaaccaaaaccaataaaattacacctcccgcagatgccaactatcatcaatgcagcatggatacacggaggggagcacagtgggaggatccgcaccggttcaagggctccatggaggccatggcggcgacggcggcgacggcgagcggcggttggggtttcgcgggttttcgccgcgatcaaggaggttttagccgctgcagcgcagggcgcaaggcttgaggacgaagaatgcagcgaccgcgccgagttggttgggttgggtttcgtttcgtttcgttctcgagtgtaccgactcgtgtgggtcggacccgagcccgacacgactcccctctcgttttaagcggtttggactcgaacccgactcgaccatttttcttcttctcaccttcttgcggtggaaggaaacacgggcgactgagcagctgagtccaacatcgccgggagagagatggcggagacatcgtcggcggcggcggcggcgcagaccgacgcggagagggaggaggcgctggaccggatgctgacgcggctggccctcgccgaagacgcgcggctcgcgccgctgctcgcccgcgtcctcccctacgccatcacctcgctcgcctccgccaccgcatccgtccgcaagctcgtaagcataccactcctctggtcctgggtcgattgaaatttgtatgtgagacatatgtgtaggtgtgtcattattctccttcggttggtttagttggtctcttggttggtgatgtttacaatgttcctgcttcaatttgatgaaattcgagcaacagtgcgtattatagtgttttagtgatttgttcatgtacacataatcttctaaacgacataattagagagactattgtgctttatgttgcaagaattacttgcatttgttactgtaacctgaacctattcagaggtagcagagtgccagtcctgttttccttcagttctttgcatgattctatagcataatttccatgtcaattagacaatggcatgtaatggaaaataataccatttttggactccattaggttatggaaattctcagccacattaacaaacgggtgaagcacaggcctgagatttcactgcccatgctggatttatggaggatttatactgaatctacttcctccacaatagtccggaatttttgcattgtttatattgagatggcatttgaacgtctgctaagtgaggtatcctattctgcttcgtttgtttctcattttctctaggctgttttaccttttctgcaaagccaacaacatgaagttaacattctgtaacaggacaagggaagcatagcacctgatcttttaatcaacatatcaaatgttacagagcagcatcagggaatcatcttgagacttgtggtgaaggtttgtcacaatttaattaagactgttgtccaccacagagtttacacaatttagtcaagtctataatgatttttgataagttactcatagcttccttttcttcctttggtgtatctgcatcctaaaaagcttgctagtttttctctgtttttttaaatcttgttgtcaggctattggtgaatgtaacacacataaggtgggtgacaatgttgcttcaaaatatcaatccataagtggatctaatgatggtctagtcttcgctgacttctgttttcacacagtactgtatcaaacaccacctcaagggtaggtttccttgctaaattaggtacaagtatgaaacttttttttatttatggagagttgactgctagtattcttcagtgttggatgcccggcaggactttcggttgctcaatcagatcgtgttactggaaagcagccactaaaaggtgacacacttacatcaagaaaggtaatacagaaatgcatgtatcatttattcatgttatgcctgtgtatgcaatcatgtcagcatatacattcgcacattttaagtccttgagtatagtaactgcaccttcttacagttgaatttcacttgtgatatcttcagctaggaatcttgaacgtcattgaagctatgcagttggcaccagagattgtttaccctctttatttagctgctgcttcagataggtacttttttggaattatgtttacaatccgctgaaatgtttgtacggatcattaatcatgaggatcactgtttcaatgaagtcaagagtcagttactaagagaggagaggagttattaaagcgcaaagcttcagctgtgaacctagaagattccaaccttatgaagaaactgttcacactattcaatggtatgcattaaggattttgtagcatgctaactcaagcaaatttatatttcaatataatactgtcactttgttcttatgtattgtcatttttgttgggtggcatatgttattctgtccttgaggtgactaaaatgcattgttgaaatccagttccttacataaagggcaaagctaaaattaaaatcatctagtataactttgcctccacttcaaattatatatagaaggctttatagttttctcgagctttattgttgcatggtcaaaagatgggtgcggatacctttgttgcccctcatcttcataaccctagcaaggtccttttggtacagcacgtgtctattccatgaacatatttcctccagcctagtcccgaagcagtaggtcattgggggtacccctccaacaagtttcatttaaaatatatcactcatgaggatttactgatcctttttacaccatcttctctcaccttgtaattataactaatgttctcactaactgttctcttccgtatttttaactgagataacaaggtcatgtcctctccttctcttgttttcatacccttcttaatacttgttcccatccaaagtaagccttacattttgtaaaggtttgtgtatgttagcaggccagcatttgcacatggcactctcctgtaccaacatgtacacaatgcttctctttattttgttttgtaaaaatctcttgcttgtttttatcagtgcaaatctgaatatttgtggtttctcatggtatatgatagatactgttctcttttgcctcaggtactgcaagtccagaaaatatagctgcagagctgaaagtcgccccagcacatagttcactgcgagtccgccttatgggtgttttctgccgatcgattgctgcagcaaacgcattcccgtacacacttcagtgcatctttggctgcatctatggtattctgtttatatatatttttactttgtgtatttattttagttttcttatttgttgtcatgaccaataaaatgaaattttaataagctgtgtattaacaaatgcactcttttactagttttgattatttacatcaccaaaccacatctttaagtagtacatagaaactgatttggtatgtttgtccttttgtacaataatctttcttttaagcatcttttagagttttatggaatggtaggagcagcagaggatgatcttctgaaaaactattaatatcaaattaacaataatgtacagcatacattacaatagaatgataaaagataaaggtgggcctagaaatttatatctggaacaagtgaaagagttaaaagatatgggctagggttcatggaggataaacaccattaggaggatagcaaggtggcagcggctccctgggatgagaagtaggcatagactgggatgcagaacattgaggacaatggattgatattttttcttgctaacagtgacatccttatatagaggtgctagagcccaaatgatagaaactaaataaaatcataccttggatatagccatctacttccatgaaatatctaacatagaaactaataatccttatccccaaatcaattgcgcagcccataacacatatatgcatgacttcctttaaagagggaaatgcaagatgaggacttcatttgctttttaagtgtctatttctatgatatggaacacattctatgatatttcttgttatgttgcattcaattcattgctaaaactactcaattgacatttcagcaaggcaataactcaacttcagcatgccatgtatcgttactaaactcatatttgtttctgctgtgtttctatgcctgaaggaaacgggactacttcaaggctgaagcagttagggatggagttcactgtctgggttttcaaacatgtaggtgcactttgtatgttttcagttcaccaacattgattagcttctagcattctttacttgtgctcttccaattttagttttttcacttggagcagttctgttcctttctgtcaaccttgtttcatggtctcaaacttttatcaattatcattgtttccttattgatttaggcagcaaatgaccagctaaagttaattggtccagtcattctcagtggaatattacgttcacttgatggttcttccactactgaagcaggttttgcacttgtcatcgactctacttgtttaggcatgcatgtgatttatcttcacatccctttgctttgaattacttgggttttaacacttctttgacttcctattttgccatgtcaaataagttgagaaacagtgaatgatttattgatttcctttatgtccagattcttccagtagggatattaaaatatttgcctaccaggcaattggtttgcttgccactcgcatgcctaatttattcaggtatgcccttttcttactcttctgctttcttgcctcgtgattcatttctgttatggagactgattttttctactttttatgaacattgcagcaacaaaactgacatggctatacgactctttactgctttaagattagaggagcaatctcttcgtttgacaattcaggaggcagctactgcccttgctacagcatacaaggtacttacttgtaggatatgctaatttcctccaaaatggtgctgtactgctgtcctgacctgttaaaaatgttggcaaagatggttgtgaaatgtgtttcgagggtgtagtgatttccctagggtgctgtacttctgtccttgacatttctcattattttgaatggtcagatatttttacgctgtagttgattaatgacttgatgcggaacaaacttactagttttgttgatgaagcacatgaatggattgtgacgccccatggtccaaacatggtacaatctatccactttgctggattaaaccacatacattgcaattctttgaagcttttgatctcgtttgctgcagttgggttaacctggaattgccttcatacaccaagttttgtatgctgcattgtcacactcacacctttcacatccaacatagactgactaacccacccccatccattcacgcacacatgcatatggacctccaagttctggcttggttagatgctaaaagatgtcttgcaaattgcaattttatattcttgctattattttactgaaagaaaatcttaacatgtgacttgaaatagttattcgttgaatgtgttcttcgttctaattataacagcatgtatctaactcatttcctgacatcaaagcgaaaagggtaatgagcgaacgttcgctataagttgatcccgcgaatcagaagggggaaattggaggacacgtattttcttcctttttcagtttcctttttccttcttttacgtgatttttctaatccgttgcaaagtctcaaccatctccttttattttctcacttcggtttattttcagatttcttttttttcgttatagtatttttatagcctttttaatggaaatttttatataaacaatttctgtgaaaactttctatatatagaatttttatatatagagactttatatatgtaaaatttatatacatatatatagactttgtatatgtaaaatttatgtagaaattacgtgtgtagttagaaagtttagtgcatataaattttactagaaataataaaatgctgacggaatttttttaaatgtataatatccgtggaaaatttctatgtacagactttctatatagagagactttatatatgtaaactttatatatatatagattttgtatatgtagatttatatatatatagattttgtatatgtaaactttatatagaaattatatctataactagaaagtttagtgcataaattttattagaaataaaaaaaaatgctgatcatcatcacatatttctcaaaaaaaatccaatccgaacaaacctcctaacagaaaaaaggataaaacgaaacattgatttttttccccatcgcgtgaaatggaaacgggaaacgttttcctccttttttgctgttttctattcgccgctagcgaatgttcgtgcattagacttacccacatcaaagttagtaccgcctggagtgtaacagatacgtgctgaggaagacccttggcaagaagtagaaatatagtgctcaccagttccatgaactgagggagggagggtgggctttgcatggtatggggtagtggtaagtaggtacatgccatgattgtctagcagttgagggaggactggaggagattaccagttcagcttgcaacagagatcaacagataagtccttgggtttggttaagagataagtttaatcaggagataatcattagttgaggtattcttcttaaattgtttgggattcttgctgtctgatctatacatgcagccactagagaatgtattcggcacagagggaagatacaagaaggcaaatgttctgttgagtgttgacatttttgggttttacatacttgtgacttgtaatatttattgctttgtcctgttactgcatcatgtcttcagtcagtgtcgttcatatgctgttatgttactccactttttctggaaatatatttgtgatttccttttttcttaccagggtgcttcggttgtaatattgaaggatattgaggcacttcttttggaaaattctcaaatggtaagttcccattcttgtcattgtagattcttaaatactcgagagcccacagctgcatcaaaattttcctatctacagttgaatttgtgggtgttacttctattattttttctcagactcatctagatatatgtgaaagcaatagtttgaaaagatggaatatttaattgtttatatgttgttgattggcctgatgagaagttctattggaatacaactatatcttcttacttttgtgatagttgaaagttgaaccctactgttcgaggaatgcaagtacttttagtcatttagattttgcatacttttgtgattttacattttttatcttattttttcttcaaggagcaaagtgaggtccgattttctgctgtaagatgggcaacaacactatacgatatgaagcactgcccaagccgatacatttgcatgcttggtgcttcagatgtaaaactggacataaggtttgttagaaaagatcttgccgagttgttgacatcttgtttcctttggtttctatttattatttttaaaaaaaatataattatatgattatgtttgtcatcagggaaatggctttaactggtctgaatctgttaaatgatgaaagggagtcatttgcaatagcaactgattccaactatcctgatattgcagacatggtaaattatgtatacagccaacagcctcagttgctacactgtgatgagcagaggaacggaaaattgcttttcccaacaaaaacatttcttgcaatgataaagtttctaatgaagtgctttcagaaaagtgatggctcggattttcttcaagaagatctatctaattgtccagtatcaaaattgtgtatcattttagaacatgccatgtcatatgaaggatctagtgaacttcatgcattggccttgaagtcattggtcgatatttcctctcgtcaaccaaaggtttctgtcctatattatctgttaaagcaaactatgctttcttcacatgtttaaacttttccttttttaattttagttggtgtcatcgcgctatgtgaaccgtttactttggctaagaactttactgggccatgttgatgctgatgctcgtgaagcaacttcacgtctgcttggtattacttcttcagccctttcaagcactgctgcactggatcttctctctgagctcacttcaacatttgatcaaaatcgcccatcaaggtatggaagagaaatttaaaacacaaatccattttctctgtactgttatgctacttctaattcacgtggatatttgatgaattgcaccagattcgaaaattaccatggattgttatgtgcaattgggtatataactgctggttgtttaaaggaatcttatgtaagtttatgcttctttcatgatactattttttttgcagtttgtttatgtcatttctttgctacatgtgctttacatgaaagtttagtgcattcgctgttcgcttgacaccattaaacctatcttgaatataatttaatggtgttatatcagaacgacttgatgggcatcccattagtaataccatccatgagaatcctttttgttattctctagtactaagaatatgaaatggactagtgtaagacggttcttgtttggagtgtcatgtgagggacagaattgcaggcagggaaagaatgagagtagtacttctctttccataagttaaatgtgttttgagattggggattctaagaaagaaagggatgaattacattataatttacctatgccatacaatgttcagttgttcacaaaactataggacaacacaagaaactatgttgatttttatttttattctttctctctgtttttttcctaatataaatctttagttaattttagggtattcccgtgctggtttcttgggcggttaatgtgccaaagtggctggggtgccccagggaagaaggcacaagggacagtctgtagctaggcagttaannnnnnnnnnnnnnnnnnnnnnnnnnnnnnnnnnnnnnnnnnnnnnnnnnnnnnnnnnnnnnnnnnnnnnnnnnnnnnntcatcaatgcacg

SEQ ID NO: 22105 - DNA, 4243 bp, Oryza sativa
  unsure (1)..(4243): unsure at all n locations
cctgctcccttgattgacatttcactcggtacccaagaagttctttttgcagccggggaggccctatcttttatatggggggaagttcctgtgaccacagatgtaatactagaaacgaactttgtctccctttcccaggccacaaactatcttactggtgatgcacccgtacttgtctcgagtaactctaataaaggaagtgattgtgaagaagcacacgcaatggctcgagaagaaattataaaacggttatttgatacattaatttatagcagtagaaaagaggaaaggtgcgcaggtactgtctggttggtctcacttacaatgtactgtggtcagcatccaaagatcctggaactacttccacaaattcaggtctgccaatcaataataacatatatttatcattgtagaagtactatatcttaggacaaacaagagtggtgcactccaaagtttacattagaattgatacaccataggttgttgtgtgaattattaatctgtcctaaaattaaaacaatgccagtatgctggacagggcacagaagccaacaactgttaataattgtgtacctttcatctaaaacatgtgcttgcttatagtataattcagagttcctcagaggtttcagctgtcaagctgtcactgaaaaatattaatttcagtactgatacaatcacctatatttagacttgatccatgtgcaagtgcacttctttttaggttttatcctctatggtgtttacgcatttcagttgaagaaaaccagaaactttgagtatttgattctacaaatcgtgcatgcatatactgatgtagtgtagtgttttcagttagtggagtccttgtcttggggtgaaagagtgtcctttaatgttgagctattctcatattcaaactttgtctttttctgtcattatatgtttctcttctaaatgtcttctatcttgtatcattatgttcattccagcgtataacagtttgctctaggtttctgcttaccttttgaagttcattccttttataggaagcccttacccaccttcttggtgatcagaatgatcttacacaagatctggcatcccaaggcatgagtattgtatatgagcttggtgatgcatctatgaaggagcagctggttcatgctcttgtgaatacactgtctggcgcagcaaaaaagaaaagggccatcaaggtgcacactatgtttccagtttccattttgagagaacctggaatacccccgaacccgtacccaaaaaaaaactgttaatgattaatgttttctctgtctgcattagctgatggaggattcagaggtttttcaagaaggaactattggcaataatcctactggaggaaagcttagcacatacaaggaactttgtagccttgccaacgagatgggccaacctgacttaatatacaagtttatggatctagctaactatcaggctgctatcaattccaagaggggtgctgcttttgggttttccaagatagccaagcaagctggtgaggcacttcagcctcatctgcataccttaattcccaggcttgtccgttaccaatatgatcctgataagaacatccaggtattgaactatacgcttacattatcacatatgccatgttttgttttctgatttttgtgttgggtttaagttcttaaagtgtttgtatgctataaccttatgatccttcattgcaccaaagtgagtatgaatcttgttagctatggcctgcaaaatttcagcaactccacagctgaggtcgtatgcatgtttgtaatcttacctagagaattattggtttgttttttccaatagtgtgtagatataaaagtataatgcggtcttcttgttcatatagaatccaaggcagtcaggaagtactacagtgcatcagacagctcagattatctgattttgatcacttaactatttcaaaaatggttcttcctagctaactgacactttgtatttcattctaggattctatggcacacatatggaaattaattgttgcagatccaaaaaaaacaatagatgaacattatgatctaatagtagaagatttattggttcaatctggatcgaggctttggcgttcacgtgaagcttcatgtcttgcacttgcagacattattcaaggtcgaagatatggtcaggtagataatttgttttgctaattttgattttttttaaaaaaaatcatgtaactattttgttttgcataagctatgaataactggtttaggatttattttgagaataaaatattgcttatctttccctttgttaaggtttctaagcatttgagaaaaatatggattaccaccttccgagcaatggatgatattaaggaaactgtgcgaaatgctggtgacagtttgtgccgagctgtaagcttgttgacagttaggctctgtgatgtgtcacttactacttcatctgatgcaaatgaaacaatgaacattgtactgccatacttgctttctgaaggcatactcagtaaagtttcaagtgttcaaaaggcatctataagtttggttatgaagcttgctaaggtatactcattgtcaaattcaaaaaaagttatctgcattaacattttagtggcaattttttgctccactgtaattttctttatgtatgctgctgtcatgaattgaattacacgaactaactgcccgatgttcacagggggctggccctgcacttaagccacatctgtcagaacttgtcagctgtatgctcgaatgcttatcaagtctggaggatcaaagattgaactatgttgaggtatgctacttttcttggtttttgttaagcacggatgggtagtgattttccaagacaattaacagtttctatacctcactcatttctgaatttggaccaaagatgcatgcaggaaatgctggcatccaaactgaaaagcttgagagcttgcgtatagctgtggctaaagattctccgatgtgggaaacccttgatatctgtttaaaagttgttgacaaagaatcactggatcttttagttcctcgtctggctcaaatggttaaatctgctgttggtcttaatacaaggttagttttgatgctactatgaaccttgtagtataattgaaataataaattgttgcttttcatgtacttcaatcttgttgtcattcattttatgtttgtcttatttcagggttggtgttgctagcttcatcaccttgttagtacagaaggtcatggttgaaatcaagccatatgcggcagcattgctgaggttactgtatagtgctgttctggaggaaaagagttctgcagctaaaagggcctttgcatcatcttgtgctgcagtcttaaaatatgccagcccttctcaggctcagaaacttattgaagataccacttctctgcatttaggtgaaaaaaatgctcagttgtctgctgcaattcttattaaatcttatttaagcaatgcagcagatattcttagtggatacaatgcagttgttctcccagtaatttttgcttcaaggtatgtgaacgcatgtagtcttatcttagccttttatcttctctaccattgctaatggtattacagatattaatgtgttttgaagttcactttcagtctatcacagtaacttgaaatgcacatgttctttgaactgtacattgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcgtcatgggctgggaagagaaaggtgaagcctttatttcattatcttactgtccatacacataaaagtatcatagcttggaatacacttacagtactgtgtgctacttgcagtcagccaaggctataaaaaaactatgtgatgctctaggagaatccctgtctgtgcaccacaataatattcttgaatcacttttgaaagaactacctggtcgattttgggaggtaattagtactatgatttttctatctgtggcttatcagtgaatctttccttttattcatggaataaaacaggatggattgcttagagattttcaagannnnnnnnnnnnnnnnnnnnnnnnnnnnnnnnnnnnnnnnnnnnnnnnnnnnnnnnngtnatagccgacgtgcatcagtgctcgcg

SEQ ID NO: 22106 - DNA, 782 bp, Oryza sativa
  unsure (1)..(782): unsure at all n locations
cgcgcgtgatgacattcgatcactacgggcgaattcgagctcggtaccatgtcgttgaattcagttgaaatctatgtttataaaaaattacatgcacaaatttctatataaaaaatttctctttctatatatgtatatatattttagacatgtaaagtctatatataaatatattttctttactgggccatgttgcttttgttgggctgaattctagaaaagagagaaaaagatgcacgtggaagcctacgagcgtggaaacatgaccgagaaatctgagtcgtcgcgctcgcgccttagcaaatccatcttaggtgtgtaaacgtgatcgtgcacaccgtggacccatggttgctcaagtattagacggaccctattatgtttgcatatccattttttttcatttcctccagcattgcaaaatgtgaatgctttatcagtcatttctagttcacctgaatttatcttatagaggattattttgtactacctctatttttttctttttatatagatgactcagttggcttttggcataatgtttaatcattcgtcttattcaagaatttagtataaatatgaaaaaaatatgagtcatataaattttattaataaagagaaatggtcaaatgtcacgttaaaagttaaaaaaataaggggagtattagtgtctaaaataaagggggctaaaaagaaaagatctagctttgtaccgtttgtcgaactattgaagcaaaattctaaattgttggttcttgcatctcttttgcatccttattaan

SEQ ID NO: 22107 - DNA, 771 bp, Oryza sativa
  unsure (1)..(771): unsure at all n locations
cgctgggtggtattgacacttccnatnnnnnnnnnnnnnnnnnnnnnnnnnnnnnnnnnnnnnnnnnnnnnnnnnnnnnnnnntttccgatctgtaccgacatgtttccgtccgtattgtttcgtttccggttttccgatatttccgatatcgttttcgtttccgactttaccgtttccgatttcgtttccgagaaaaatatggttacggaaatggttgaggctgttttccgatcgtttccgaccgttttcatccctactcgtcggcacccgctcgctgctcgccgtctcgccgcgcatgtggaaggggccgccgcggacgcctggtgatggaggaggggaagaggaggtagaaaatagagataaggtggtgacggaggatgggaggaggacattccatctttgcacatgggctcgctttcaatgtcgatgtcgtcgaatatcaacgattgaatagactaatgagttaatgaaatactactggacgctgtgctggtctagaagattcttctcttaaacaataaatattgcaacatactaataccttctatttgaacgggatttaccgtaaacttcttttactttttttgacacgggttatctaccttgacgctaactatatgcacctaaaggaaaatcctcacactttctccttgaatttctatggttttgaatcaatactttatagactgatttcaaaactaatatggggcattagctgtttttatattgtttaatagcgatcaaatgttcgagccggccggcttactat

SEQ ID NO: 22108 - DNA, 869 bp, Oryza sativa
  unsure (1)..(869): unsure at all n locations
cgagatgatcgccatnnnnnnnnnnnnnnnnnnnnnnnnnnnnnnnnnnnnnnnnnnnnnnnnnnnnnnnnnnnnnnnnnnttctgaaaataaaaaaaattgaacaagaacaaattcatatacctgtagaactcagttagcataccatcatggctgcctgcagtaacaatgcagttccactcatgatcagtgagataggaagtgaaattgttgatgaactccagggcagtttctcgttgaggcttggagatgcacacaatgtccaggccaacgaggcagagaggctcagatgctatgccaacgtactccccctgatgcgacgtgttgaagttgaagccaggaaagttggcatttttattctgctgcaacagcagacgtgatcagttgcaatttgggcttcagaaactgacagactgtaaacgtgaaactgaaagagatggatttgggatgcagagcagacatgaactaattgatgggaatatctactactactaccaggtagggcttcccttcaagcgtgcggttgatgcgaatttggtggaatgggattccaagagcatggtgcacgagcgagtattggagaaggcgactgacgagcgcccgtttcctgtcatcttctctgacgaacctgcagcggtgaggtcgtgactcgtgaggaggaggagaaaaatctagaggctgaattgaatttcagtagtgagtgggtggaatcaatgtgggggaagaggaattggttggaaaaaccttgggatggcggtgcggtccttcggcgggaagagggccgcggccgtcttgaactcagcgggggaaggggcgccaccggccgaagttaacaagcacctacaccggccccttccaagctggtttgc

SEQ ID NO: 22109 - DNA, 851 bp, Oryza sativa
  unsure (1)..(851): unsure at all n locations
caagaaattgtcttggtcaatttttttattttaagacaactgaagggtgctgatcatgttaacaagccaaaatttgtgaagttacttaagatttaacgattgtctgtttttgtaggtattggtgtcttaaagaagcatttgtcaaagctacaggtgctggcgttggatttgggttgcaacgtttggaattccaccatatgaattggactaatatttctctccgtattgatggagaagaggataggaaatggaggttttggcttttcaagattgatgaaaagcatttggtatgtctgaattttttcacaacatctacagtgcctaaactttggctcttgtacttctagttttggtcttgtgataggttatttgcttacgattatcaacaccattgcaggcatccattgcgaaagggcatccagaggatgctattgacagcttcaggagaacattatctgatgtggttattcaggagggagaattgcatacggcaatagaaattccagaagaagctttcactctattgacagtggaacaacttatacagttacatgattaaatggtcttcttgaattttgcggtgacatattaatgcaggactaaaatcaacaaattgtgagtgtatcctgaaagttaaaatatatacatagcacaccaaaattaggaaaagtatccttgtatttgctctcggtgcttctgcagaaatgagagcttaggggttagggcctgtttttttttttcataacagagaagacacttgatattnnnnnnnnnnnnnnnnnnnnnnnnnnnnnnnnnnnnnnnnnnnnnnnnnnnnnnnnnnnnnnnnnnngacatgcaatcaagccagc

SEQ ID NO: 22110 - DNA, 875 bp, Oryza sativa
  unsure (1)..(875): unsure at all n locations
actccctcacgtgatagacaatcctgtacgtctgctaatactctgatcncactgcgcgctttttttntttctatcatgaatatgtcctacataattattctccctnnctcccccccccncnaagttatgtctgacatacnactcggaacccggcggctcccggtgacgacggctacaggcgccgcgcctgactgcgcgtggacggaggctcccggcggcgcgtggacggaggctcctgccgacggcggctcccgacggtgcatcgacgggcgcccgcgccgcgcgagagaaggcagcgagcggcggtgcgcctagctctcggcggattgacggtgcacggtggcgtgcctgactcccgagcttcccggcggactagcggacgacggtggtgggctggtggctgcgtgcggatctggaggatttggtattttgggtagagaatttgaagttgactggttgacttaggattagaagttatatatgcctgttaaatgggctttagtattatgggccaaaacatgtaaaaagtctaaaattagtcctctatacagtaaagtcgggtcaccgtggggagcggcgtcaccctcttgccttataggacacaacagccccaaaatatatgttgccctaaaaaaggggaccaatacccacgggaggaaaacaagacgacaaaggcaccggacgggggcaaggtaaacataaacacctcaaggcccgaaaagaaccggcacgtgaaaactacgaaataccccaatcacggggcgaccccttatttcggccagcacaccgtcatctccaacgccggtcaaaactggcaaatgttctgcaaaccgacacggacgccgcagcactaacccaacagcgcatacgtgccn

SEQ ID NO: 22111 - DNA, 1801 bp, Oryza sativa
  unsure (1)..(1801): unsure at all n locations
catgctgtcagtatcagcaggcatgctatagctgggagtacaatctttacaatgttcttgttgtttactgcagaatgacatttatcgtcatgttcatggagaatgtggggcaattgctagagaaaacatcatgagacggcgcatacctgcaggagagccggcgaagtcgaaggtacaggttctcaccaacggcactggctttctccgagtcgagaagctcccccatccataccaagcaccttgaggggtcacccgtcgtgaggatagttctcaagttggcataagcgtatgccgtgcacgagcagttgcggtcgcactcatcggcacactcctcaaaggttctgttcctgatgtacaagaacttgtccggcaccttcatccctggtaaggtgaagaaatggtcttggccaccgcatctcagctccttctttcttcggcatcctctggaagagttgaggctaaatccatcggccggctcgaagccatcaaggcacttgcactcctggaagctgccggtgatgtcgcagtagccgaacggcccgcaggcgccgtagtggagacagccatggcctggtcgctcgaatgggctcgtccaagtcgatgatacgttgttccatgcccggaagctcacgttcccggtgtagtccagcttccagtgtgtcaaaatgccatcagctgcgttgtatatcgcgtagatctcctcgccattgtcaacgatctgggaccatatgtacctggtgaggccggtggccgtcgcgccgttccagacaccgttgcgccacgacgggctcgccccatgccagatgacgatatggagcccccactggtcagggtcaccgctgagggagaactcgcaggtggacgggtcgcgacgacccctccaagcaactacgcgcaccgcctcatggttcttgtatgttcgtccatagcttgaagccagggaggccaaggaggatcgtgtccgtggggtgatcgggcaaccggagcacgaagttgcccgtgttctgcagcaccgcggtggctccaccacctccgatggtgaccgtgttcgccgtggtcccctggagtcggatagcacaagcccggaggtgttggtaacagccagcctcnccgtatgggtggtgattgggttgtcgcggttggcgacccagacataggtgcgctccgggatgttgttgtaccatatgccaaggtagagcaggcttggggttgagttggtggtggtcagggagaagaagccgacagcaaagacgccgccatccgagatgagcttgtccccgccggggaaagatgaggtggctttgccggtgttaaggcggtcattcggatttggcagaaactaatcaaagaaccatgaagatgactacanntgcagtctggtcattattctcttggtaaattccttggaaagcactacaatcctacatagagacgatagaacagagttgtgagattattgggccaaccttcttgtcggcagtatagagtaactagtgcagctagcttcgtaaaagagtaggattatactatcgtaattgttatatttcccaggccctgaaatagcgcaatagatattctgtattcctgtgttgagagtgagaaaattgggattatactaccgtaaaagagtggtttcgctggaatgctatcccttcaaactgattcattaaaatgctattctaaattgaaggtgttcaccaaaatgctattttcgtttttttaggtaaataaaaatgttttttctcaattataactttttttcggaccaaaatacccctgatgcgggcccacctgtcatact

SEQ ID NO: 22112 - DNA, 7295 bp, Oryza sativa
agagtggagagtatgacatgtgggcccgtagcaggggtattttggtccagaaaaaagttaaaattgaggaaaaaaatttctatttacccaaaagagtgaaaatagcactttggtgaacacctccagtttaagatagcattttagtgaattagtttgaagagatagcattccagcgaaaccactcttttacgatagtataatcccaattttctcgttgagagtggccagatgatcagaacgacacgctagtagttgtatgtcaccgttaagattgaagacccgatttattgctcaatgacttttattttcagtgcttgatgaagcaagtcagcacgcacagggcatttgctagtcttcaggagaaccacttgcaacggcagtacggcaggcaagctattttaccagcacaactaatcacagatttacaggcaagtgttttgctgtgcatctccacaaatatttcccggtgattcttcccagcgtcctgacttccgagccagtgatgagagtgagacggtggaggtgcttcaccgggcagcggcggagaggcattggcatgggccgcggcgagggaataccagaacaaattcggcccaccagtccgcgaccggaactgtgagattcgtgggccgtgaaagtgctcgtgatgggctattgggcctaggtcgattgatctgtggacgaagacgaacgtgcttcggttacttcgccggcggagtggtggttggcggcggtggggggcggtgagccggcgacggtcggcaccgcacgtcgaagcgcccggcgtccgcggtctgccgctcccggtggagctcggcgaggtggcggaggcgttgcagcctaggagaggaagcgctcggttgaggcggtggacggcggagtagcggcggccgtgggggcaggtgccggcgccaccgccaccgcagccggcttaggcggaagagacggcgggcctaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatgaaaaatccttgcaataccaaagtctgatattttggggttcatttctgtgtccaacaagatgttgcttgctttgagatctctatgaattattgtcagtcttgaatcttggtgaagataaagaagcccttttgctatccctttgattattttgaaccttgttggccaatcaagcacatattttcttgtagcatctttcaacaagatcagtatgtacaaaatctaatgttagtcatcataaatatattttagtcaatgtaagaacctttttgcaatgggatagaaagtcataacacaccaaaaaggaaggcgtccaagcttttgttaggcaagtattcatagatcagtaacttctcatcttcatgaatgcagcaaccaagaagtctaactaggttcctgtgctgcagttttgcaattagaaccacttcattcctaaactcttcaatgccttgtccagaaccctcattaagccttttgacagcaacttccgtgcctccctccaatattcccttcatgttgtcatcaatataaatagggaaacgctggggcagtaatattttatatagtttcaaaacgtgttatgatgtagataaatttagtactctttcttaccttgtaaactttgccaaagcctccccttccaagtagattggactcacagaaattatctgttgcagccacaatatctccaaagctaataaatggaaatttcacattttcacctccaagttcattggaggtgcccggatattctagcatcagtctcttttggatttccttgttttgtttccctgataaagttcaacacatgagatttttacaatatacttaagaaggtaccatctggaggcactatacaattttagtgtaaattcccggtatctctatagtgtcgaggcaccagtgctatctcaagaaccgtaagtcattgtcaatgcatttatctttcaaattacgaagtagctttacatttggaagacaaggccttatatcatctacctctgtgcttgcatatccaggtaaggactatgcatgtgagtagcagcatgcatactgttatcggaacaacaatcttcagtaacctgtttttctttccaactgcagaaatgtacacctcagatgttagtgttatggcatggagcataacttggaaagttaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgctgtcaagtgtgaggcgtgtgtagatggagctgtcggagacagtgtatgagtagtagagcttgttccctgagtcgatgagtgtttgatacatgaataagctgctgttactcggatactgggcgccggacaccgtcacgctggttctgacgccgttacggcagtatggcttggtcccgttccaggtcatgccctggaggtccgagctggggtcgaggctgaaggagaaatctccagtggatgggtcatcatggctcctccacgcagtgaggcgtccgatgatctcggacttgtagctcatcaagaacatcatgcctgcgaggatggtatcagtcgggtgatcgaagctttgccatatgtcggtgccgtttggcaaccggagaacgaagttccccgtgtcgagcagcacggcggaggctccggtgacgctgatcttggttgtccaaagaatggtgccttgggagtccgacagcaccatgcctgagctgttggtgatggcaagggtcgctgacgaaggggtggtgattgggttgtcgcggttggcaacccacacaacggtgcgctgggggatgttgtggaaccagactccaacatagaggctattgctgaagttggccggggggaagaagccgagggcaaagatgccgcccttggagatgagcatctcgctgggaaagattggctttcccagtgtcagctggtcatcggttttgcatagaggaatcgagagcagcaggaggaacatgagaaaatagaccatattgcctgttagactttctgcttcgtttgcttgtcatgggtcaagttatatctttcattcataatgcagatatggactggtgtagttggagttcaattcccttgctgtcacctcatctgaagatcaggagaaatgtgagatggctaagtcctgattcagactcatggacagagacagtaaaggaccctgtctgaattctgatgaccaggtcacctggtcatgatactccaagtcgtgtgacaatgctgcacgaaaacgaaagaatgctgctgccatggactttggagtgataggctagtgcaggcaaaagcgaaacctcacgtgcgttccatggctccacgtggtgtcacaggcccttgatgctgccactctccatttgaagaagtacaataggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataattgagtccacaaatttctctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatatgtgtcagacttgacagagaagatgccttccattgcatattcaggagacatgtaaccactgtttgaatcgtgccaccaataacaagaagtgtgggtaatttgaaagtatccaagtatataaaatttagtattttaatcataagtagtgcaagagttactcactatgtcccgactacatgtttagtgtttgcttgatgctggttgccaccaaagatccttgccataccaaaatctgatattttggggctcatctcctcatccaataaaatattgctggctttgagatctctgtgaattactctcattcttgaatcttggtggagataaacaagacctctggctactcctttgattatgttgaaccttgtttgccaatcaagtataggcttttttgaatcatctaccatgaacagtatgaaacaagacttaaagttgttcaggcacctctcccaccaaaagtgataaagggaaaatgaatatatgattaggcgtaccaaaaagaaagtaatccaagcttttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacttccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtaacggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatc

SEQ ID NO: 22113 - DNA, 3478 bp, Oryza sativa
  unsure (1)..(3478): unsure at all n locations
nnnnnnnnnnnnnnnnnnnnnnnnnnnnnnnnnnnnnnnnnnnnnnnnnnnnnnnnnnnnnnnnnnnnnnnncatgtgaagatttgaaaattttcgcattaatatttaaaatttcaagtcagatttaaaaattttcaaataaggatttttaacttttaactcaagatttaaaactttcaaatcaaattcgataacttttaaccatgatttgaaaaaaaataaatctatatttgaaaatttcaactcagaattgaaactttcatttcaaaatttaaaactttcaactcaaattcaaaacttccaaatgaaattgaagatgaaagattcaatttctaaaataaaaaattcgcaaaaaaatagccaaaaaaaagcgcatgagggcgccgcgtaagctttccttcccgttcactcccaggctctcggcgcatggtcgcccattcccgatcccctccctcgcgagaaaattgcatatgtaccactcgtaaaaactggcttcgctataatgccattctcaagataggattcgcccaaacgccactcttaacacgtgggtattcgctggaatgccactttcgggcttttttccatttcgaaaatacttttcatcaatttcaatttttcttggactattatgcccctgagtcaactgattcagtcggactctttcttctcttcgtttcaatctagcgaccgaacgcgagaagtcgagaagagaagcggcagcgacaccggcgccgcccaccaccactgcatcgccgccgcggcgtgcctcaccggtcccgccccccaacagctgcgccgccgcctcttcccggtgagtctcctccccagccgccgcctatcctcagcgaaaccctaggcaccgagccggccgcatcgacgcgtacggccgtgctgtgtccgccggtgaggtgctggcggcgcaccccaaccacgtgcttagccggcagtgctcgtcgcagcagggggcgatgggccggatacacatcgtgtcgccggagtcgaagctggagtgcggcgagatctacttcctcatcccggccgcctccgtccccgacgccaagagaaggacgagcaccggcggcgccgccggccacgggcaccacgtccgcagcaagtcggagggcaacgccgccgtcgccgattggttgggcagccagtgcagcgcgtcgccggagacgacaaggatgatgagggtgcagaagcaacaccaccaccaacaccggcggcgcatgagcaccgggagccatgcctcgccgtggcagccgcacctctcgtgcatcactgaggacccctgagcttagctttcatttttttttcttctcttctctgaattcatagtggtttttttgcctcctgtgtaatttcctctggtgcctggtaaatatttttgttcacattttgtgtcaatgatgtgccgattttacattctgaaatcaacaactgtgtataattttcaagcacaaagcgacttctattctagtagtatcttcttgtatgttcgaaaaacattttgcaacttctttttaaagttcgtttgggttaaccaaagcgaacgaacttgctcatacaaaattaaacaagtcggcagctctgcttgatgcgaaattaaatgaaaattaaaccgcttgcaagttatatatatgaactcatgaattgaggttgtatgtcatggactcatggtgtatgtcaccgaggaggcggcacaattgcgcggactaggacgagcggcacagctggggaggacctcggcgcggcggctggagctgaagtagcggtggcgcagtggtggtgggcggcgccggtgtcgctgccgattctcttctcaccttctcacgctcgctagattgaaccgaggagaagaaagagtctcaggggcataatagtctgagaaaaattgaaattgatgaaaaatattttcgaaatggaagaaaacctgaagtggcatttcagcgaatacccatatattatgagtggcgtttgggcaaatcccatcttgagaatgatattatagcgaagccagtttttaatgagtagtacatatgcaattttctcctccctcgcgggctcgcggcccacctcggcctgctagctttctagcgcgcgcgatgggctgcccctgcctgctcggcatcagccccaatgaacacggtgcacagggatagtcacacgacacggcgcgattgcagtagcactgtacctaccgtccgtcccatctctcgatcggcttatggacaacgtgtatgacgcacggccgtattaacgtcagttggatgccgatggacggccatgaatccatcggtccagacgcacgcatgctcctttgactctaccagctacgcataccattgctgagagcgtgatatgacgatcttgttgtccactccatattgacactttaacccagctgacgtgcgtaatcgacgctccgactcaggacctgtttagattcatgggttacttttcagtcctctttcaaatagctgcaaataatctaaaagttataaataggtgagctatttcagggctatttgaaaataacacatccaaaaaaactatcccccttaagaatactaattagggctatttcaggtggggcccactaaaaaatgtcttttctctttatctctctccatgagaaagtgcattaaagattaaatagctcttaaaataacccttggatctaaacaacttgagactattttattggatggctatttttttcttaaaaattagtagtttttaaaataactcttagctaattctctatacatgtctcaatcaaccacccaactcgcaccgcaccggttttattttacaataaggtgatattctggatatagtgcatgatgtcagcatgtttcttttcggtagtacttaaaaaaaatcttactgataagcacgccagaccacctcactagacaaattgaactcttcccaaagtacagcaacaaacataaattcctcgtcctcttcgtctcatctgggctggtgggttgttgtagcgaccgatcgacgacgacgatgtcggcggtcgagaggaagacggcgtgcgtcaccggcggcaacgggtacatcgcttctgcgctcatcaagatgctgttggagaagggatatgctgtcaacacgacggtcagaaaccccggtaagattctcctccttttttcactctctagttcgtgttttttactttttttgcagtgtttcttccattcatatgatcatatcctcggcctgctagtaccatatgagctaattagcgagtgttttcgcttaaccactcattagcaaatggcaggcttagccgcacatgtggacaatatcatatctttcgaaagggagaagttgtcaaatcttatccttttccaacttccaaccgatagttacatatatatatcgtgacatatgatggatcaaaatatgatgcgactttatcaatacgatggtgtgaattttcagagtttcagtttcgtctctg

SEQ ID NO: 22114 - DNA, 7638 bp, Oryza sativa
cttgacattttcacatctccatcttatccataaattcaagaaaacttttaccgtacaatatatactaatatatgctactactagtatgtgctgccagtacaaacaattcaaagatttttatgaatatttccttgtgctttaatatattatagtataaaattaaagggggtaaaattgtctttccatactattggatgagggtaattatgtaaactcacaacttatagcgaaatactccctccgttaaaaaaaaatctcgtaacatcctagaagtgtctagattcgttttactagaatagtaggatgtgtcataagaggttgagttatttaaggacagagggagtagagataggcattattttcaccaccatgagacactgcgctgttgcaaactagaatgaaaattactaaaataccatttttaatttgataaaaattcttaaaatactcagtatattggaccgaaaagttctttaaatttaccaacgaaaataagcttgcacccaattggcaatggcatttgcgtttgcaggcgtacagtgtgtccaaggtgcttttggagaaggccgcatgcaagttcgcggaggagaacaacatgagcctcgtcaccgtgttcccggtgttcaccttgggcgcagcgccggcgccggtggcgaggacgagcgtccccggcatcctctccttgctatccggtgagctagaagcaccagcaacagcaatcaaatcaacaagctagctcccacaaagggcctgtttggggggagcttctagctgctgcagtatattctagaattagaagttgctctaaacagttcagcttttgatttagattataagaagatataattgtaaaatccaaaaaatgaagctgggaaacacaatttttccagattgtaatcttaaaactccaaacagaccccaagtctcaacactctttgcaacgcgtgttacacagtttaagttggctgctgtttttttactactacttctcaggtgatgagacgcatctcgaagtcctgaagcccctgcagtgggtcaccggctccgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttgaccaacttggaaatccaaaatagataaatattgttgtgttcgatctgacgagcgagtgatcgtctctgtatctttgcagcttcgacgggatgcctgagaaaccgagagtctgctgttcgtcggagaagctgatcagggaagggttcgagttcaagtacacgaatatgggcgacatactcgatgaccttgtagagtacggcagggccctgggaattctaccacattgaacgaatagctgatgctgctctaccttcaacctagctgtcacgaggaccgaactggagtatgcgcttgcgaaataagtgatcagtgtttttaaagaaaaaaaaatagtacagtgttttaagatgagcctaatacacagtggataatggcaatgaagtttaatacccttagagcatatccttcgttcttgcatgtcatttatatattttttataaaaaaatttaacaagaatcatttggttgatacgtaagaaattaggggatgtccattttgagggacctaaggctccgttcgttggtctgttagggatgccacttgtttttttagccgcttcataaactgttaaaagatgtatattatggacatgtttttaagtttctttaaaaaatctaataaaaccatttggcatatttatagtagttaatactacatccatttcatattataaatcattttgaactttttttgtcaaacattttcagtaaaaggtttgactaagtttatagaaaaaattagcaacatttacaacacaaaatttatttcattaaacactacattaaatatatttcattaaacacgaccgtgcctgggccgtgccgcccggatggccatctatacatccggtcatagatttggtttttatttgtagtactcgtcaacaactagcatgtgtcacattcgatacttggttgattttttatgagacgaaaggagtactcctcaatcagatatcaaccaaacaaccacccactttcatatcaactgaacagttctgtaaggacagttccgtaaatggtccatccttctttccatagatggtccaaccccgcacatagtgttgcatcctcgtcctaaaataatttgaaatgtttggatcagggactaaaactttaagccatgtcacatcggatgtttggacactaattagaagtaccagaacattagtgtgccggttggcacactttctttatagcccgatacattgtttagcgtgtgtttgaaacatgaaaattttgtaagatatttttagcatttcgttcaacttctatgttccattaaatattgtattctcttgcatatcgttctgagcataatctcctgtaatgttaatttgggattgtgtgttctctatgtttctggtggacgattaattatagatgttgagtttctaacaaatttttgatataattaaatactataaagtattaagaaagtagaaagtaggtggagttaaataatagaaggttctctgaaaaaaatattagaagattaatatttttttaaaaaaaggagtgattgtaataaaaaaaagttacagaaaatcgtaaacttacaaagcttgctctcaataatccataatactcttgatgtccacaaatattaggtggaaggatccaactcctaaatgctagaagtagaatttgaagttaagtagtggcctattgacggtctttgtgttcactccacccctcatttttctaggtcactatagtctgctccactctcttttttatagagcagaaaaaactttgttgagctttagctacagaaaagctggaaggtcctgccaaattgagcactgcgtgtcgtatcactcacctcttgatttaattttcttcatgtcttacttctaaccattctgtcatttttcaactatattttatttaataaatggcattatagttttttcactccatacttatctctctaagaaaaagattgggaatattttatattagtggaggaagtacacttggttcataagatacgatggtaactggaaactgaaaaaaggaggaattgaaatggtcaattgacttggtgctacacggtgatacgatagctgaggaccctgttgctcatattttttattggatttccctttttttttttaataattctgagttttcttctatcggatatttgaatgcctctaggagtgatgttgttgcaaaggactataatctagatgtataagtctatggatctagatactttaactagacttatcttaaattatgatttatatttgagtggttctagaaagtctctatgtttattgcgaagtgatgtacagttagaagcttctggaagctgatttttttttttaccgggtgggaacagctagatgttctggatgctgtgttgttaaggtacaactttttcttaaaagaaactgctaaggtactacttgcttttagaattatcacataacactgtagttttctattttgcttgatcttctgtatttttttccttagacaaaattcatgatttatttgataagctaggggcgccacgtggcccaatcaaaagctggcataaccactggctttagattaatagatagattaaacgtagactaatgacaaaactcattacataaccctggactaattcgtgagatgaatctattgagcctaattaatccatgattagtctatgtgatgctatagtaaacatgtgctaattatgaattgattaggcttaaaaaatgtctcgtgaattaactctcatttatgcaattagtcttgtaattattctatgtttaatactctaaattagcatccaaatatccaatgtgacatggaataaagtttactccctgaatacaaacatacctttgcatctaaataacaaagatttcttattggtgacaactgacaagcatatcctatcagatgaacgtcagtgacagtgactgtactcttgtactcttacaaccgccgtcttcattccagtaagctatttctctcaggaggacgtagtggagcctggaggggacgaagtagccggcggcacggcgatgtcagcggttgggatgaagacggcgtgcgtgaccggcgggaacgggtatatcgcttcggcgctcatcaagatgctgcttcagaagggatatgctgtcaacacgacagtcagaaaccctggtgagattcttcccccttttttgttgttcatgatttcagttacaggctgtgattagtttcatgccaaaattagaagttcaatgaaattagaacgatgtaatgaaaaagttagaaatttatgtatgtaggaaagttcgatgtgacgaaaaagttgaaagtttaaagaagaaaaatgaaatctaaacagggccacagtctttctcccattcagattcaaaaatcttttggtcagaggtagtttatttgctgaactgtcgtcatgaacaatagaaaaagttcttctatctgcaccatatagaaaatctttatatgttccaactgatatagtgacatatgctggaaacgatggatgcaaatctttatgatctcaattctcaagacaacgctacgaattttcagagttcagtttcacatctgacgatcctactcttgtgtattcagatgacatgaggaagaattcccatctcaaggggttggaggcactaggcaccttgaaggtcttccgtgccgaccttgacgaagatggcagcttcgatgaagccgtcaacggctgcgattacgccttcctcgtcgccgctccggtgaatctccagtcagagaatcctgaggtgaacagctagcttagctaattaatccggttttctctaatcgacgtcacagttgacagttgtcttgtgtcatctgatgataagcatgctctttagtctctagtactgaaattaatttgctcttaacttctacgatgacaaattaagctgggtttcctgccaacgtttgatggcagaaagagatgattgaagccggcgtccaaggaaccctgaacgtgatgagatcgtgcctgagagccggcacggtgaagcgcgtgattctgacatcgtcggcggccgccgtcgccctccgtccgctgcaaggcggcgtcggccatgtcctggacgagtcgtcctggtccgacgtcgactacctgacgagagagaagccaccatcttgggtcacattctactcctttcttttttggtcctccatcaaatcattcatatacattttttaccgggctgatgaaaatgacggctggctgatgctagcacaccccattgtttttgcgtttgcgttttgcaggcgtatggtgtctcgaaggtgcttttggagaaggcggcgtgcaaattcgcggaggagaacgacatcagcctcatcaccgtgctcccggtgttcaccttgggcgcggcgccgacgccgttgaccacaacaagcatcccaactacgctctccttgctgtctggtgagagcctgagaaacatacgtcaaatttaagaagctactcttttatttgttcagattcaagatatatcacattttatatttgatttgtttattttagaattaagagagtatgtacttccattatgtgttacgattgacgttgtttctttttcaggtgatgaggcgcagctaaaaaccctgaaaggcctggcggccaccggctccattccggtggttcacgtggacgacgtctgccgcgccgagatattcctcgcggagaaggagtcggcgtcggggaggtacatctgcagcagcctcagcaccaccgtgatggcgctcgcacgtttcgcggcagcaaaataccctcagtacaacgtccaaaccgactggtacatatacacgaactggcactttcagtttcaactttcaagtgactgatcgatcgacacatgcatttcttgagagaacctgatgagccagcgataatctttgtttgctcgtagtttcgaagggttccctgagaagccgagagtgtgctattcgtcggagaagctgacgagggaagggttcgagttcaagtggacggatctggacgagatattcggcgacctcgtcgagtacggcaaggccctggggattctaccgcactgaattgatggttgctccgtcaatttggagttttggacataaaaattctcttgtgaaattgttagtcctcttgtcttgtgaaataagtcattgttgtgtgttacggtatggtaatctctttatgatacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctggatccaattaaccattattgttatgggctctctaacccgtaaacaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctgggagatctacttaactccagtgcaggtccaaaactcgccttcggatgtgtgagcgtgtcagttgatttgatcctgcaatcaacaagaaataaagacaaaagaaccgtggttaaatctataaatgatagccgatcggccagatgccgatgacatatcatttatatccgagccgatgtcatctgtgtatcgatcggcaatcgtgaatgagtaaggaaaaactaaatctacttgatcggctgtagatattaacgatatataattcttatgtcgatgtatacttaaatcaggttgtcggtgacatgggatcgggagtatcatgactagaggtttgaggcagacacaatcgcccacgtggcctggcaccctcgggggacgtcgggcccgagggtgatgtgttcgccctcctcttagtccccccgatggggtcgggctgcacccccctcggccccgagggccgaggcgccccgacccctcgtgggttttcgctccgcgtgtatgggttaag

SEQ ID NO: 22115 - DNA, 47870 bp, Oryza sativa
gagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctacgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcggcagccgctgttcgccgttcggccgtcactccttcgtcgactccttcgacccgggaagatctgcgtggggagcaggacgcccgcaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgacggcagcatcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggcaatcggcgaagtgaggccaagaagaaggcccccgccgaggacatcgacgacggcgatgatgacctaggtttccaagagcctggggccaccattgccactgtcgatggaggagcgtgtgctcacatttctcgccggagcctcaaggccatgaagcgagagcttctggccgcggcccctactcatgaggcgacgcgccgggcgcggtggtcggaggttgccctaactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacccgccaatttccgcacggagcgagtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccagtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtcgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaatgaacccttgctactctacttagcggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggaggagaggcccccgagcagaacggtggcccaaggctcccgacgaccggagatggccctctgcccgcttgtccgacgacgccaggggcccccgacccccaggacggccccgaagccactgtgggaaggccgcccccgtcgtcctccgaccccgaggtcgtcggcacagaagacgagtgcgccccgcgaggccgctcgggtgaagagcgccccagggatgcggcccctagcgaaaaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccaccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaaacacggcgattcatggatcgaggagttgccagcggtgctctaggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagctttgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgtccaaacgcgtgctagattgagcaagctctcaccaatgtgggagggtccgtatcgagtgatcggcgtcccccggccgggctccatacggctggccatgggcgacggcactgagttgcctaacccatggaacatcgagcaccttcgtcgcttctacccctgaggggggggtcgggtgtcaggtttcgggctcgggccaaccccgtaccccccccctcgggtgtgcatggttggccgggggctaccacacatgcacattctcttttctcttatttcagtatttcaataaaagcagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacagatcatcctcatctcatttgtatagcaaagtaaaattaacacaaaaattttcatcatttttgattgcagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttgacggtcttctcgagctcctcggggagctgctggagagccccggccatcttcgagaggtgctgagcgaggcctccctggttggtggagtacttcattgtctggcctttccagaggcccgcctgccgaccggcgcgatccagatgggagactgcatcccaaagcatgccgggccctatctcgcccgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgtcaaccgttgcgccgcggcctcggcctcttcgagagctcgctcccgctcggtaagcgcgtcctcgcggaggcggagtgcagactcctcttcggcgcaggcagactcgtgcgccgccagcgttgcctcccggatggcgacggcggcctcgcggtccgccaggtccttctccacgacgcaggcgcgctcttccagcgccatggcacgcgcctcaagggcctcttcacgccgccggagcgccgtttcggtctccgttgctcgctgctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccacctcttgagcgatctccgccagcgccgtcttacgggcttcaagatctgagacgtgccggcggtgtgccttgcggcccgcttccaccatggcctccaccgatcgccgcccctcctcgacacgcgcccatgcggcgtcgagctccgcacgctccgcctgcagggcctccacctgggcacttaacccatccaacaccgcggtgtttgcggcggctaaggcctgcagaaggggctctgcgctcagcggggcgacggaaggcgtggggaagagctgccttggagaagatgtcgcgcggctcggcccgccaatggacgtgccggactcggggatgttccccggacctgtttggtcctgggcgtcgcccgaaggagtgggcccaggcgacgcgcccgcagcctcgtcgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcggcctcccgggcggcctcttcagcttcccgtaggcgatctgcggcctctcgccggtcagattctcgcctccgtgcctctgcggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccacgatgagtgagagatgaacctgcgagggggtcggttgaacgaccactttggaggggagatgaggtttccccgagatggttctgtctcccccatcttgcggagccgtttcttcttgcgctccccctcgggctgtgatgttggcgcggccccctccgggcgcctgctgctggcacgcactgccccgccccctcggggaggagatgggggaggtgttcgtcccagcttcctcttcccccggtcgtcgatagggcggttgctccccgagcccctgacgcggggcccagaagcacgaccccctcctggggtagattgatcccccttgcggctcccgcctgcgccgtcgtggccctttggagctccctcctctgaggccccgactgccgtcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcgccatacaccatggcccctgtgagcccctgggatcgcaggcccgccaggcggtcgaggacagcgtcatagccatcccccagatctaccggcgcccgccaactggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtaaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatagcggaaccagccctgccattgcaaaagggagaaagaagacggaccgccccgggtagtctgtgtcgcgaccgggaaaattgccttttcccgaacgccagtgtattaatccccgtcccaggaaaagccggggtacaccacacaaacatggtataaaagacacatctttattatatcgataatatttacattattacaaaggcacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgtgattcaatatgctcaaggatgatgtgacttgccttgctcgctttcccaaacaccggcttcaacttccacgaagagcggatcttccgaagctgcagcgtctacacgactaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagcgaaaggggcggtccacggttcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgagcggcggaaacggaggagagaggcacggggaacaattatatagcgccgggagggagagagagaggccggaggggaaggaaacggccgcggcgatctcgggcgccattgatgccggcgaggtttaggggaaagattccgagcgaatccgagggagagagagagggaaaagcggggggaaacggagagggaatcacggggagtgatttccccctctttaatgcgcgcggggatggcgggatgcggcggaatccgcggcggcggcggcgctagggcacgggcgggcggcgggagcggcgcgaggaaggcgatgacaggtgggccccacccgtcagcgagggtggcgggcgggcccgcctgtcagcggcgtgcgcgcgggggaggggccgagtgggccgcggggaggagagagagggaaagagcgaggtgggccgagccggcccaagagaggaagggggggaaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggacgagggcttctaggcgctcgtccccagctggagctagcgtgttacctcccagagatggcacgttagccctgatcagatatatgccaggcttcatcctaaccattacaagcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaagggaagaggaaaaaagcaaaaaaaaaaaaaagttaactaaagcttaggaagtactacggcggctaaacgcgaactcctaacagcgggaaggggcatagccacgctacactcccaaaaaatccccaaaagtggcaccacagatgaccctccgagaggatggattccagacacagggactgaagagagcaccgagtcaaaaacccagaagtccgttccttccacggctgccaagagaccagagcaccagggtcttgaggatgaatagaattttcccttctacttagcaaatgccaaatgccactcttacctgcaccatgtagaaaatattttttttagataatgtagaaaatatttacatgttcaaaccgatagtcgcacttaattcatatagtgaaatatgctggaaaggatgcaaatcgttatgatctcaattctcaagacgacgctactacgagtttccaagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctcgccggcggagccggcggtggcggtggaggcgaggtgaaacggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccgccggggacggccggtgcggcgaccgctgcgccggcgccggcgccgccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccggatgcagattgtgtctcgcagaaatttccttccttgtttctcagcgcatgtttaaatagctgttattttcaagctttttgtttggattggccagaacaagatatactttcgaatcttttgactggtactagcatctccctgcctgacaccggtatctttggaattttggatggggactggaagccaagatgtgagatcaataaatcatttgaatcgcattatatcggttactacataatcaccaaaatcaagcttgtcgaatcctggtagtgatcaatagctcctaaccttttttttttagaactactaatagctacttcaccatgtctgtttcggcggtggcattaaccagtcaagatcgccggcgctggtggcccatttgggcctaattttcatcatcaacgtaggctagttattaggctgggccttggcccagtagctgacacagtcgatgggccagttttcctttcctttttgatttggtgacagaagtaattgtagctgagttccacaaagaaaaagaaaaaaaaaagaagtagaaataattttagctgtgttgtcttggcaggcgccggcgtgttcggacacctatcggattcgttcctcggtcggaagggctcgctgcaggtggtctgcgtcctcaatggcgtcttcggcatgctcaccgcgatggcgcccaactactgggcgtacgccgcgctgcgcctcctcaccggcttcagcgccggcagcgtcggcctctgctccttcgtcctcgccaccgagcccgtcggcccctcccgacgcggcgccgcggggatgtccaccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgtcgtgcgcgccatcgcgtccagcaatggcaggagcattcctgacgacgtgtccctcaagctcgacgacgagggagacgacgacacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgctgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatatcaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctgtgtttagatgtaaagtttggatccaaactttttcatcacatcaacctgtcatacacacacaacttttcagtcacatcatcttcaatttcaaccaaaatccaaactttgcgctgaactaaacacagccttagttctaaagttttttttctaaactttcaactttcgatcacatcaaacattttatacacacacaacttttcaatcacatcgtaccaatttcaaccaacttccaaatttcagtgtgaactaaacatagtcttatacagctgttagcacactagtaacagtaccacacaaaatgatattcccccattacattttaagtgcagtcataagtttctgtgttcaactttgatcctctgtcttatttaacctttttttgtaatgagtatgtccatattcatagtcatataatgggtctcatcccatcctatgctgctacattttgggacggagggagtatttttattatttttagatgataaaatataaataatacttttatgtatgacttatgttctttaattttttaaaaagtattttaaataagatatatgatcaaagatgcacacaagaacttatgactacgcttaaaatgggacagagggagcacgtaacaattttagtgcggcagtgctaatgttgacaagagtactccttacattccaaattaaactaatttagaatgagatacgagtatgagatagtatgacacacaattttactactactccccttgtctcaaaataagttaaataagatttgatccattttaatactaaaaaatccaaaggtttcaatttttaaaaggaaaacatttagaaatcctttaaacgccctaaacgttgtctctaccatcaacggtacaatttttaaatttgaaaacaaaaatcaaacacttgagacctgacagctggagagggggtccagcagcaggagaggtttgcggttttcacttcgaaaagttgcggattgaaaagatgagtccaaactcccaaaacttttgcttttccacggacgggacacgggagacggggagagtactcgcgttgtacacgggagaaaagcataattattgcaggttcagtgggtgatgtcactattatccgctgtaaaggaatgtccccacattcagtaaatatctttactggagtacagtaaaggttataaggaaaatactacagaatggtaaaccgttcggacgaaatgagtgtatccaataattatcggttgatattctgtttggacaaaagcttgatacctaatatcagctgctatctctgatgtataattccgtttgaattcgaatggaatactgtaatatgctatctccgtcttaaaatataataatttttacatagctaaaaatacttatattttaaaacgaagagagtatcattttccgaaagctaatcacgattgaaatggacaccaggcaagcacgcattggttatgcgcatcctccataccgtaccataccagcatgagccatatatcacctctttccgactgtatcttccttgaagaacaatgcagatttgcgggggatgaaagccagtaagccactgcccactagtcctactaaaatggaagcttagcgtacgattaaactctgatggcgcggtaaaaactgtaacgttaacacgagcggttttgtgacttttgtgtgaactcgacaaggacaaaagattatgcgcatcggctggggcgtcgcgaaagcgaaaggaggaggaggagagagcccgtggaatgatgcgtcatgagtttcgttctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctggccgtcgtggtggtggtggtggcggtggtgtgcgccgccggtgtggcggcggcgggcaagttcgacgacgtggtggagccgagctgggccaacgaccacgtcgtgtacgagggcgacctcctcaagctccgcctcgacagctcgtccggtacgtgttcaactgttcatcgtcttcgccgttgaagtttttgtggtgaatgggtgaagatgttctcgatctgcatttgggggacagatgaccagaatgttttgtgttgtggatgcaggcggcgggttcgcgtcgaagagcaagttcctgtacggcaaggcgaccgccgacctgaagctcgtggcgggggattccgccggagttgtcactgctttctatgtgagtgagtgcatcaggctgtgctctgtgcttcgctacgctttcctccatctgcttcgaacctgccattattgattcttcatcctgcattagcttaaacaagattaactggggtaaatgacaccattagtagtatgcactactgtagtaaatacagtacaaacgtttttcgaggcagtgttggggacatgcttgaccatgtctgtcgggggaagctgccaagaatcaatttacaaagaacagcggcacgtgaactcgtgcagcaataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaacctgtacatcgacggcgtcggcaaccgggagcagcgcatcgacctgtggttcgaccccaccgccgacttccacacctacgccgtgctctggaaccccagccaggtcgtcttcctcgtcgacgacacccccatccgcgtctacgagaacaagaacgccaccgccgccgtcaagggccaccaccgccacgccgccgccgccaatggcaccagcaacgccacatcggcggcggcgtccgtgccgccgttcccgtcgccgcagccgatgtcggtgtacagctccatctggaacgcggacgactgggcgacgcagggcgggcgggtgaagacggactggtcgcacgcgccgttcgtggccacgttccgcgacgtccgcgtcgagggttgcgcgtgggcggcgaacgccacggactcgaacgccggcgaggtggcgcggtgcacggggagctcgtggggcaaggaggggaggtactggtggaaggagaaggacatggaggagctcaccgtgcaccagaaccaccagctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatctacggatgaaaacggccagaaaacgtttcaatcgtatccatcactatattttctcgaagacggaattcaaaacataaatactggaaagaaaacggtatcgaaaatataaaaaaaaacaactgatactacggatgattatcaacggaaaaccggtaagaaatatcagaaacattgaccataaaaatcacaattcaatttgcatagctatatgttctgatgaaataaaatcaaagttacactatgtaaattacaatttgtctttctttcaacaatagattaggggtttgattgatgaattgacgatactatagactatgggttgagtaaagaattagatcatatatatgatggcgcatttagaaacagtaaaatataacagcaaaattgtttccgttttcatttttgtcggtaaccctttccatataactcgaccagtaaaataaaaggaattgctaactggctacctgctgatctaccctataattcaccaacttgttttactcatctttcactcttacactcttacattcatcactcaacggttgagatcatccctgtgaaatccaacgctccatgtcatctccacctcccacctcgcaccataaccccaacccgactcccgtcttccacgcgattcttcctcccctttccttcccgtcttccacgctacagattgcgcctcctcaattcctcattgtctcgcgaatttttgcgcctaggtcgccctcactcgaagcgacgacaccctcgtttccctctctgcccaccatgccacgtgcaagtcctttgccgatgaccatggagagaccgtcaaaatctgttggtcgccgtcaccgatacagccgatagcgcctcctttccctattgatctgttgctagagaatggggcgagggtcaagcgcaatgcccaagcccagactccaacccaacccacaaatcgtttgcacccttctgcaccgatcgccgtaaccggtcggctgccataagcggttctctgtctacccaactcgccggtcaatagatcgcaacgccccaccacatttcgtccctggtcggctgctgcttgctcttccactaatttgatcttgcaatttcaaaatcataatgcttcagcagtggaatttgcggataaggtcaggtacatttatctcaaatttacctgattcttgatgttgcatgcaaaatttcctagccgcccgggttgccatagatgagacttgtggcgttctttttgttgatatgtctgcaaatgggatagcttaaccaaattatggagttgtggcactttactaaagtctgaatgtacatttcatttgtattatggggtataggccaacaacttttaatatgagcttttgctgtaatcttgatttaattcgttgatatgctgagggatcgtggcatccttcccattacatgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcagtcttcaggaagtgttgagttctgtgtgagtaaatgagtatgtaagtaggggagaagcactgcaagtagtgatttgtctatggcatatatcatcatgatctgctccttgtataaagagcttcagaattcagattaatttttttagagaaataattcagattaatttcacaaactagattgatcagggttttgccgaaccttgtctatcttaacttagtgcaaatatcagtttgtcaaatcactgttcacgtttttttttcccatgtggatatgcatttgcaaataagtacgtagcagtattttggagaccttgatttggatgtaatatatatgtgtttcttgttttataatttaggtcttcttaattcatagattgccttgtacctcttgatgggtggctatcaaagctctattagtctaaaacaatagtattaatcttactttgatactttaatgtttgatatgccctttctgtaagttgttcatgggtccttgcaaaagaaacaaatgctcattgctgtctagattagtttctagaaattcgatttggaccaggtatgtccaacagaatgagattcggattttcttttggcgtactatatatggctgcaagttcgggtgcgatcgtctgaataactgaatgtactgcaaattgcaaaactagctcattaacttggatcatttaccaatttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggtataacagcgtaaccacaatcgttacttgcaacttttgatgaatgagaatagagcatttcgttatttctgaacaaatatattactgcctccgttttaggttataagattttctagcattgcccacattgatatatatatgttaatgtgtgtctagattcattaacatatatattgtaaagagaataggagagaacaccactctccccaatgaggggggtgaccatatattatagtctttccaatatacaagatccttagaggagtatacaaggaagctaaggatacaaaagaatcctatacatatatggctatacattcctaatgcccgcccgcagtcacaacaggaggatcacgaatgcaaagattggacctgaaatcagtgaacaactgcacaagcagccccttggtcatgatatcggtgaactgatgggacgacggtacatggagcacatggacctgtcttagagccaccttctcccgaacgaagtgaatgtcgatctcaatgtgcttcgtacgacgatgatgcaccggattggccgtcatgtagacagcgctgacgttgtcaccgtaaacaacggttgcagaggcgatgggagcatgaagctcctggagaagctgtcgaagccagcagcattcggcgacggcgtgagcaacagcgcggtactcagcctccgcgctagaccgggagacagtcgtctgacgcttggaagaccaagagatcggattgtcgccgaggaagacgtagtatccggaggtggagcgccgggagtcgggacagctggcccagtcggcattagaataagccgtcagagacttgacagggccggtgctgatgtggagtccggtggagagagcctttgacgtaagcgcagaatgcacttgaccaaggcaaggtggggctcccgtggatcatgcatgaagaggcagacttactgaacagcataggcgagctctggccgagtgagagtgaggtactgcagagtgcctgcaaggctcctgtactcggtcggatccttgacgggggcgccgtcggaggcggaaagcttggcccgagcatcaaccggggtggcggtggggtggcattcagacatgccggctcgctgaagaagatcgacggcgtactgtcgctgggacaggaagaggccaacggaggagcgacggacggaggttctctatcaaatatgatatttccaaaaatagccatacatatttttaaacctttcttaaatgctggatagagaattgtgatacaaatggtgattattgatgaaaaaaatagaaaacctttaattgatatttgtttatgcatgtagaagtagaaaaataatagtgaacagattacttctcttgattgcgacttgaactttcatactgagagctactccggtttgtgataataatatttaaataaatttgacctcgaaatagtaaaataatttttaagtagaaaatttgctagatatcgccgtagcgttagcatgggcaaattactagtttattttggttggttaagaatttctgtaactgtttttaccactaaccatgtttccactttctacggctccatggtgtagccgaaggcctgggttcattttaggaaggaaggcccagcagcccagtacatgacaaccatgtgcacagacctagagtttgagacaatacaaaacaaaacatgggagggcgtcatttgccaaacatagtaccacctcggaagtcttcaagaaatgaatctagcttaaaatgcaaaacctttgaccgctaagcacgaccttacttgaacaggatctgttctataggctcgtaccgttgcatccttgactaataaggaggcaagcactcaagcttggttgatgacgcatgacctgtgggccagagcgtgattgacggcccggatcatttccgtgtgaattgatcccgcggctgtagaggatcgttccttgccgggctttcgcttggtcagggttggcccataggttgtctgacaggcatcattttttttttcagttatcttcaccactccattaattaggccgttttttcaatatttaggagaagcctgaattactaacagtaaaatctttgacaagcccaagtcatccgcatgacaatccaaacagtaatttgtagatttttgtaatcatagtgtgttattatccttcatcaattgatacttctgctgctcacattgatcattcatcaattgatacttctgctgctcacattgatcatttggactacctcgtaataaatggaaatccaagttcatgctacggagcattggactgataattaaggtgttttagtcacatcatgcatatacacaacaaatctgaggtacaagatctcaacaacgtactccctccgtctaaaaaagacaaatcctaactagtgaaattaagtgagcatacatagtggtactactaaggctatgtttagatttgacataccacatcgaatatacggacgcatatttaaagtattaaatgtagtataataacaaaataaattacagaattcgccccgagatgaatttattaagtctaataaatcaatcattagcaaatgtttattgtagcaccacattattaaatcatggcgcgattaggcttaaaagattcgtttcgtaatttacacacaatctatgtgattaattattttttcgtttatatttaatactctaagcatgtatccaaacattcgatgtgacattgtgtaaaattttatcaaagggattgccctgaagactgctatgcaggtccagacttggacgaaattaaattacagcatctttcatgattatgtcaaggccctgatcacatcagctgggtcctcagaaacataaacccccatgttaaattgcattatcatcagtttgggcacggatcagtacgacagtacactattggatacaatttccatctactaatgtttacaggtggagtttttaaccacgtgatggctatgtgaaggagtaagataaactgtaggagaaaagcatttcgtagtgggccatgaagcctttcaggacatgtattgcagtatgggccggcccattacgcaattggaggacaacaaagactagtattagtaccacctcggctatccacatagatcaaagctggtttaaaagagttgtgcagatgatccatggcacgaccttacttgaacaggatctgttctataggctcgtaccgttgcatccttgactaataaggaggcaagcactcaagcttggttgatgacgcatgacctgtgggccagagcgtgattaacggccggatcatgtcactggctgattcgatcccacggctgtagaggatcgttccttgccgggcctcgcttggccaggatggctctcaggttgtctgacaggctcccaattttttttttcgttttgcattgagttttctccgtcgcatgtttgcagcgtgttcaaaaagttcgcagctgtatttcacttatttacggcgccacattttcatgccgtttgtgccaactatcccgagctagtgaatacagcttagcttcacacaacaccggtgacccgctgacctgctcgtacctcgtaccgtcgtacggcacagcattgctggaattaagggtgtgatcgatactgcttgctgctgcagcaaccgtggctgcaagagctaaaaatggctgcagcggcagcagctgaaaaacagccacagccatagcggcagcagcagatagcagttccgatcaggccctaaatccaagtcctagctaaacaggatgctccattgaacagccaaaccggcctcacatggtctatccaaggacctgccagttagccacgaaatatttcgtgaaaagccagctgaaggctgaagccctttttgcactgaaatgagtatgcgtgcgggcctgatgatccgtggcattgttgctgcggggacatccatgcactgcagggtaatggaggagctgattgagccatatgtctcgctgcaaaggcttcctcctttcggtggttagcccagagcctctcccagagatcgacccagaccagcatgcagtaatcgaatcccgttcgatgattcgatctactaaattcgcaaaggctgtagcgcgcacatggcgccaacaggcaacagtccgggccatttcgccatgccccgggggatccctctgacgcctcacttgagattccttgaaagttgcgaacacatttgtggttttatcttcacttgtgaaagaagacgtgtcatcgtatgatctctactttcttttcaagaaagtcttctgggtgatcttatgagcactctgactatctgaacgctgcctaataattcacataaagctcgggcgccagttcacagttttcatacctggactactgctactgtgttagtgcagtagtgctatagctaatgatatggggcatccaattagttgggtcctcacctggtcggtccatacatgaacctgacgcccccgtgctgtgctggcttctacgttttcatcaccgaaaatattgcagtcccacacgctctctaggttaaggagcaactggcggcttggtgcatatacagtagtactcttgatcagtgaagacctaggtaacagggtactatagcaggttcctgtgcacaatgatgtgaagcaaaatataaatgcttaatttgtcaacattgtatacaacgcgcgtcaaaggaatcatttcaagaatgatcccatcttctgatgtagtggtgtccaaggctccatatacagctgccccagtgtataatgcatggaaagtacagaactatgtacatctcattgtgcaggaactcgtcacgaaacgcaatcatatatacagtaaaacatttttttttgtgtgtggaagtgccctttctgtgatcatgctgctggtagtgcccaataagctaagcaccaccaagtatattcccattgtcagtagtcaccagggcattcatcaagtcggttgatatatattgtcaggtagggacatcggagctagctagcagcttggccccggccgccggcgaccatcacggccgggatgatccgacgccatcccggctacttttcacagatcatcgcatgcttgccatggacgacaatgcagagaaaatactcttacctgttgctaattaaacgtctaagtcaaacacagaaactgaaaacgaatgtacactaagttttgcctaattagttcttgttgcgatctacgcaatggtttcgtcagcgacgaggaaagaatgcacacaggaaactgatgcaataatccgaaggtgactcgacaagaaattttttttcgcaggacaaaaggaaaaggagagttgtgaaaacgatcgaagtagccgggggtcaaaaagggtttgacccgcccacccaggctatgaatgcgatagacactggcttgacaggcccatcagctggcccggtatacctaacacaatcacgatggggggttggtgggcccagccggtcagcgagacagatagcgaatccgcgggcctttgggctttcgtcagagcccacctgaactgttggcatgtgcagcagttttcggggtccatcgagtgttgactctgctgaagaaagggtaacaaaacagatggagagttttccttggtttcacatacacagagtgagtacatcattaaagtaagtgaattcacaacatagaaatgcattcaattattcatcacaaaacctgttgttttattgcctttaattatggacaggatagtgtttgtttgtttatgacgtaacgggcgcgcaccagtatatattgtcactagacagtgggttttgttaggtaagtagtactgagaatgtagcctcatcattaagagttcaagatcattaacacggcgtacacttgttttgtctcaatagcatgtgttcccactgtgatgagatcagtctcgtgaacaatcccgtgcatatatgggttattaaaagcatcatcagacgtatggttgacctcttgcttggttgggttatctgtccactgtcctaaccacgtgtgttaggcgcagagatcacaagcttgctagatcgatctcacgtacggccacactacattaccatacagttacgccgaaattaaaacaagatgccagatcactcacccaacttagctaagctccaatcgatccgtgcccaacccaaccgtcccggcagctgtcgggacaaactgagtagactccgagcgtgtcgatctaattctaaagtcagagcacactttgacgaacaggttgacccactgcgacccaggaatcaaacagctagtaggaaactagcatttgtctcagcctaatagcccaaagatgccctcgtgtgtcctactgtccttagcccggccgtgtcaacgcccagcctaaaccggccaacacgtcaacgatccgtgtcgcagagcgtgtgcttttcctgacgcgacggatgccggcgctactgctacttcctacccctccgaaaccgacgccgcggccgggttgggtttgggtcttgggtcagcgtcgacgtcgtcgctggcctcgtcggtttcggaggcacgtgttacaggccgggaaccctcgatcgatcgcgcggccgcgcgcacgcacgcgcgtctggtttgctccgcgatgttgcggtgcgcactagccagcggaggactcgtcgcgtgtacaggttgccgtggcgatcgagcgcgcggcgtgcgtgtccacgtacgtacgccgccccgcgcgcacgcgcacgccgccgtgtttcgcacaccggcagccggaccattctagccggcgcgcgggcgcgagcgagcgagcggcaggtcggtcggtttcgggagacctcgtgccctgggtggcacggcagtggcaggggggacagcgtagcgtagcgtagcttgccatctacgactggacgactccaccaacaaaacattagactctataaattaaaatctgtatatatgtttgtggctagcaaaaatggtaaattcgagtataaagttacaggcaggataagtaagtgttcgcaagaggaaattgattgcacgcttctaacacaaaccatgcacgagcatgataataatactatatatttgtagttatgggtcaagctaccatcccaccttgtgctaataaccaatccttcaacgaaaacgcatccaagagatcgatcgagattactactactactactgctgtcatcatctccaggttctgcaaagtgcgaattaccggtgaagtatcactactactcgatcaagtcaggcaggcaggggaggaggaaagagatcaacctctgaacataaactagtaatttcacctctgaaaaaaacacccccagcactcgataggggaaaaaaaacggaatgaatcgaaagttgacctccattccaaaccccaatcattccgatcgggcggtcaaagcttcgtcgatacgtggcagcgacgtcgctggcccccggccacggggagggagggacacggcgtggtgtgtcgctggacgccgcgattcagatttcagaggaggatgctgtccctgtcccgccttttgactcggcgttccgatcgatcgatcggtcgatcggctaagcgagtagtagcagcagcagtggagtgccgtgcgttgttcagagttgcaggtgcatgcgtgcgtgcgtgtgtgcgcgagagagaatgagaacgggtggcgtttgtggtgtgtggcttggcaaggcgggatggagggtgagtgggcggctggctttttccgggcacgcgtgcgacccaatcgggccccgcgcttttgacgccttcgccgccgcagtcataagcgtgacgtcaacgcccggggtcttcattcttcaatcgcttaaactggctactatggctaactaattgcctaagctgtaccgccggtccgccgcccgccgtgtgttgtagcctaggccggccaccgtctgtctagaaaagattctaagattctgtttgaaacatatatattatcatcttttacaatattccaagattttgtttgaaacagattgtcgagtaaattattacgacagattatctatttaattgtaaacatatgttaagtattttgataaatatgtaatttaaaacatatgggcaaagcaatgcattaaaaaatttattccgtagtaaattacaggggtatcatctaagtaatattagctgattatattgacatcgcatgtctattattatcagtcacaaatcgacgagcctagacgactgcataggatcactggccttagttatggtgtagcagaaagtaacttttctttcgcgaatgctcattgcatgtcaatatattagaagagtttttgttatacaactcaatcagtcagacatgcctatggggggagggagaaaaaaacaaaagctacaaccaggtaaaggaaagaaaaaaaaactactacggaaaaggctactccgatcagcgggagggtggaggcagaaccataccacactcctaataagcccccaaaagcagcaacaccagcagaagaccacatacgagtatacgaccctccgagaggatagactccagaactactgagaccgaggagagcgcagagtcgaataccctagagttccactccttccatagctaccaagagacgagaaggaccggggagtcgaagttggcgcgaagatgcttagataagcagaccctagaagacagccactagacctgaagcgagctgtcacggggggagggcaacctagccagagggcgacaacatgtggtgctagatctgtcgagcgaatacacagttgaagagggtgtggttcgccatctcaagattctgtgtgcaaaaggggcaggctgagtgctatcaatatcacgcttctggagaagatcagccgtccagcaacgctgctaaaatgcaaaccagatgaagaatttacgtttaaggagaaagtacattaattatatatctgctgagtactctaaattaccaactagtactcaattatgacttatgcccttgccttcatttcaaaattttaatagtactagcgccgtgtttagttccgaaatatttcttcaaacttccaattttttcatcacatcaaaacttttctacacacataaacttctaacttttctgtcacatcgtttcaatttcaaccaaactttcaattttggcgtgaactcacagctagaacaataaccagtctcttcattcagaggatctctctatgtactacggcgaatacgatggtttcctgaccataagtagaagaataatgtgttgactatgcatgatgggcggatgcacgcttaatttggccatattgcaccgtgccatgcatctaacgtcctgattggatgtatatgtgtgccaggagcgagcggcgaggaaaaacaaaaacgtcgaagagtacaaatacgcattgactgtcgacctgcaggtctgaactctgagagagaatataatacatggacaaaaatccaaaaaggagaaaggcagaatcataagaatccaagacaaatcgccggccgatgcatgcctaacgcgacatgaggggttcttgttcctctatcacaatctgcttttccaaacgaaactgatatgagtacgtatgagattaatttacttctcattaagtttgtaatttgcgaagttatatgctacgactgtacttgggacagaggtgtattgttctttgatttattttgatctgtcactcttctatcttcacttcttacacacatacgcatgttttcaggcaactaatacactactagagaattaatctttgttggatcgctaaaaaacggttcgaataagaaccgggactaagattatctttatagtccctgttaaaaagctgaagggaattttttgatcttagtcctggttgataacatttttagttccggtttaaaaagtcatcaggccttactatctttagtcccaccaaccggaactaaagattaacatttagtcccggttatttataccaaccaggaccaaagattgaaaaaaaaattcaaccgcacactcctcggtggaagggaggcggtgcccgggcgggcaggtggaagggagggtggcataggcggcggccgagcgggcggaggggtcgtcggcaacgctgatgtcgatgtgcggattgttggttttgtgatgtgtggacttgtgttgtttgttgagcatgtgaattagtaatgtcaatgttctatgaattcgtgtagtcattttgatccgtgaattttgtgatgttggtgagtttagctgtgaatttgtgacgttggtgagttcggcgtgaaatcaatatgctgacaacaaaaatacaatgaaaaaaaaggaaaaaaaactttagttccggtttgtaacaccaataggtactaaagatttatctttaaacccagttatttgaatcgggactaaaaatggacatctttaattccggattg

SEQ ID NO: 22116 - DNA, 11119 bp, Oryza sativa
ttttttatttttaaaacttgtatataaaaattaaatttaaatctatatgttcgtgaatttatatatatatatatatatatatctattttttttaaaaaaaccgctttttaggtgacataaaaaagagggacgtcccataggaaaaatgactttcacacatacccgctttaattaataagtcgtttagtcttacaatataacaatcagtatatgtgcatatcattctgcatgccactcaagtactacatgatttaattagcgcaacatcatatatatactacaatgacagcaggcgtgcaaataaaatataatttgtagaggtcagagggtacgtgtgtaatttgtgtttagattgtgacgttgagtttatcttctagtgtgaaatgctatacaataaactaaagttgatgggaagattaacaataattaccaacgagaaagtaattcgtagagagttagattagagcaattgatgaagactatggtacacacaaacaagacttcttggtacaggccgggaattaggtgccgcagctcattacccctttacggttaggtgatatcatcaaacattccctctaatcgttctaatttttatttgtttctgttgctatcgctaagacttcttttgagaggtcaatgcctttgattacatagaatttattcgctagtctttcactgcttgttttatttgcagaaggataataagacattaatttaaactgattcgacatatttatcctgattctatcgtgaaaagcatgcatgcatattgctatcaattaatcaattattgaagtgatattaatattgtgtaccccccaaaaaaaataaatataagagaatctcaaaattgctgacaaatggcatgtctagctagtactagtgtgtgctaccactactggaacatcgtaaaataaaaaaaagaaagaaatggaggtaggaatttctagacatagcacaacagtatagctagatgtgatatgtttggcacaaataaagggaattttcttttttgtctaatctccttttaattaattccaaaggaataatataatctatattcctatatgagttacactgcacacatccaccccccctacatttcttacagatgctctttctgaggaacgacaattatgatccaactaattaattaccagacaaaaaacaaagctggtacattttttttacagtagtacacaagcagctagggctataggtgtccaaacgggcggcacggcccggcccggcacgggcacggttccggcacggcccgtttcagcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacatctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattatttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagttttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccgaaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccacgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagctagggcatgtcaaaaccctaagactaccatgcatagactacatttatgcatgcatgcatatactactgacataactaaattaagtacacatatcccaaggggaattaagctcttctaacatccattagtgcagtagtagtactgaactctctgtgggttgttgaacaaccgctggatcatgatcagttgcaccagaataacctgacgcaatgccggacgaccggcaacgacccccggccggtttatccggcgcctcatctccggtgtggtcagacagccaaaattctcctcctcgatctcatctcccctctttccaaacggtttatatatatatacacaagctatacatctttccactacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaacagctcggtgaccttccaagagccggcgagcatccccgacccggccgccgtcgccgccgtgccgcagccggggctcgccggcttaccgatggacccagcctttcatgtgagttatatatacaagccaattaattaactcgtactagctaccatatcatatggagagctagcttagctgagatcgatcctgacatgtttgcatgcgattttgtgtacgtttcatcaggaacaacggtgctggtctgcatgagtttctgcaagatggccaccatgacatgagcgcgtcgagcttgatgaatcactcatcaaataacctagcactgcagcaagcaggtcaccaccacgagctgctgtccagcttcggctcagacctgctcttgtcgccgacgtcgccgtacggcggattccagtcctcgctgctgaggagcctcatggagccgacggcgaagcagcagcagcagcagccggctttggctggactccagcagtatcatcagtaccagcagcagatgggacacgcaccagcagctgctgccaagttcgcgcaggcagttggggccagggattcactccagttcaccaacgacgcgccgttctggaacccttctgccggattcggcatgccggcggctgtggcggtggcggcggcggcggcgcaagatcaagctagcgttcgctctgccaaacgctcgtcgccggcgccgccgcgtgcggcagcaacccttgcattaaaggtttgtacatagatgatgcatgcatacaagatagctagctagttctgtcattagctactttaattttagggcattgtgattgatgttttgttatgtgtatacgtgtagactgctatggaaggagtaggggactctagctcagtgatcaccaagaaggagacagcgttcaagaaaccgagactcgagacaccgtcgccattgccgaccttcaaggtagatagatactcacagagacatagctagctgctatgcatcatgagttgaactcaatctggtttaattagtataaaacagtctgcattatttgatgtcacaataatatataggtcatgcaatttaagagatcgatatagatgcatctttactaaagttgttcgtatgtgcaaattgcaatatacttcaggttaggaaggagaagctaggggacaggatcacagcgctccaacaactagtctctccttttggaaaggtgagggaggcttttgatggccaatgtgcactatattacaaacaacaagagtgcttggaactatgcatcaacatcttctgtgcaaaagagttcttcctttttgatctcctcctcctttcgagatctatacactatatgcaaaacaacacaatcttattctcttctcgatgtgcgcgcgtgcagacggataccgcatcggtgctccatgagaccatcgagtacatcaagttcctgcacgaccaagttggtgtaagtgtgtgcaagtacaccatgattccccacctttaattatagcatcctggagcacgaactcgcacgtttcttcagatgaatcatgcatcagagattcagagaagagagactgatgatcagtgttacctgaacattgtcttgtgttttgttttctgcaggctcttagtgctccatacttgaagaacggtgcccatcaagtgccccacttgaaggtattgccagtgttggatgctgcatgcttgctctccttttcagcattctgatcgatcactgtacttatgatcgatctgtgtgtgtcatctctgttcaagccagtgctgatgatggcttctgcaattgatttgtttcgtttcagaactcaagtcctgacaagtccaagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtaccaaataaaagtgccatctctttgattaatgataccttttgcttgcttctcttttaaatctgaccgcatgttttgctattaagtagagcttcaagaatttgtgcatgtgtttcttttgcttaattatttccagaactttcaggttaacaattccatttctgtagtgcatatcagcatgccgaacacttctgcttgggcatattctactcatctactgcattttattattatatgaacaaagataggaaaaatgcaaattgatccattgataaaatcatattaggaagatattttgacgtatgctgtcaagttcctataatttcggtgctcagtattatatcaaagaatggttagatttatcatatatggaaatgcaaaccatttaatttggcaagaaaaatattttcacaaatataataattttataattaccattttgtgacttgactactgacttcggtaattccgtatatctcttttacccactgacccccttgttagggacgctaacttcgactggctggtctatatatgccagtatgcttatgctggtagcattgcaccatatccaacccggcaacatatcctatgcacacaggccctcacgtgtacacacgtgcacaccaactaaaaaatatcacaaaaaaatctagaaaaaatcatacacatactttcaattgtattacacctagggttaaaatcttaacgtcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgtgagggcatgtgtgcataggatacgctcccatccaacccttatggtctagttgagtccatacgcgtggattagtgactgcatgagcgaagcctttaccctttttccagagaaaattgaacttttttttatcacaccaatgctcttcaaaagaaattcaacgcaccacatgtccaatacaattctggttctgttgagggtgttgaaatttcaaatagcatgagtaaaaccatagcttttaacccccaaaacgaactttttaccaagattcatggttggtatacagagtcaaaattcaacagaaatgctcttcaaaagaatttcagtgccaaaaagtagagggagatatgtcaaatagttgattttcacccaatccattaatatttgtactgcacgaatacaattctatttgaaccctttatttcttagaactgagtgaaccatcatgtgtatctgtcatggaatttgattcaagtttcacttgtatgagagctacaaccatacatgttattctccttagtgaaatggtaaaccaaatgcgacgaactcctgtaaagctagcagacaagaacaattcaacatcatgcgcaaaaacacaataatagaattcagtccttactgaaccactatgtacatctagaagatatatattataaaaatatataaaagtttggtcaatcaataaggagcattaccctttttctctttatttaccaaaacatttagaaatccatgagctagacatctgcattgcatccaccatctgcctccccggtttgcctttgccctgtattgtcagctcagagactcacatagctgcattggttctctgcatgctcaattctgttagaacatttttacatgactagccaccagaatgcacaatatggccggcttgcgagagtacctgacagtgacaaaagaaggctacactgcaaactcatctcagtctcggccacctgttaactgaacctatcagatccaacaaagatcagcaagacaatgtttttgtagctataatatgatactattgctgaatgccattttctttttctgctgacaaagtgatgaaatgtggatgattgggctgagttaggctgcaatgttgaagaaagcagatctctgaaatcttacaggtcatggtcacttgaaaggggctttcctaccttcctgatactgagagatttgcaagagcctcacttgctgacattgtcatttactggaagtcaagcccttgtacttccaacggtttctatcagctgcatctcaaatccgactgctcacagctgtaaaattattcactttttttctgaatctctgatgaaagtcaagcatgtgcttccatgtcagatctcctcctcgctttgctttgagatctcgacgagttctcgttaacctcgatgggtgatggacacagacgggttggtcgccgtcagttgtagtagatccgacgggattgtccgcggcggcggcgaccgaggtgacggccggcggctgcgaagcgaggtcagggaagcggaggagatggaggacgagccgccggagagcagaccgccggcggcgagggattcggcggtttcggcccatgagaagaggcagatagggtaccgatccaatcttgacccgaatttaactatttgccattttgaggtttgccaattatccaaatattgcacttaataatttgccattggagagaggtaatttcttaactatttgctatttttgcatatgtgacgtgccactgtaccgtgccagcgtggaaagtaacgtgggccccacccgtcagcccctctcctctccttctctatctccggtcggtcgtcgcccacctcccgccagccccgcgccgtcgtcggccgctggccccacgcgacagagacgaagagcaggcgaggagtcctggcagcaggcgcgtggcgcgctccctggcgaccaacaaatggacagcgcatcggcgaggaagcccgcgaggccaaagagaaggcatgcggcggagaaggccggggtggagaggaggcggcgaagcgtggcgcggcgggaggtggctgccgaggagaagaccttcggcgagctcggcatggattcggcgaactcgccggccgctggcgcgtggatcggggaggcacgtcggatcggagtcgggggagacgagaaggagtagtgggggtggacactgt

SEQ ID NO: 22117 - DNA, 12562 bp, Oryza sativa
aggggctgacgggtgaggtccacgttgcttttcacgctggcacgtacggtggcatgacacgtaagcaaaagtggcaaatagttaagaaattacctctacaaattattaaatacaaacataagagggatatttgaataattggcaaacctaaaagtggcaaatagttaaattccgctccaaaggtaggcccgaataactaactatacgggccctttcttcaacttgggtccaaacaaatcggcccgtacccacgagtgggccgatgcagcaggaatgggcttgttcaagttttagattgcagtcaggcaatggacaaatggcatagaagattagaagatggaactatactgatgttttccatccattccattctgagctaacccttacggcatgtttggcgacttaacaaaaagggattggtagtttagaggaggaagttgggagtttcatttttatttctcgtcccttggtagtagagatgagaatcatacaaagtttgagtgggaattaaagttcaagtgatgacatacaattcagatatatcctgacatacttaagaagggaatcccctccaaattaactgttactaaacacatattgaaaagttgagattttgctctcaaactctccttcctaattcattctaaaactccgacacccaccatccaaacaatttcctccaaccaaacgcgcccttaataagatgattgcatttcactgacataactaggatctacaatagatgtcaggacaattgtccgtcgtccatttggcaacggatacaaaatttgttgataatggattatattcgtttcaaaagcagaagcaatgaatcaccattcctacaataacgcatagctgcagaaaatgccgaaatttacagacaaggataaaacaaatataaacattcatctcccctccaaggctgtaatgctcacgccattcacggaattttccatattctctcttgcatattcagttgcgcgttttttgtgcacaaaaaatataggttgctttggttgaggtagcggtgcagtattgttctctaacatgaacacaacagatgacatcagcggcctatcatctggatggtcctgaatgcacaagagcgctatgtggatacatctcaaaacttcatggagtggacaactctccacaacgctcgagtccaccaaatcccttgcatttccatctttccataagctccaagactacaccaacagaatataagaatcagttacaaaagtatgcatcgtttgagctgaagaaattaagcattctgctgctcttacataagctataaggtttgggaagcccattatgagatggggtgagctgatcctgaagccacttatgatctccaaaagtagaataccaaagctatatatgtcagacttgacagaaaagattccttccattgcatattcaggagacatgtacccactgtttgttaagcggtgaggaatgcaccgtttgaatcagtaaacatgtaaatttgatcacattaagcattagataattcatgcatcacttactatgtcccaacaacacgggtggtgtttgcttgttgctggtttccaccaaagatccgtgccatgccgaaatctgatattttgggactcatttcagcgtccagcaagatattgcctgctttgagatctctatgaataattgttaatcttgaatcttggtggagataaagaagccctcttgctacccctttaattattttgaaccggtttggccaatcaagcactgtttttcttgtagcatctcccaatattaacatgaacaaagtgtatcgtcagccatcattcagtatatatttttactaattcactaatcatttaatataaggccggaaatcagaacataccaaaaaggaaggcatccaagcttttgttcggcaagtattcatagatcagtaacttttcatcttcatgaatgcagcaaccaacaagtttaactagatttctgtgctgcaatcttgcaataaggacgacttcattcctaaactcctctattccttgcccagaacccttactgagccttttaacagctacttccttgccaccttccagaattccctatgtgagcaaccaaatgttcaattaaacaagtaaaagccaaatattaactggaaatgtcaagctatgacattaaaaaaaaaagaaatatcaagatatatcttctccttaccttgtaaactttgccaaaacctccttttccaagcatattataactggagaaattgtttgttgcaattacgacctcttcaaacccaatgaatggaaaatccacatcttcagccccaagttcatttgaggcactcaagtattgtaccataattttgttctggatttccttgcttcgctgtttgcctaacaagaacagtattatatagaaattgttttactaacaaaactacatggactgcattttgagaagtgatgtgagtgttgttgtaccccttgatttgcatatccacacaaggcatatgcatgtgaggatcagtaggctagccacaactggaaggacaatcttcactacatcagtctccttcttgactgctgcagaaatatagtccatacaagagaatgggactttcaggttctcttcataagctgcttgcaagtgcatggactagatgcactttactattagtaatgtttcattttaaccatatttgatgctactacagacttcagatgaattgtgaattttacaggcagatttagtgtgtctgcaaacatcagaggaagtggtaaattggcaaatctttacacattgggcaatagagtattgggtcccatagtagcagaagtggcacgccaaaagataggccacaagttgctaatgcagcaggataccaatttgagtcctgtcaatggtacatgaactggactgaccaagaaatgcatcggctagaaaaaacaaattactgaaatcggtgtcaactgaacaattggtcgtaatatactaggctatgtttcgtgaccaccattatctttcctaatataacttcctcaactaaagagtaagagcaacaagtgcctaattcagcaaggtgcccattcagtatgaaatggattagaaagcatagatcagaaagaatgctttataaaacagtttagaaagctctgggtcaagttaaaaagcataaaaaaaaatgcgtaatcaaattaattaatacttaacagtgcataagtggagtaagtatgggcattaatcacaatgtagaggcatatgatgggcagggaatgataaaaagtaccagttgggctcggaagccggaggtacagattctcaccaccaccagtgacctttgccaggtctagaagctcccccatccaaaccaagcacctcgatgtgtcacccatcatgctggcagtgctcaggttcgcgtaagcatatgctgtgcaagagcagttgtgcctgcactcttccatgcactcatcaaggcttctgttcctgatgtacaagaacttgtcaggtgttttcatgccaggcaaggtcaagaaactatctccatagctacatttcatctgctcctttctcacacatcctcttgaaatgttaagaccatcaggcttgaatccatcaaggcacttgcatgttgggaatgcctccgcagcatcacaataaccaaatggtccacaggaggcatatctttcgcaagtataagagggattgctgaataacacagaccatgcaaacaagttgctgttccagatcagcatctttattgttcctgtgtagtcgagcatcaagcgcatgctaggagagtcatcagaaacagagtacatcatgtatatctcattccctttgttgatgattgtctggtatgtcacagagctggtattactctggaacatagcagagaccaacgcaccattccatgccccactacgccagtatggacttgttccattccaaaccaaaacctggaaatccgagttggggtcaccactgagggaaaagttgccggttgatggatcatcagggcccttccaagaaacaatgcgctgagcaacctggccattgtatttcagcaagagcttcatgccagggaggatggtatcagtcaaatgatcaaagctctgccacaagattgtgtggttaggagatcgaaggaccaaattaccagaattaagaagaactaccgtggctccagaacctccagtggtgatgttgttccttgcttcccaaagagtgtggcctcccgattcagacaacacaaggtcagaactgttggagatgaagagcatggcagaagaaggggcagtgattgggttgtcacggttggcaacccacaccacggtgcgattgggaatcttgtggtaccatatgccaacatataaggtagcatttgagtttgttggggagaagaaaccaagagcaaaaacaccaccatccgagattagcatgtcaccagggtagagtggctttgcaggtgttagctgatcatctgatttgcacaaagaaatcaagaacacgagtacgaaaacggtagcgaaagccgtgcccattaggccttctattctgtgtaaggttgagtaagcatggaagcaattcttccctccaattgtaggaagctcttatcagcgaggacacgcaattggtaggaactatgaacaacaagccaaacaagggtcggtctcatccagctgaacaaagttgactcaaatgatttggccatccagcaaatcgtctgcccaacttgagccagcaactacataatgccgtctgagtgaaggttccttgaatttcattaccagggacagtaagtcaaatacatcggcacatctccatccagaaatacaaagtcgaaagttcatcgaacatgtgtgagtatgacagttaaaaggggggaatattgagaaactggctggctcaccaagtcaccatcggttttagctcgcggcggaggcgactgaagcggaccttaggtctccggggaaatctcgccgtagacggccggcggctgtgatgggaggtccctggcggcggaggtaggagtagggcaccgtcgaaggggacatgacgcgagtcccccgacgaggccccggtcgtggccgtcggcgagggaggttgaagcggagggacaaggaggcaccggcgggcgggcatggtgggcaggctgtgcgctcggcgtcgccgacggcgacggcgcaccgccggctgcacaggttgtcggaccgagaagcttcgccggctcgccgccgaaggattcggcccacggacatgaattggatcgtaaaccattgcttccgaatcaatctgggcttgcccatatccatactgagctgcaaagttcatcgtggccgtttcctcaccatgcggcccagtaaatcggcccgtcacatccaccccacttcgctttcgtcagagatcgccgccgtcgccgtcgccgccgtcgccgccgccgccgctggatggaaccggatctgcctgcgcgtgctcgatagcttgcaagaccgatcagttggcgaatcctgaatgccgcagcggcgcagccgcctcggctgcttcccgtcgggcggcgctcccatggaaggatggggattggttccgttaacgcagatggtgcgtatttcttcaggccttagatccatgagagttccagtgcgccattgattaatagggtttatccagatctccactgtggaatgtggattgtgattgagagtattgcttcctggttggtggtggtgtgcaggtttcgccttggcctggggctttccatgaataaggcggcgccggcgtgctttgctgctttggacaacgcagcagcggatgcccttcaaagttcaaactcgtcacctgtaagcagactgcttctttcctatgcaatgctatcaaatgataggatttggccaaacgatttgcatttattagtctgcaaatttcagagcaagccaaggctgcagtagcagaaatagttaagtttctgaaatatggatgtatggaagcattccttttatgcaaccaagcaacaaagaaaatgctggttacaatgtattgctcagaacattttctgtgtataaatttgaattgctaatgtataagtgtacaactacaagctacagaagtttatagactaaacagggaatggtgtaataaacatttaacgtccctctagtgctgtgatactcacgttatttacagatctttccttgttttctctagtgtctttagttccatagaccctagctgtcaaataagcagactcctttggggtaggaagagcagctgtctcgttctctaacatgaacacaatggatgacatgagtggcctggcagttgggtcatcttgaacacatgaaagtgctatttgaatacatcgtaaaacttcgtgaagtagacaactctcccgaattgatgagtccaccaaatccattgcatttccatctttccataaactccacgcctgaaccaagatatacaagaaagttgtggtcaatttattttgcaatgttttactgattaaaatgttgaggattgcagtccacttacgaaggttataagattttggaaatccattatgagatggggcgaactgatctttaagccacttacaagctccaacagtagcaccccaaaactgtaggtgtcagacttgacagaaaaggagccttccaaagcatattcaggagacatgtaaccgctgtttagatcattccaaaaacaatgtaatgtgcagtttgaattagttataatgaaaacatatatcattaggtggtctacaggttacttactatgtcccaactactctggtagtattttcttgttgcttatttccttcaaagatccttgccatcccaaaatctgatattttgggactcatatttgtgtccaacaagatgttgcttgctttgagatccctgtgaattatcgttaaccttgaatcttggtgcaaataaagaagccctctcgctatacctttgattatcatgaaccgggtcgtccaatcgagaactgattttcttttagcatcttccaagattaatgtgaaacaaagttaattgtcattaaccatgaatatcctcaagaatgtttgtattatacgaccacaaataagtgagtaacaacgtaccaaaaaggaaagtatccaagcttttattaggcaagtattcgtagatgagtaacttctcatcttcgtgaatgcaataactgataagcctaactaaatttctatgctgcaatttggcaatcagaactacttcatttctgaactcctccacaccttgctgagaacccttactaagccttttgactgcaatctccttgccaccttccaacactccctgcacaagcacacactctttcaattgaacaagagaatataaaagatatttcttctgaaattgccaaggtaaaaccttttgtaccttgtaaacttttccaaaaccacctttcccaagcatgttgtgatcagaaaaattgttcgttgcagtgacaatgtcttctaagcaaataaatggaagttctagattgtcattctcaagttcactggaatccttcaaatgttgtagtctatgtttcttctgaatttccttgcttcggtgtatgcctggcaggaaagcctttcatataaattgttaccttagaaacaatgcagcctgaaaagcttagttggtgttggcctacctcttgatttgcatatccacgcaagacatatgcacatgagtatcaacaggcttgttataaccggaagtacgatcttcgggatgtcactcttcttcttgttaactgcagaatacggcccaccaagagaacacggattataaaatttgaggttgatatggagtagcacattggatatatgttctttttcctttaacagaaggtatatattccttttttgttttcttcagaagagtcctatcaagtagtgaacatttttttgttcgtggaaaatcttggcctggcaagacctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctgaacagtgaatttagtacggtgggccaacgaagtaacgcctgaccgggacttgtctgcccctctggtgaagacgcagtgtcaaaccgcaaactaattactgtagctacgacatcagggtcagctgattaaactttcgagagagacgcgaccgtgaaaagttggcaagagagcgaaacctcgcggcatgcgcgtgtgtcggccggtcgccgccatggcgcgttacgcaatgccgagaggcagcaggtaggcaggtagtcagtgttgtaatgcaacttgtgcggttgtgcctggcacacgggaagtccgaaacatcttcgctgactctcctgaacaaaaacaacaaagaaaacgaaaatttcagtctcaaaacgttgcgcgtgagcgtgatgacgctgggacacacggggactttgtacactaatcaacacaggagttgatggcgtcaagtcgtcgattttttgaattttatttatttaaatatttacataataattttctagaaaacttttagaaatctacacctaaaaaacgacgtctaggagagagttttattttttttatgacgtggcacacgggtgttggcataccgcgtaaaaagaggccggctattttgcaagcaattgccttgacatcttcccaaaagactataaggaggccacctgcaaaaataaccgagaatgttattttacaggcaaccccttgtcacatcttttgagatgttgtgaaatggccgcttgcaaaatgctctagccatcatttcacatataatcccatataaccttctaataaggcggtaagaatgctacttcagcctctttctatgtgaccgttaacatgcaccaatgaatatgtgccacgtcaaaaaaaaacgttctgctaaaagtggtaggggtgtagattatagaaatttgaaaaaatatttcaataaataaaattaataataaacagaatttgtgtcgtcaacggcttgctgacgtgctccatggcagcgctgggctgtaaacagccggcctggccttatgggcttcatggattaaacatgggccgcgggtgctatatgtgggccaatccatccgtggccgtgtacgcagggccgaatcagacccagttgggccgcaggtacaaaacccttccgcgtggagttcagacgacggagaagagggcaccgaccaccgagccggcagcgggcggcgccaaccgggaaggcggttcgtccgccaccgcgagcgcgcgaggtggcgcggcggcggcgtcagcgccggtgttgccaggcgagagagctagtggttccgcgtgtccggggagcagacgtatcacggattcaccacatcgtggcagggcaggttggttaccacccccttgatccttttgcccccaaatctcttgccgatttgcccatttggaagcgacgaggagacatcatttgcattggaagtaggaaccacaggcgctgaagattcacacaacagcttcttctttttttttcagtccttcggtgctgcgggagcactttggtttggagaccttccgccaaacgaagatggactttcagagacttgaacaagcatagcaggtgatcaattcccaacaaacgctgcctgtgcaagtcattcttttcaacatctcatgagtgaattgcacatggacccacttattatttttacccatatgttgcaaatcggattaggggtacatcaatgtgcttaggcaatgcattttttacaagatctataaacctcagctcctactgtagtaatgtacaactgcagaaactgcttaagagtttaatctcttacagtctagcggccttctagcgctgtcaggctcgcgttattaacggaactttccgagccttgtctttcttcttcgtcgtaatgcctttgcacgaaatatataggctgcttcggtattgggcgtgccatgtcctcgttgtccagcatcgacacaactaatgacatatgcggcttggcatttgggctgtcctgaacacacaatagtccaatatggatgcattgcaatacttcattaagcaaacagctctccagaaccattttgtctacgaaagcctctgccattccatctttccacaagttccatgcctgaaagtaataacattagtaaagatttcttaacttgttttaactatattgtgttcgaattgttaacataagtattggtagcagcatgcacttacataagctataaggttcggaaaatccatcacaatatgatgaggggagctgatctttaatccacttacaatctccagtagcaatacgccaaagctataggtgtcagatttgactgaaaaaatgccttccattgcatattcaggtgccatgtagccgctatttaaatcatttgcaagcaagcaggaaaaaagtgaataagttcaagcacatgaatatgttgaactagtcggctagagaacaagtccacttactaggtcccaacgactcgtctagtacttgcttgctgttcactgtttccaaaaatccttgccataccaaaatctgatatttttgggttcatctctgcatccaacaagatgttgcttgtcttgagatctctatgaattatcatcattcttgaatcttgatggagataaagaagtcctctagctacccctttgattatgttaaaccttgtttgccaatcaatcacagacttcattgcgtgatctaccaagaaaatggataatggacaggaatgaaaccattagagaattcgataatgttgactcctccattagagtatgcactttgtcttaatggaaattcaggtggggaacctctcccctccggtgaacattccaaaaaaaaaaaatcaagacttttttttaatgcatccttttctgaaaaacaagcttttcatttaatatctgataaaacttaccaaagaggaatttgtctaagcttttgttgggtaagtattcataaataagcaacttctcatctccatgaatgcaacaaccaagaagtctaactaggttcttatgctgcagttttgcaataagaactacttcattcctaaattgctctaccccttgctcagaatccttgttaagccttttaacagcaacttccatgccatcttccaatgttccctgtggtatttcattaccat

SEQ ID NO: 22118 - DNA, 2016 bp, Oryza sativa
tccgggccacatttgatttttcttgtacgtattttagtgtttgccaatttcttttcgaattttaattaattctattattccttttagcgaatgatttttaattcgggatgaatttatcaggacgtgacaaatccaccccccttataagaatctcgtccccgagattcgaggaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctctgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagtgcaattttaattccaggaaaaaaaaatcctttttcttttttctttttctttttttttctctttttcctcctttctttcggatgggccgccggcccatctcctcctttcctccccctcctccctgctgggccggccgcaggccgaggcccagccggccgcccgcctccctccctcccggggtcgccgacaggtggggcccacctgtcggacccgtctcccacctcccgcctatcccgctcgcgccgtcccgccgaaaccgctgccgccgcacccacttcctccgctttccccgcgcccacgccacgtcgccgcgcccacgccacgtcgccgccctctccccgcgtctcccggccgcgccagcgcacgagaggggcgggattcgattttgaatctccccccaccttctctctctcctcccccacgtcgccggcgaaatcggagcgcctcccggccacgtccgcctccccctccgcctataaaatgctccccatgccctcctctctcgtttttcgctctcaccgctccatcccgtgccccctaccgagctcgcaccgccgccacttacgccgccgcccgtcgcgcactccggccgtgtgccgccgtcgctagagccgccgccgcactaagccaccgccaccactagcttcgccgccgcaagacccttcccggccgctgctctgcgttcaccggaataccaccgaaaccccatttccctcgcgtcgtcggtgagttctctctcccctccgactccggccggcgtggatggtcgctgtgggggttttcctccgccctaattcctctcctctctttccctaggtgtcgccgtcgctcgtccgcacctcggcatcaccgg

SEQ ID NO: 22119 - DNA, 5693 bp, Oryza sativa
ttgccatggccgcccggccggcttgatgccgggcctggccggtacatcggctcgtggagccggagccgtggggcccgcttgccagccgtgcccccccccttgagccgctgccgagtgggcccgtgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgtttaagtccattcaagtctcagtaaatcaagaaaaatgtgtagaatccattaaaaatggttttgtttcctgtttcagtagtcttatagcatgttttgcttgtgtgctttgtttgtcgcgtagatttcgcccgtttcgtcgatccgcagtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttaggtcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaatctcccaagacatggtgttgcctggtaaccggtgcttgcacttttcactccgtgcagcatctgataccgagttgaagatttcactctttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacgtctttgccaatctcttttatcaatcatctttcggcttatctctaacaggtggtattctttaatgtggattgcggacgcttctggggacgatgaggtcctttggcttgctgcctttccgtgaaaccttgatgtggttcgtcaaaaagctgcactgactaccttcaaggaaatacgttgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgagtttataatatagttcttctgacacgagaccctaggtctccttgtcagtaaacaattatacatatgatcacatatccgcatcttccacaagaatcctcttagaacttgtctgtattacccatttctcccttattacacgaatacaaggcactgccttaaacaaaaagggaaggtgcttatcattggtacattgtatcctcaacatgaatcatccctaaacatagcaagctcattgtttaaaatcatgaatatatttgtttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgcagagtgtgagacacatgctagcaatgtgtccaatttctccacaacggatacatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacaaccccccgatgcaaaccacgcgctacacacacaagcaaggaacacacgactaacaacactaccctacagggtggcttaggttctgcgacgggttctccaagatcttcactgcttcacagctggcttcactgcttcctccacttcgctagcggatcctgcagtcttccggagcttcggcgaacaattggcgacatcttcttcttcgcaaactaaccatctagtactagtggaaatccgaagaaggaagaagggagtaaaccttttgcaaatagcattaggggaaggagaaaaaaaaggaactttcgcaaatagttttatttataaaatatgtccttaggttttatccacttggcttatcctacagtcgagatggctctgataccatcttgtcgcgaccgggaaaattgccttttcccgaacaccagtgtattaatccccgtcccaggaaaagccgggtacaccacacaaacatggtataaaagacacatctttattatatcgataatatttacattattacaaaggtacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtgccaagccaacccaggccaaccattccacattttagttgttgagcaaattttaagaattaaaacactgacttgggtacattgctcggcttgcccataaccgaaggcgcgggtattcgaatagattatacttctgatcagaggtggacatctttacccacaagacacatattcctcacgagttaccacgtgccacataccaccacggtatacggacagaagacgtgacatagttccaacccatcctaggcataaacaagagtaccga

SEQ ID NO: 22120 - DNA, 5936 bp, Oryza sativa
aaatgccgtttttatcaaaaaaaccttgagcctcccttgaatatatcttgcatcatacctcctcttccggtgtgactagctaagaacagtgggtagtactcagtctgcctctcttttcccccacaccagagttgaagtccttctcagttgaagatgtctcgaaaaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaagttggtatcagagccgaccttgaccgtaggacaagccaactggaaacctaagagccctctgaacccctcttcatctgcatatgctttttgcacttggatttgtttcgggaaaaattttggggttttgttcttctgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctttagatgtcagacctgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagccttaattaggaattgtgtgcctctttttcagtgttttaatccagattaagataatggcacttaatttcataagaaaaattagtttccgagccatccgttttcttcctttctcttatttctacctatcccctccagatggtgaagacaaggaatgatccccgtgactccagcgacgccaggggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgcccctgaggacgtgcgcaccgatgctgagaagcaggagaagtttttgtttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgattacaacggtggcagtcacaacaacagtaagcagcgcaaccacaactcgactccacccccactaatggcaccagctcagtcagatccgccaactgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggggaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatataccgaagtcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagaaatagccgaattcgtcgcactctgcgatgtttgtcagcgagtcaaagcagagcatcagaggcccgcaggactgctacaaccccttcagatcccggaatggaaatgggaagaaatcggaatggatttcataacaggtttgcccagaacgtcgtcggggcacgattcaatctgggtggtcgtggatcgactcaccaaagttgctcattttattccagtacacactacctatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgccttatgcggaattctcttacaacaatagttatcagtccagtttgcaaatggcaccgtttgaagcattgtacggacgaaagtgccgcacaccacttttctgggatcaaacaggtgagcgccaactgtttgggacagaagtgttaaccgaagcagaggagaaagttaggactgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtgtctcaactgaagaagtgtttgagggtacctgaggaacaagctagctcagagcacattgacatccaggaagatctgacttatgtggagaagccgatttgtatcctcgagaccagtgagagaaggaccagaaacaaggtgatcaagttttgcaaagttcagtggagccaccactcggaagaagaagccacctgggaaagagaagatgaattgaaggccgcccatccgcaccttttcgccagctcttccgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtgggatttttcttggattctacatgtcaaaatatgctaacaggatttttagt

SEQ ID NO: 22121 - DNA, 4232 bp, Oryza sativa
ttttttgaaatgatctctcactcaccatgattgagagagaaaaatataagggaaaaagcgagggctaaagttcaattattgggtccttttcccgaggcgatgaccttttgggcccacaaattattattcccctgcaggatctagcttacacaggtgtgtgggcccaccacgcgtgctgggcccaccgcgatactggagtgataggcccatggacctatgttgtatgggccttacgtcagcacggcccagttgctggttttacctgcagatgcgagcagccgccggcggcggcggtcggagagcgagtggaggggaggatgctgtgccgccggcggcgcgtgggggcggcggtgcggtggctgtcgcggctggcgccgcccgcgccggcggaggcggacccggtggtggtccgcgtggacgggagcaacgtggcccgcctcgggaagcccaagcccggcccgaggccgcggcagctgctgtcgctgccgccgttcccgggcggcggggacggcgacccgctccccgggaggaaggcggcggcgccgcggcgggtgacggcggtcagctgggtgaagcactacctcgccgacgtgccgcaggaggtcgtgcaggcgcacttcaacaagaggctggtaaaatcgcacatggccttcaaactaatttttgacaaactctttgatgcaaagattgcaatctgttttcttcctagttagtgagacatattagaggaaaagattcatgttgttctcttgcttgaaatgctcttcgggagtgtggactctactactctagtggcgaaatgttgcttggttagtgctcatgtttaagtttttctgtgtttctgcccttgcaagaaaatagtatcatgatcttaatatgtcttattatgtatgattagtcacttttatttttctttaagttcacaattttccctcttgcaatcttttctctcagtttgatgtcatatgcagttggcactatatttagggattccttttttgtgtatgaagtgaaactatttgttccccgtttaccaggtttattccgagtgctcagatcatgaggtttcagttgagactattaagagccagaagcatcatctcaagaaggtatacaatagagatttcgttcctaaaatctgtttgtattctattgttctcggtttgaatgaagtaaatatgctcagcagtttgttgcagatcaagcataatgatgtgatggagcctggcatgagaattcaccttcctgtgtcagtggcagagggcgagattaagaagcggtatgagaccattccaactgccacattgcatcccaataaagatgagattgaatacttgagaaggcttgtcatacacaaggtaaatttatggttgtgtgatgtattttcattggatgagttgtagcctacataattcatgtagtatgtgcggataaattatgtaggtcttctacctttgtaccattctataccacaacttggacatacagtattatgatatgaattaattaatggctgtttacatattatggtgcttttaaagtatcataagagtgctgttcacagttttattatgtctgtcaattattgaaaaatgtcagcttgacacaatttgagcactctgtttaattacgcagcttggcatgattttagtgtttattttttggagcttactgattttaattttcataattcagagtcataattgtatgcaaaattttgaaattacaggattctgccatacttgtacttaacaagcccccaaaagtgcccatgaagggaaatttgccagtgcataacagcatggatgtgcttgcagcagcagctctgtcatatggaaatgaagaaggtccaaaattggtgagctcaagagtctcttcatcattggtcagcatgtataaccataagcttgcactgaagatttttctcgatggattttgcgttttgaccacaggttcatcgactggacagagaaagtagtggtttgctgttgttcgggagaacaaaagaaagctttactcgattgcattggcttttcactagcgtcaatttagcaaaaacgaattctcaggtaatgaggcaaaatcaattcattgtgcttgtggttaagcaatttttttcatctaaacaacttttatttgctctctgttgttatttgcatgttaattccttaaattgttgacaaatattataggtatggaatgctgcctgtgaagcatacatgcagaggtattgggcattggtgattgggacccctaaagaaagagaagggattatttctgcacctctttcaaaggtgttcccatttacttagtattactctcagtaatgaaccacctaagcatgtaaaagaaaaaagaactgtttcctctctaagtctgagttttttagcttccaatctttttcacttaactttccactatgcagtaatcttagcacttgtgctacgagtaaccatggattggtcaagtcatatgtgccaagttacatgcataataacatatatttttcataaacaggtacttcttgatgatgggaaagccgagcgtgtcattctggcacatccatctggcatagatggtgcacaagaagctgtaacagcatatcgggtgatgggaccaaccattcatgggtgctcatggattgagctacgcccattgacaggccgaaagcatcaggtaccctcaactcaatattatgttctaatgtatcaagataattaagataatatatgttttgatattattagtggcttagtgctactgaatgcctgagttatttcacatgtatacatatgaaatgatgtttctttactgaaagaatcaatctttccgttttgctcctctgcagctccgagtacattgtgcagaagctctaggcacacccattgtcggagactacaagtacgggtggtttgtgcaccaaaggtggaagcagaatccccaaccagactttgaaccgtttactggggagccatacaagctgaggcgcccagaaggcttggaaatccagaagggcagtgttctctctaaagtccctctgctgcacctgcattgccgggaaatggtcatccccaacatcgcgaaattcctgagcagcaatggagaatggcatgaaaatggtgctccatggtccaaggagaagcccaatctcctcaggttcatcgcaccgatgcctgcacatatgaaaattagctggaatatcatgtcctcatatctggtgtaagagcatctccatgtgccattgttggtaacatcaagtttcattccatgtagttttactgagaagcagctaggcttctagttcattattttctagattctatagctacatcttctcacagtctgggtgagaatctgttctgcactgcttcgggagcctaagattttaggatataagctgccgctgctagaagctcagctcccccgaatagtgccatagctgtttttttcaggaatgccagattgtagcatctgaaccattgcaaaagaaacagttggtgtgaatatagatcaattttctaagagtatacatcctaccaaagttttaaatctttgtttcttttttgtaagcatgatgtaattctgaacaataattactgtacgttgcagcattttactactaatgaaatgccactgctagtctgctactaatctgatgagtaattccattccagtatcagtagttccaaaagatttggtttttcctgtgctgcttcctcaggtagacgccgagcaacttgtaatacgtccaccgccgctcgccgccggtggcctcgagcaacacctcggagctcgcgtggaatccccccttgccgaacgcctcgaacacgacggcgtccgtggtcacgacgggctcgccggcgcccaaccgatcgaacgcgaagttgaggttgcgggcgaggcggcgctccaggtaggcgtcgacgaagcaaccgtgcgtgacgaggtccggcgcgacgccgtcgcggcgcatgtggtcggcggtgaggtggaggtcccagaacatgcacatcttggagaaggcgacggcgcggaggttgaaggtggtgaggtccggcgtgaacccggcggcgaccatgtccaggaacgcgcgctgcagcgactttatcttgaagttggcggcgaaggagaggaggtagaggttccagagcaggttgccgccagcacggtggccgaggccgacgtcggtgacgaactccccgagcttgtagtacttgcggtgggagatgtac

SEQ ID NO: 22122 - DNA, 19286 bp, Oryza sativa
cgcggcggccgcgcagccgacggcgaggacgggaagccgagcctcgccggcgagtggagctcgggaaggaggaggcgagcggagggagagtcaggcgagggcagcggccatggtggaagcaggagagaacccatggtgatgatgacgtcacctctttttcttagcttggcttctgctttctgaactgcctcacaaaaagggcagggagaaatggaagcaagatttttgagaggaaaaaaaattcctgggaattggcaattcatgttttcaactttgggttaactgaatccatattattatcaataataatttattcattttcgaaacatgctatattaaaattcgcaatgtttaagttgtgccattacaatttggtttagaagtcttgataaatgcatatacatcgaaggggcaatagtagtggcactgacatgtcccgaatacctgctaaattttaatagcacagcttgaatatcacgaaattataattagcatatttcaaagatggagaaattataatggcggattcaattataatagcgtgccaatcctgtctgcagaatcatcaagatggtgacaaacccagtgtaacaagtttcagtaaaaaaaatgcaggatttggatcatccagcagttcagaattcagagctaacatctcttttcttctgcgctgataatctgatatggcaaaaaatggtcatcttagcctccatattgcaacaaactcaatctgttcatcactgacggcacaaataatcaccaaagataagcagaggatagcagcaggaagctgcaaaacacaaacctttggctacatgataagactagccctctttgcccaaggtgaataatcaatactcagatgggcatcaggagagttacattgatcaatcgcaaattcacattccatcaaatacatctgttactctgttaaggcgagaactacttcgaccaaattagaaaagaaaatggtcaatagtacaacaataataagaagataataacacaattccgcgacaagcagtgaaccggaagaggagcactcactcaaatagtacagaaaccagaaaataggaaccgaaagaggaaggccaggcttgcgccgaacaagccgaacactacaaatgccttcctcctccttaagcacctagttgtagtacataagctgttgcgctgatgactggttcgggtacccgtcgtagagggcctgggagccagcagcaagaagccctgcggatacctgacctgcaaggccatgctggccagcaatctgcccagctgcgacctggcttaaggtaagttgcctctgatatgctacgatatcagctgccgagaaaccttgtggcacacctgccattggtacgggttgatatgaaggaagtggcggtggcaatggcttggaggatgtaccaggtggggtaggtttgttgccccatgagcactaagaaagaacatgggaaattgcataagtaatcatgcaaaaaattgaaagaacagacgaaataatatttatttgaattggacaataccttgatcggcttcccacgcactaccaatccattggccatctgaatagccaatgctgcttcgccatggttactgtatctcacaaacccaaatcctttatcctgttgaacgcgaacttcctcaatagccccaacacctaaattatagaagtggcggtgaagctcatctcggttaacctgacaagttagataagtaaatgatcaatttaaggtgtcctaaaattcgagatgagaagtaattgcagcacactgaggaaagaggaacggtctagcaccaattccagggtaggatatggaataggaaataattagaacataggaagaaagaaaactgggctagcaccagttaatttctacctcatgtccaaggttgccaacatacaccgtagtacaatcagggttgttctctggattctctttacttccggtgtcctgacttgcctccattcctgcagaataaagttgaaaacaattcagaattagcagcgaggactatgtacgtcagtagctcaaattgctattgttaaagagcagctagatatgagtgtatttgctatggatgaaataatcgtaacaaatgaatgtggttatgcagaaaatacaagttgcagcatcttttcacttcttttgttacaggaagcacttacaagttgcagcagcgtatgcagaaaatacaaatatacatggaaatccggtcatctcagatctttgtgtgttaaatttgatctttctaaggataacataaaaatacaatgtgggaggtccattgtgtaatattgaagaacatcaggggcctcaaaatgcagtgtaagtaaaggtgggataccagattcagaacaataaccaccagcttcggtcttttagaggttgactcaaaagtttatggccatggtgtaccccacatgctatttattcagctgaatataaatataatagtgccttttggtcatgaaactagtaaaacaactaacctggattactagaactaccatttgttagtacaactgcattatggttgtcagtttcttgtttctcttctgcattgttctttgttgcccaattacaccttatttgtctgcttccaagccatttccctattaaagcatattagtttgcaaaagtcaggaagttacaacactggaatgccagtaggttataagaaaaaaaatatattatgagctctgcttgcatgtttaccagtcatttcagttatagcagtctcagcttcctgcattgagaaaaatatcatgagtgataataggacaaaacactaggtgcaactgtaggactggacatcagtttacaaatgaaacttcaggtgataatcaaatttatgttcaagctatgataaatcataaataaaaaagcaaaagaaaaaaaactgacacttggaatttgcataaccttcatacaacagcaaagatcacctatgatacagtttgaatttttggctatggatgaattacataaggaacccgaagagctaaaattagatatacaacaagtaccataaaaaactatttgaatattaaagaatatggaatcataacataaaaagtaatcaaacctaccaataccaaacatgagaacataatattatatctcatctgaaactaacagtaactggtacacaggtggagaatagttcactgaattaaactacaacagcaatagctctaagcctctaacagaacactggttgccaggaaataaaagaaagaacgcaaataggttgtcactcgtcactgtagtatagctaaaacaccagaataataggtagagaataagctgtggaacacacatcacccacgggacaaaaattggtaaacatctgcgaaatggaaaaaggtctgagttgttcatgcctgttgattacggaaggagacaaaaccataacctctggagcgtccggttttgttatcccacatgactcgagcatcactgatcataaatgacacaaatgaaaaactgaaaagctacagcaaaaacaaaaaaaaaaaggtagaaacaaagaaaaagcatgtagtccaaaacgcaacattctaacatgtaatatcatcaattttacaatgggataaagtttatatagaaaattgagccacttgaaatcaagtcagaattacaaggcataagctgcagaatgcagataaaaattatcatatagtttatcatgtcacaaagaactaaggacttacgaacaagaaggatatgctgagaaacaggcataaagagttgcatcattcacttcagaacttaaatcaccaacaaaaatatggaaatgccctggaaatagttcagtgggcacagttaaccaaataagaattaaaattagaaacaaatgaaagacatgtgaggtttttctttaataatatctcaccagatgtatcctccctctgtgtacttgcataagcccagttcaccttgattgcttggccacatctgtgcaaaaaaaagtccataatgaagaaaccctaaaagaaacttgaggctctgaaacctgtgctgttgaagttaatggaacacgggaacttacatgtgacgaccatgaagggtcattattgcaagagccgctgacctccgatcataatagtcaacaaaaccaaaggaagactgtaacgaaaaagtgaattctcatcaaacagatgaatattaacaaaatgcagtaggttctagttattggccctgttcttttcagctacttcattggattgttacggtggattatttgctccaacgactctaaaaatatattttctcaaaaaactttcttctactgtattgcttaaaccacttgctctaagctactacctccatcccaaaatataaggagttttggggttggacatgggtattaagaaagtaggtaaaattcaatgtgtgatggttgtgattggttgagaagagaaggtaggtgaggattttaagaggtggaaggttgtgattggttaagaagggaataaattgttatattttgggacagatgttggaggctagaagttgttatattttgggatggatggagtatttcttaagtttatttctacaaatctttatttgatccctacaatcacgtagataattcactgactaatctgttacaaactgtgccaaaatgtttgatgacatttgaaccaaaatcacaccaagattgttagaaaattaaaactaaaattaggtcgggaatgttgtagtgttagaacgtggcgtttctcaaactttcatcaaaccttgggcacagcctttggatgcatgagcaggatgcataaacataccttctccttccggatgagcttgcatctttccacaaggccagaactctggaaaacttcgattagaaggctctcagtaacattagggtgcacattcccaacatacctagttgacacagcatcgttaattagaaaaataaacaaaacttcaaagtagttaactagcaaccatatattatacaaatttctaccaaagaaaaaatcagcatcagccttgatggaagactgtgcataacctaattatgcacgcatgcgtcaccttgtggaattccacattggtcataaaacaaaataagttggcagataagggggaaaatattaaaaaaaaaaggaagttgtataatatatgaaggtgaaagcaggaaaagactgaaagcactcacacactgcgacatgtggatggatcaaaccctggtggaagattgccatttgaaataggctccatctgcaaaacataaaatgtcaaaagaaaaaaaaaacaagactgacgcgaagcaagcacggcaaaacaagatagaaaacaaataagtacaatgaggaaagctaaacttggtaccaaataacataagaagaataggcacccaacattcaaactaaagaggaatcacaccagtagtgcagataagatatacacccacaaagcccatctagcaaaacatagtttctaagtcatctgttatccattaacatcgccatggtgatgtggattgttaagccagccttccaaacctatgttcttcgtgcagcaggtgatgtcgcacaaaaccaggctatttggtgggtcttataagatcgtgccattaggaaccttgaataattggagagtggaagcactagcctaaggagatacggaaagcattttgattaaacagattttagtatgcaccaagaatgtacactgagccaatgaggtaagggggacagcttacaaaaagttaaactctcccagattcataacaaatgcaataattttatacaataattacattcgatgtgaatatgaatagcatataggcaagtaaacatgatatgatcactttccccagaaattgtaaaggaagtgaaaacccaattcttccaagccatgtttcatcacggccaactcaaagtttgtctctcttttttcaccaaactaacctaacaattagcagttagcacgacatttgccatgaataatgacatgcaccttttatgcaactaaagacaacacatcacttgctcaattccaaataacaaagaaactctagttttcaagtgagagcctcctctaactactcaatcaatcaagatgcaacctaaaaaaaaggaggaggaatgcacaaagcaaaacaacaatcctcctggggctcgcgcggcagatcggcgcgcattactgctccccgacacgcgcacgcaatggcacgaacaaacagatcaagaagagagggggggaaacgggagaggggctgacctgggtcatggccgccgcggcggcggcggcgaggacgccggactggtactgctgctgctgctgcagcgcctgctgcatcaggagggcctgctgctgctgctgctgcctgagccgctgctgctgctgctgctgctgctggtggttcccgccggcgccgttcatctcctccccctccgactccgactccgactccggcggcgacggcgacgcggcgaagaccggatcgggaccccgggaaccgagggttcgcaaggaacgatcgacagatcgggggaatggatcgagcggatcgagagattccggggcgaatttcttgcggggatcgagctagataacggaggaagaggaaggtgagatttttctcgttttcttcctctctttttttcttttcttttttttttcgctcgcctctgttttttttctcctcctcgtcgagctccaatggaggttagagagggggagggtaagttggggattttcccctgtgtaggagtctaggagatggcatggaccttacactgacaggtgggcccggtttttttcccctggctctgaagcctgaatctgcatggtcacttgtggtcaggtggtcaggttaagacttaagaatatggatgtggtattgtggataggtttcaaaaattttaaaaggaattcgctatagtaggtaatatttgttttgtccaaatattacatatttggttcatatttatcttaagatttatatacccacggtggatagggtttgatgtttggttagacggatgtgacatacctgtggtagatctcagctcaaattgggccagagaatgagattttacgaaagaaattatattggaatttacttagggaaagataaatttttaagtcccattaaaagatgcttgagatgaaccatggctctggttttcaaacgattcggaaaaatttggtcttttgcttttcacgggaattagagccaaattattacatgatttacagcacattcgtttacattacaaagaaaagagaaagccaacatagttcgaatgataagacgttgttaaaagcaaatgctattgctaaatccccatccataattagcaaaaggttgcataatcatcatatttaggtaacagcacaagtccgatatcatttgtttgtcattttcgcacttttgcaacatggcccaaaaccaaagacaatgtgtgtctcttgtaaagtatctacatataaaatttaatagaaaagttatccgaaatcatctcattgcgacttaaccatatagcctagcatattccagatgtcccggctaatattgtctctaatgatggtgatatctaaggtaggattacagtgtatgattgcttatttttgggaccaacttcataaacataggttaatagattgcattaatgatttaaagaagaatgtcaaattacttaaacatacatttactcacaaatactctatgtctttttcatgtagctatatgtcttttaagtctagcggatgaacgcaacaaaagatgttatcatcccataaatgtgatgcatatgcatacatttttatcagtactaagggcctgtttagatcccctggcaaaattttcaccccgtcacatcgaaatgtttggacacatacatggagtattaaatataaacgaaaaaataactaattacacagattgcgtgtaaattgcgagacgaatcttttaagcctaattgctctatgatttgacaatatggtactacagtaaatatttgctaatgacggattaattaggcttaataaattcatctcacagtttacatgcgaaatctgtaatttgttttgttattagtctacgtttaatatttcaaatgtgtgtccatatattcgatgtgacacgccaaaactttacacccatggatctaaacaccccctaaactttttatatgccatgttataacctcaatacatatttatccaaataataccttaaatattccttaaaaaaattatccaacgtcccaaataacggaactaggtattttaatgtcgaaattttaccatttggttcaaataacaacctccttactagtgtcttgcggcattgtccatgtgatgaatgagtggtttttccataatattagccagtttggagatagggcatcctttggaatggaaaagctcaactggttaggttcattgtggtggaacctgtccacccgtgttcaagttctagatttgctcgcatttatgactatttattcttcagtgatagatgatatactcatcgacaacaagacacccgtagtgacttcgtcaatctcaagatatgtcagcctagtcttccagaggttctcaagatattacggtcttgtttttcggtgatgctcatagcaataggatgtgcgttcgtaggggtgttctcattatatgacgacctagtttttcggagatgctcgtagcgatagggtgtgcgtttattggggtgagtgtgcgagcgttgtgagcgtctacgtatgtaccgtatttcaaaaaaaaaaaggaattttctaagagcaattttatgggaatcaatccagattatgtaaaattcatgcctcccaaataagctctaaaatttgaagtcacacctctcccgcgattcatggatccatccaatatagtcaccaaaaaacgaagtataatcttccaattccaattccactcttgtcattgttggtattaacaagaaaagtacatggcaccaacacgaaaatggcgatcgaatatacctctacaaactttaaatgaacaaacaatgatttagatagctcacaacatgaaaacggcgatccaatatacctctacaaactctaaatgaacagataaataattcatctggatggctcaccaggggcctattttacaacgaaacgctaacaatcagtgcatcctggtgatgatgttctgatcgacaggtgaaacaattgtttccatgattctgggcttacttgcttcacatgcttctccataacatcacagcagataccagtaagccatattatgttttcaatacaaaatattgacactcaaacaataattgctgctgctccacacatgaacaaaagtgaaattacacaacagataaccagagaagaagaatgtactcctgcccagtatgtttgggacaaccagttttcctcttggctgctgatacgccatatttccaccttaagcttaaagtctttttaaaaagaagggaaagcaggtccgttccatatggtgcagataaataatgtagtgaacaagggaaccttaggaaaacaacggcacagtgcttaccccatattaaccttggaaagatatattttgcaggacaatgcatcgacaataccttttcttttctcgaaaacatcagcaggactcatatggaacatgttaagcgaaagatgatctgtagtatatatttttattttgaaggtattaccaccaatgtcaaagaccagtagacgtcataatgtttcagaggcatgaaaacaaaattattggttgaagtggtgtacaacaaaatgtaccgtgaaaagaaattcaatagctaacataagaagtctagcatcaattttgttttttgagaagaattcagacattaaggctaaattgatctaggacatgacaaggtttctagtgtcttcatgagactgtttacgtcgcataatgtttaaaaggacagaaaaatcttcatgcacatatatacctgtaatatgataaatatcaagaggaaaccatatcgttttagctgttattgttgtactcagatgctctcttcttttagatgtcagatgtatcattttgcattgcattgacattaacaagatctgtttggcagaggtgtgctacatatatcacgacaaaatattcatcttgggaagcaagcgattttgtaatgatatctcaattgttgctattacctgttcagttaaataagatctgaaatacagcagtaaatactcaggaagagctgaggaatctggggtatcaaatccagtggctggctcaaatggacttcttcatttgagataagaacagtgaaatactatagccgtctgaatagtatgcaaacaaatccaaacaaaataacttctggacagatgttgtggaggccaattggagcaacaatacagtgacttggaatgtcagattctcgttatgtgttccaaaaaatccccagctaatttcctcaattttgtcagaacgcttcctgaactatcagcaaggatagtttcaactggtgacactgtggcaacaaggacaaaattttcaccattactgacatttatttcatacaactcagagaagacatggcgaagaacatcaatcaaccctttgtagaaggatccatctgcagcaggagggataacattcaatatgaaagccccatcacgatgtaggatcgtgcgtgaagcaagaagaatgctttcctttgtcatctccaacggtggtgcactgactccacatatagcatcagatgaatcaagatccaccataatcgcactgaaattcatatcagggtccccttgatgagcaaaatcctggatcatttgaatagcatcaccaacacggacttgaaggaactcatcctctaccaatccaaaatggctccttgcaacatccagcacaacaccatcagcctctatccctagtacatcacactgaagccccattctgattgacatcagaagagcgccgccaccgataccagcacaaagacacctcggcttgccacccaaccgaaagctctcatccatggaaggggcgatcaccgcaagaccagcggccattgcctgtaggtaaggctggaccagctctccacccacctcaggctgcaatgaaccacctccaacctcatccaatgcatctaacatcaaagaatcacccggcgataattgccgcacaaggcgcacctgcgtctgaacaaggaacggcatccgcttgaaccgcaatcggcggcgcaattcagccgaacgtggcgcgcagtcgacggccacatcctcaacaaccatctcaccaaccacaggaccagcgacaaccttgacaggagcaagccggaggaggtcatcatggaaggagagcaatggcacgtcagggatagcatcgcccccaaacgcggcacgggggcatagagccaggaggagtgggagcagccgcgcgtgagcaggatccgggtccgggcgagcggcggcggcgacgaccaccacccgagaaggagacggcgcggagagctcggggccgacgaggatgaggcgggagaggtggctgcactgggagcgggaggcgaggaggaggtgcaggtggccggcgcgggtggagaagatccagtcgcggtgccgccccgccggcacgagcatcgccgccgtgcgcggcgacgggtggggtgaggagtggtcgagaaccgccacgcggaggaactcatggccgccatgggcgtacgggtcggaggcgtggtcgaggaggaggagagggtttgggaaggagaaggcgatgaagcgggagggctccacgtcctgcaagccctccagctccgagctgaccgccattgcagagagagagatctcgagcaaccaagaaacccaagcaggaggagcaatcgcgcgcgtccaaatttctcgacgagggtttcgtttctcctccgattgggggagtatcgcgaagattctaatggcggggagagagggttgacctgagattccgtcccgtccagccgccgccggcgaggaagtcgacggggctcgcggcggcgccggcgccggcggcgacgaaaaatcgcctggagctgtgagctgagggtttcctctgtcactgtgttgtgggaccactaggtcagtgagaaacaaatatcatatgatatatttaccgttcttaaattaggtgtatttgaccccatgttttgagtattttctatgttcagtttaaaattatgttcccgttgatggaattggtacagtatcttccaaaatccattcttcggaagaagattgtaagcagtaatgcttattaacaacaacaaaggaaaattatgtaaaacttagtgtatgtgatcttagcgatttaaaaattaatgctggaaaatgaactacgataaaagaaacaaacaaatctaaaattaagttttaaacttcaaatattggttgtggctcataagatgaagagcaaatgataaagctgttggtcatctcatataacgaatgaagtcaggcagcatatgatagaaagaatttagagaaatgacatgatgaaaagtcccttagcaatatttgcaataagaatttggtactaatttattgaaatatttcgtatccccaaatgtacaactcaacactagctcccaaagactgtagaaaactctcatacaaatacatgatcagcgattcctcatgtataaaatgttgtttttttttacccatttagatctgtaacagcttacagatggtgatatctgacaatctccattctgcagcttatacagcagcaatatatacactgtagtatagacatatggacgggctatacaagagggtaacaaggccataaaaacatacagagaattagcacatctacaagactgcaacagagacaatagtctgaataatggagtaaacttataaatggaggcttctgggcactccaacacagccttcctcttgtatccatatttattgagttttcttgtcgataaatttactgtaagctcaaagtttcgaagccaaaattatcattgcctactaccatcctttgcactgtcatgagactaacagtcaaaaaaaagtcggtcttgaggcgacagcaactacagtatgtatgtaaagtgggttttgatcagtttctacattctagtcgccggttatcctccagggatgacccccatcagagctgctgcaagcttggttgggtagaaagctgtctccaaagtcgccgactaatctcatctgcatttcttcctgtggagaaagaatcctgatacatcgtacacatttcacaaagtccctgcacatgcaaagccatcggttcttagttatcaccgtgatacaattagaaatagctatactttgataggtgaataagtatgatcagttgaaaaaaatggagcctcgttatatttcccaatcaggtaagtggtgagatcactgcagaaaatatgcttgattggttttacgtaacacagagttgcttttagagtctctctacatgttttaacaggtaaagtaaatattcagctggagttagaaaacattctatggcatgtgaaactaacaagcagggatgtacagatctttgcgtgttagtgaaactaagctcacaaacaataaatccagaatctatatgaagttgctccaagatcatgttcactcaaatcagctaaccccatccatgggtttatcttcggtaaaaaaaaagatccacgcctccagaaagatattattgttagttttgtatgtgcagatgaaaaataagtttatgggatttgacttactcccatggatcatcaccaactagtagaacatccttctcgtgatcttcatatactagcttccagccaactctattttgatcaccaagctgcccctcaataccaaacatccgagcaacgtcatgtttcagctcatcatatccagaatatcgattgatgtcaattgatcttcccaccgcaccacgcttgtgtacctgtagataattattttggtcagcacaggtgtccactgcaataatcatcaacatgtgcaattatttcatgaatcttagttaagagtcatcctaagattgtaacttaactcgaaatttttttctaaaaaagatggtgtaaagtaacaagttgaggctaagctagataacaaaccttggtgtaggttctcatccgttgatgtgcaggacctgctgcagaccgggaatttctatttaagaatggggtatcattgattgcagaatctatagaattgaatgccatatcagcaactccaaatgaatgtgaaatcattgaagatgataactcttgttgagaatcctttgatgaaatgaagttagaaatgccatttcctggcaactgatccatgtatttatcggttccaatgtcattcgcaagcaggtctgcattaagtggtaaacccagttgaccatcaatattcaccccaaatagaaggttatttcttggatctgtaacctcaaactcgctatctggaactgtgtcttttagcaagtgatgctggtggaaggatgaaggtggaaagttttgttgcaatgatccatcagcctgggaaaggcaaaccgaagtagctgaagaggatgtgtccaagtaatccatttgaggattgttatttatgcagtcttgtccagtagctggcctttgttctgtcgtcttgggaatcataactgtttgctttacattttgatatggctttgtgtcctgttcgatcgtaggacccaacacaacagatgattgagatgtctttcctgctgtagttaaactttggttcttggagctacttgggatggattgcagaagaacaggattgctgttagtggatggtgatgttgaagtagacggaacatcatctgtcttcaataattggcgtccaccagctacatgcaaagaactagcacccatggaagtagcgatgtctgattttgaattaggaatgacattcccagttaagtcttgaacttggtgagactgaaccttttgctgtgtcgggtattgaatagtgttactgttatgtaaactaatagcttggtttgttacctgtacacactgctgaggagctgactgtgaatttatcacttgctgctgcaaatccaaaagcatcttctgctgctctgagatcagaggctgctgtggctgtaaagccttgagtagttgtagtttcatttgatgatctgccacctgcgtattcatacttgcatccatggaaacatgaacaggttgtatctttatttgctgatgttcctgtactgactgctgaacctgctggacaggttgcaactgttgtgtttgctgctgctgatgatgtaactgttgcggtatctgctggtgctgcacatgtggctgttgctgctggagaagctggatttgttgaagacctccttgtaagacagtgtgactttggaccgaaggttgcgtttgctggagttgggcctggacaacaacttgaggttgctgcagttgcgcctggagaatgacttgcggttgctgaagctgagcctgaacaacaagctgaggctgtggaatgtttatgtttggctggctgccttgcactggttgagtaaccacatgctgcctttgttcagagttgcaatcctgaaccaccttctgcggtattataacacttcccaattggtttggtgtagggataactttcgctaattggtctgtctgtgggttttgttgaggtaccaacgcagagatgaactggatgttgatttggtgcaagaactgcgggtgaaaactgatttgccttgataaatcagctgcagccaaattttgtacaggttttccacttaatgagtgtagtaactctggttgcacaaccgtgccaagaagcgaggagctgtgctgcatgttcatccactgagctagatttagaccaagcactacactgttctgaatattcagatctttcttgcaaatctgctcaccaacccatgggatggccctcttgagaagaccgtccatttcagtctcgtcatctacagatgtgattaaattattataagataatgaaatcataattttctgttagaactgatattcagtcgaaaactttggttacacaataatcatagtctgatatgagtactaatcatccatagagtgaccttttatcagatcagtaactgtttacctgtcatcccaggtagccttggacgttttgcggtgaataatggtgaggggtagatgaagaatggagcaatgataggctctatctcccagagggaaaccctggtgcgtctctcagttggtgccgcttcatcccatgcaacctgcatatagttctacttattccagcaaaaacaaaggagatatagctttgtaaggaatcagaccaaacccgaatattgcgccaatgagatgttttccaccttactggatccagatcacttataccagttattgtacccatgtacctgcaaggaagatgtcacaaatacgattcagaaaagaatcttataaaacatcacacattcacaagtgcatgaacatgaacacagtcaacacagagagctgaatgtgactcaatgcagaaaaatgatgctcccaaaatatcctaagtgtgcacaacacacaccaaggatctttttaggtccagtctgtagcagggtccctgtgggagtcaaggtagctcgatatccaccccttagaggggggtttaggataaaaaattttcaactaaaaggaatttgaagtaatgagaacaagtatatgttacacaaataagataaagttcagaaactataccttcttgttcctgactcttcagtttcaaacatcattctgaaccgcatgccaagagataattggttaccatacactgccttctggtatttggcaaaaggaatcacaaattcggaagtactggccctgaataaacaaaaaaaagttcaaacaaaactaataacatatcatctcttcatacgttaaacctagccaaagatgtttaccttgggttataatatattgtaaattggctgttattcgctgcagcatgggctgctgcagcaagaattccaatatgcatactatcactagataagacagatgatgagaggttcgtaggttgcctatttgctcgtctgatccccaagaggagctgctgttttgcatccctatggtcggaatgaagaaagtttagtactccctcaagattgatttgttacagcaacattttcaagcgatagcgaggcagaaaaaacagtttattggcataatcagtgtacctaataaacaagactgaatcaccagcaagtaatctctttccactgacaaataggctccagcccgtagtcagtaaatgccttttaggctgacctggtgaagagaaagagaactcataaactttgagacattaaagcatgaagtaacaccagagtttcctgaaccttttagtaaccaaaggccaaagctgacatacggcagttgaatacgggtttcgtttacaagagtaaggcctttactaagttgcattagcttttatcatgcatcaaagggaacaacggaatattagtatttttctactgtaccccggtatatatgacgaaatgtccaaacattatcatgcaaatcccgggcctgcagttcctgggcaggaggctgcatggagaagtcctaaacataatacagtgcgcataagttagtagaagaaaccaagaaagaatcaacactttgttttccataaggttaaagtatgctcacaagacgaggaaaaatcctctcagcggcacggcgtggcacagagaaacctccatgagtgcttgtatcactggcggtcagtgttttgcaaaagaattctgtttgtggcctggtttgcttcagcgcaagctctgatgctagcaatgtctccttgtcacactgggtcacctaataatcccaattccaaaatcatgtcggtactgctacatcacataatccagaagatctaactgaatttgggaaattgcaacctacattgctaactggctggagagtcattcgagcataaacctcatctgtgtcaggatcagcctgtcatgttttgtcaagaaatgtgtcagtacagaagttcaaattattggcataatagagcactaataaagcgtggagctctttttctgtttactgatgctcaaagtggcagagattacaagcatggtgacactgtggaggatgcatatcagctttgatggaagatttggatagcttggaatttgcgcatctgcgtcctttcgcatagatgctgcaacctgaaatcgggtatccaggaatgagaattgttctccatgaaaccccaaaaccacttgcacaaaacttgcacatttacaaacggtgtgctagtaactctcaaagcttttgttaactctcatcatagaacttgtgtacagaaacacacatgttttctatatcaaactccatggtaaaacagaagcaaccaagtaacatgagcacttttcgtttgggttgattcaaattacagtgccgtataactgaatttgctaagaactgaaagaagattaacaaaagttgtatgttcgtagttgaaagttgcaaaaagattaaagttatctgcagataagattaaacaacatgtaaaggagcatcagaaaaggaagacagattgggaggatgcccaactccatgctcctccagcattgcatcaaatggcaccaaacctccatgacgcgacgacttaatctcacaaagaacaaaagcaaagggaagtaaacaacacgagcaattagacagtgaattaattcctctctgaaacctcttcctttatgaccaaaaaaatcgattcccaaatcttcctcttatgagaacaagaacaccgagaaaaccggaatctttttttccctatttctcgagaacaaagggaaagaaaccatttggatatatggccaagatcaaacgctcaagaaccaattgacaccggacacggaaccaatcaaccaaaccacacaaccgcaaagagagagagaaaaaaattctccgccgcacgcggacatgacgcgacaactaagagaagaaagatgaaaacgaaaaattcacgaaaaccacaatgaaaaaacaacaagaaccaaagaaagggagaaatctcccttcatccgaaatgggggaaaaaagaagaacaaagcaaagcaatcagcagcagcagctttgatcaaagacgacttcaacaacttcacaagtcgtcgtcgtcggaagcagagagctcggcggcggcggcggcggcggccgtacctgctcgctgtgaccctgggggaagtagacgatgaggctcccctgcggcggcagcgagacgagcggccccgcgcacgcgtaccacagctcctggttcaccttggtcgcccccc

SEQ ID NO: 22123 - DNA, 2773 bp, Oryza sativa
tgtggtaaaggctttggccatttcacagagtggcaatagaaggcttgggggtttttggggtaggagttgcatgatctgtttgtacaagttcatagaagttcactttggctaccatgtggattcttccccaccaccaccccctccgccggagctcgccatcgccgccgccgtgtctcccgagctcagtcaccgccgcctcagcctaccgcccgccggaatccatcgccggatggatcgccgccggcgaggaggaggcgaatttgaggagagaacagaagagactcggtagcagcgaagagaaaaaaaaaagtagtagtaatataatagtgcagccgagctaagcttactggccactgtactgtttaagcatcagagttaatttaatcgcaggctataattaattaattactctcgctaattaatcaaccagaacacatctggggaatggggatttgcagctgcaggctgcatcacgtgtggagagggattctatacgcgaaattcacacgcgcgagcgtgcgggtgcgttcgttgcgtgtgtgactcctatgaattctgacgaaagtctgaatacactgctccctccatcacaatgattccgttcttttctccaacaaaagttagacgaagattaatatttttatggcacgattttcaaactgctaaacggtgcaattcgtgcgaaaatttttatatgaaagttgctctaaaatatcatactaatctatttttcaaatttgtaataattaaaactcaatcaatcatacgttaataccacctcattttacgtaaaaaaaacttaatcttcatcttcatatttatcttcagaagaaaaaaaagccacctatacaaaactaacttctgactatacgtccagattcgtactcagaatttgattttttatgggacaaagagagcatctctgaataaacatatgggagcagccattcgttttgccttttcttcgtaaagattactaattaatgatgggattttaatttattttgtatactatccaccttttgacaactttgtttcttttctactacctcttttgatgtttgattttgagaagagagggaaaggtaatttgcagtgtatagcatttggggcaattttatctttctctttctctatttctttttgcctactttagttgtgcttctttttgaactcggcttttcagaagttttggatgcttttcagaagttgccaagggagacttcagaatattatttggagtttaactaggtgcatgcatgttggcatgtactgttggtaatatagtgccaattccttttctttttaccataaaaaatggatgataatatgctataatatgataatgtggataatatggatgataatggtgtattacttacaatttggagtttttttttatggaactcttcaagtgacccaaccatagtttcttcttttttttcttttttttaaaccacatgtgttaggcaaagctaaaggatgaagagaacgcttaactactgctactaataggactccaccttacgtgatactagtttcatagtgttaggcccagttgatagttgattgaattagatgtgtatatatagatattattcctttgggataagaaaaaaaaatcagcaatatactcttttcatgcgagtggggtttataaaagatcaaaataaatcgggacactagagttaatattattttgaggaaacttaaaactccattgctaaattgcttttggctctgattgttagagttatggctaataagctgtgaaaaaaatgagcaaagtaaccttatgagtaaaatttttatatgtgtagttatcattgtctattccaaggagtctctacttggccagcttccttagttcgtaagacaagccatcaaaaccgtgcgacttgtgggccaacccctgtttagcttagaccaagtctatggtctcatggggaggtccatgtgtccatcctctgtctagaaatatccttatgaaggttgaacattcgattatggttggttcagttgatgtgggtcgagatcgtgcccctagagctgtttagagacaaacacactttcactatgctagcgcgtaagatatgatagctggctgcatggtggccaggtcatggcgtttttctatgctagagtccatgactctgcattgtccgggactgccaggtatatcttgcccattgaggtcgagtagagtaggcatgtcatcccttctcggagtccaccatgtaatcgtacatgggaaggaggatgaagaccctagactctaggtgttgtatcacgagcaccccttggcgtctcatgacaggccaaatagtgttcatgagtgccgaagatgggtgggtgtgtgtccaaatgggcactacatcgcctttgggaggaatgcataggccacatagtccatccatcatattaactacatattctctcaagttgcctcttagcattaatgatgagggataatgtgtattgaagactcaatatctcttgggagtagctttttaggctcacatgagagaataaggagactacaagttagtccagtgtggattcctaggggagattgactgctacattaaatatagcgaggagttcaaggaattagttcggacttatgattatgtacaggcttttttgtttgtctctcatcaaggagaaaaagagagagcagggtagttgtagggtataaaaacccatcctaaaccctgtagaaaaggttagacgttaggaattggtaagaacaccagtcttcctaagctagttg

SEQ ID NO: 22124 - DNA, 7946 bp, Oryza sativa
cagtcttcctaagctagttggagagcatccagagcttgtacgagttgctttgatagtgacgaataacatgagtagatttgctatcttcggaagacctgaacatgtgtacgtgcttgtgttctttcttattccccgagcacatctggacacgccgtcagcatctagaaccgtacccctggttgatcccgatttatgatttttcacgtttgtcggtgttaatactggtttaaaattaaccaagactaaaaaatggaccgataaaacaaacaccaaaattaaccttaggattaaaattttaaaattcaaaatttgattgtatgtaaattgcaagctaaggtacaagggaaatccaactgaactactatattgttcaaactgagtttattataaactactctatccatcttaaaatataagtattcatagtattcaacaaaattaattttagggtattgccttcttcaccgactatacctgaactggccctcatttaactttttacccaattaattttaccttaaaccccaatcccactcgaattgaatgacaaagggagtaactaatactacataatcgaaggtctcccataaaacgagccacagagatattatatcaaaatcattaccatgactaagcatatactgaacatgattgcatatatatactccatatatggaattaattgaacattagtgttattcatgcgcgattagatagaacttagggccatgctaattggctgctagctagctaaatagagctagagttagctactaattacctactagctgtttgcagcaagctgatagtgcaaccttagctactagagctagtggccttgcatgtgttgatcatcatctttactctggaatatgcatatccagctaacaataatgcatatgcattgcgtacatttgatgcatggctaacacaacgatcgatcgacgccgctcctactcgatcgtttcaccaatgaataattcatgatcagtttggctctttcttccaagccttttaatactatagcatgtagtatgagtaagagctactttctgcaaacccaagctcatggaccatgcgtgtactttatgttgcagtgttgcagctaattactatgtctgtttctctattgattttttaaataaagtttaaacatttgtcttatctaaaatttttgtgtaaatatacaaacatttaagtcatacttaaatacttaaagaacatttaacgataaacacaataaatgataattacataatttttttaataagatgaattgttaaatgtatctaagaagtcaacagcgtcatacattaaaaaagatagagtagttgatatagactagtacttcaaaattgaagtatagcaactacaaaaatccaagctgcattgcattccgcgcattcatccgccgaccgatcgatcgatcagcagtgatgggatgcaacatgggacctcttgcttgatgaacaataatatgatcatcatacgccggtgccactacttcttatcgtatacacactcgtccataaattaataattttcatcagactagtatataccgagttgtatgtatgtgtatgctgcctgattaaaaaggctgtcgtttcggacacaggtcaaactttcaaagttaagcaacaaattaataatatatatttataaatatttggaatattgcacacattcttaaagtcccaagcctccgaggtaggttcatatgctatggacttgatcacttgattagaggaacttcatcccaaatattacatactcaccgttgaattcttctttacaaaattcttatctagattccaagactaggtaagtacatagttaaaataaaatatagtacttcccccgtttcacaatgtaagtcattctaacattttatatatttatattgatgttaatgaatttagacatatataactatttagattcacttttgcttccacccttatgttatgatgcgattaaccaccgcatctacttgagagaggatcaaatacacaagcgtttcattccaaccaaatattccagataacagataacggggggatgagggagtcgaatcattttttgaggtgatctcggtgagagcactcccattagatttgaagtgccggccattgactagacgaagaggaaggaccaatttgatcttgaccaacaactcgtgccatgccaatgcttgtaaaaactgctaccgatcgagcttgatctcatgcctggattgattgaaaccagctaattaaacacgtgcaatataattcagactctttaaccgatccaaatcttggcattgtacatgtaatagtacaaaatatgcatggcagatgcatgctctggttggccacatgatcgtcgcgaaacgtgtgatggacgtacggcgatcgggtgagatgggatccccacatgcatatcatcaccgcttcatccgcctccttctttgtcctcatcttaagctaagctaaactgagaccatagagcttaataattgatcaactatatatacatctatccagtgattagtagttcttgttgttgccagttgccttctcttcagatagatagcgagatttgatcgatagatcgagataatgattaacttgtacatgcaggtgatcgatgcgtcctactactagtagttaatttctccaagctattttcaattcaaagaaatagtttcagcctctgaataatggaagcaagcggatcaacctgatcaagacgattaattgcatcataatcaacagagagttatttaagagctagctatttttaggccttatccgtaggctgccttcacatatatctctacacatcgagataacaatttttacagacaactaaaatacattaatatttgtgtagagatggtagaaccaatcgtctcttaaaataacacatgaaaattatacgtctccagtttttttttcacgtgaaagtaaccagatatatagcttgtttatttctagctatttaagttcatattaaatcattactctagtttactaatatattgacgtacaattcttttgcacgttcgggaaaagaatcttactctagtttagtttacttagtaattaaataattagataattaatatgtcgagacttctggtaatttttattctagtttctccactgaccagcgccatatgaaaaacaatttccaactacgatcggcttaatgccatctcgagcgaaaaccatctccacatgtgggcccttatgccagccgttgccacatatatttctttcatcccataaaaaatcaaaatagaatacaaaagcacatccaaattcactatattaagatatgttatatccaatcctatgcttcttttatagagggagtacataagaccacatgagttgcttgtttacactgataccttgtaagttgtaatgtaagttcatgcagcttagttgcaagatatatttgatagcgcagtgaaaaggggtgtgtggttttaaccttgagatcacgtgtttaatatttaacacgcttataatttttttagaaaaaaaaatatttggagagacgattctccctcgtttttatgcagctcagctgccagctcgatcgactcgaccagcttatgcattcagagatggacgatggctggccgtcatggggtcctcctgcagctgggcatggtggttgcgtcgttgcgagcattcgatccgatggggacgacacattgcgccgctagggcccccggatcgatcactgttcatcgacgtctcgtcggcacctaccaatcatcatcatcatccatcacacattcattttcgcagcaaatctctgaataattcagcagcagctcgatccatccatcagatcgcaggatgaagcatgtcatcgatcctgaatttagcctgacgagactgcatttctgtttcatccatactactatatgcaccggcgaaaactatgcaccgtgtacagtgtacagcgtagaattcagagttcagagtctcgtatcctctcactgggtgttaactgaagaatgttctcttgcagtgatagtattagttgttggcatgaacagctaggagtaattaatagagatatgacgagactgcatttctgtttcatccatgcaccgtgtacagcttagaattcagaatttagagttcagagtctcttttcccacaaattttgacaatttgaccctttgcaaaaaactatttttacaaataaaccgccgccaaaacttatttcaaatctgacccttttactcaacgccaaatcgtgtggcgctgaatttagacacctcagcgccaaatagcatggcgctgaatgtacgttggcacgctgacttagtctcccatccgcatggcacggcattcagcgccagctgacgtggcgctgaggtgtctaagttcaacgccacatgatttggcgttgagcaaaagggtcagatttgaaataagttttggcagcggttcatttgtaaaaatagtttttgcagagggtcaaattgtcaaaatttgtgcctcccacaggatgttaaccgaagaatgttctcttgcatatacagtgatattaactgttggaatgaagaattaggagtataattaattaatagagatatgactgagatgttatccactctgacgacaaatcatcaggaatctgtcaaataaagcggccggctatcctgatgaaccctagaagattttcgtcgctggaattgaatctccgggcactttgatcagcaaaacctgatgtgatgccaaaacgagcaccttgtcggctccgcggtttatgcgattggacatcactcacgcttgatagatgagataatgcgtatgctttcattagttgttgtactgcagtacaatttctactcagtcatgatatcattatgaatgaagctttgcattgtccaagttttttttttttgcagataaatgcatttgttaagaccagtgcgaccgatctgaggacaagaattattgcccattgacattgcgaatggtagtgggcaaacataattaaatgtttgttttttacaaaaatatcatacaataattttaattagttcatccttacagctcatgttgcctttttttttgtttttactgtttggcaaaagaattgcacgttactatattagggttttgttgtttatactaaatatgttcatgagtattttagggcctgttcactttgatgccatttttaaccttactaaattttagtaatgttgccaaaaagtagtttgctgcaaatttttggtaactacataacaaatcctgctaaaattttggcaagacaatgtcaaaatttggtaaggttgaaaatggcaacaaagcgaacatgcctttaaacttttcaatagtttacgcttttcgtctttttgttttaaaatatagtaacatagaacacgcaattagacatcagctaccattacaaaagatatattagaacaaaggacatctttactctctctatctattatattattaaaacagctttgaaagaaggcaccacgttcgctgtggaagttagaaatttccacattaatcagtgaaaaagaaaaaaaaagaagagtccaagtagaagtacaatctaaaaatagttaaaattaggaattaaaaataagcaatattgaaacaagttttcatataggaacccaatacgagattaatcaagattcaaaataaaaataaaataaaatccaaaattagaaaaggaaaggagagtccaagtataaatacaattaaaaatagctgaaattcagaattaaaaataagcaatgttgaaagaagttttcatataagaacccaatacgagattaatcaaaattcgaaataaaaataaaataaaatctaaaattagaaaaggaaagaagagtctaagtagtatacaatttaaaaatagctgaaattcggagttaaaaataagaaatattaaaagaagagtccatataagaacccaatacgagattaattaaaattcagaataaaaataaaaataaatctgaaattagcaaaagaaaataaaagacgagttcaagtaggaatacaatttaaaattagctgaaattcggaattaaaaataagcaatattaaaagaagaatctatataagaacccaatacgagattaattaaaatttagaataaaaataaaataatatctaaaattagaaaaattaaaagagagttcaagtaggagtacaattttgaaacaactgaaattgaaaataaaacattaaaacattaaaataacacaatacgatattaactaatttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaatgacaataaaaaagggaggcagcgggcgagccgcagaggagtacgatggtaaagctgctgacggtttggcgagacttctagaaagtaaaaaaatgaacccaaacgataattatgttcgatttttaaaatctcaatgacaacaaagagaagagatagtggacgggccgtagaggagtataatggcaacgtttgacaggacatctagaaattataaaaatgaaatccaacgactctaaaagctataaaatccaatttttaaaggttgcaagaagaatgaatagaaatagtggtagatcgagcaagcaaataaagaaggagatgacataaggggtagcaactggtgtgacttttaaaaactacataattataaacacgaggatgataagatttggaatttcaaagtctcatgacaatgagatagccagatagctattttataaattttaagtaaaatcatactaaaaaatattatgattttgtttgggtgctagccgcgcaattacgcgggccagccagctagttaattatataatataacaatataaaacacggaattgacattgtggaacataggggtcggagtctcgaaggtggctacagaggggaaggcaaaaggcccaccaactgcacggcccaatacctgaccaatcgaaacccaacaggccaacactgcgggcaatcccgttccggcccaacttaaatgggccgtccgtaccacggcggagctccggcgagctgccacggcggacgcggagggattcttcgggatcgcagaatgttgggatcgtacgttttcctagtactgaattcaaacaattctcttgaatctgatccaaattcatctctatttcagttgaaaactgatttctacagtacagcaacagagtacacggggtgaaaagatttcccaatttcaccaccacatcaccgggctcgcctgcccgatcgccggcagctgctgctgcggcggcggcatgcagtgctgcggccaccgccggaacaggtacccctcgccgcagccggccgcggcacc

SEQ ID NO: 22125 - DNA, 6742 bp, Oryza sativa
cgcgcaccagccgcctcatcttggtcgcgcggcaagcgagcgggagcccgccgtcgacgtcgccggggcaaatgaacagctcaggctcctccccgcccttccttttcagcgtcacgccgccgccgggggactccacgagcaccaccatatcctgctccactaatcaatcaccacgtcgctaatctcgccacttaatcccggtgcactcgaaggttaattctcgcatcgcagcgaaggggggaagcgaaatggcgggagatttatacggggctcgtcgagagaggagtggacgagtggagaagaagaaggcgaggaagaccggagaagcttcggttccatctccggaagcctctagaatgcgcctcgcttctcgagacagcgacagcgcgtcacctgggcggcccacaaggccaccattctgggccggatgggtgatgggccgaattggtggtgggccgaatggcggaagccgaggaggggtgtcgcgcgcggtttggccgtgtgaggtgggggtttgagtttagtaccacctcggcgagcgaggcgggtggtggagggggaggtggctatataaggggggttgggtgtgagggtgaaaggcacgcacctgcgtggtgagcacaaagcgaactattctttcgccttttactaaagaataccgtgtgcgcgccacaattagcagcatacgctaaatttaaatttaaagctttgttttactaaatcttgaaatgttttggcggaaattcaaagctttcagccgtgagatgtgccaaatgtttttaagtaattgtataactctgaaatgctcaacgaaagactacgggattaacttgatgatttcgagtttgaattgattttaccaatgcctgggattaacttgatgatttggggtttgaaactttgaattaattttaccaatgctgatttggggtttgaattgattttacgcctgaattatcagatatctacaatcgctctctgtaaatttggtttctatagaacatactacaatttatactccactactgttttaaacctggatttcctctgaattaaatttaccaatatctgcaagttttcagaatttacagtgataatcagggaagactcatcgtgtcagagctactcctggtcacaccggacgaggcggccgcgtttgctgcacagcgcctgctcgccgccggccgccgccaccacctttccgtagctgtaccggagcggcatccttcccagcagccggtggaactccgtgatgcaatcccctctcttctcccagtgcgccgcgccccccgtcgagctcaggccgacggccttcatctcctcgccaccggcgccggcgccggcgtcggcatcgtcgttcctcgggtcgccccagtctctgatgctgccggcctccaccagcaccggcccctcgccggactcctcggcggcgacgaagttcatcaggatgtcctcgcagttgcgctcccggtccaccacggcgcgcgccgcggcgagctccggcgagcaggagtactcgcggaggaggcccgcgccgagcacgaggagcttggtgagcaccatggagtagcgcgcctgctgccgcgccgccgcgccgtacgcccacctcccgcgggccaggtcgaggtggtgggacctcgggaagaacccgacgagggtgcccgggcgggcgcgctgctgtcaggcggcgaacgcgaaggagagcgcggtggcgtccgggagcacgtcgtcgtcggcgacgccacgcgcggtgcggatgacgggtcgggaggaagcggtagttgagggatgcgaaggcggtgcggtggagggtgacggccggcgggaagcttgacaggaggctgtccggtgtggaggggttggaccagagcacgactacggcgaggacgagcgggtgggcggcgtacgctccggcgatggcgcggagcagcgggagccgccgctccgagtagccgctcaggagcaccgtgagccggtccggcctcagcgtggccgcgtccggcatggacttcactccgcagaacgcctcttcttcttccacaccggctacggcagcggcggcggcggcgagcgtcgtcgcgagcaaaaggaggcggaggcggcgatgcgacgccatggacgcggtggcgagatctggttcaagtgttcaacgctggagccgttgacttgtgagttaaaaatgtctcgagttggattctgtgtgggccccagtgtcagcctcggtggtgagtggtcgtgtacgatccgacgtggactcgcgtgggcccggggcgtcaggcgcgggagccgttcgttttccccgcggctttatccacacgaggagggagagaagaggtggagagggagaggcgaggtgtaaagaggcggaacaatggcggcggcggcggcggcggcgcagtggtgcggcgcggctgggctagacaggtgggtgggccggtggcggtgtaccttgtcgccggcggctctgccggtgccgtcgcggcggacgagaaggaagggcggggtcgtcggctgcgtgtccgttccaagggaggtcgccgcgaccgcggcggtggagccgccggcgccgccggaggctgaggccgagacagaggttagttatcttgcatgctccctgagctcgccggcgctttgccggagcagtgtgtggtgcaaccgtgcaatcctcacaccgacaggacgggcccacgggtcagcgagacagcagtggtgccctgtggtagttctctctaggaagtccaaccgcttaccatttgtaactgtcctaaccttgacctccctccgccgtccgatctaccataggcggttcagatcactaggggcacgtttggatcctgggcaagggtcaccctagccttgcctggcaaggctatccgtttggaactagtaaaatagcttggcttttaagggcgagttagttgtacagggcgagaaaaaccttgccggctagggagagccaatttggctcgctttcgacgtcaaacttcactcgcgtgaaaatattgtctgcgggcgacgcggacttctccggaatcgctgatattctctccccgatcaggagacgaactcattagcagcagctcaatccggaggcgatctcatccgcgtagactcctagatttgatttcttctttatcgtcagctcctaacctcttctttctgagatacatggtgtgctgtcttgttcaatcgctctgtcaggaagttggtagagttagaaaagagcgtctttgagatcgtttgctttgtgctagatgcagcctttgcgttgccaagatcatttattatgatggtacttgattaaggaattctcttgatttctcatttgtgaatcctaaaatattatgggccattttggtttgatatcaaaatgttgccataccaattttttggtagtttaaatagtaaatgtgatgatttggtttgaagccaaatattttgtaatgactatattcaatttggcacaattctagaatgttcttcaccacaattcaaaatttggctctcaattgacattgatctaaagacactcatttacaattctaccctaccaaaatattggtagtgccaaaacttgcgtagagtttggcactaccaatatattggtagggtactaaaccaaacaagccatataactttaaggtagtaataaactactagcaaaagaatggctatgggaaaaaaaacaatgcaagattattaacatgaccagtgccttttaatttttggacaaaaaaaggaagcaaaataaacttgggcaaagcaataatttttgaaggattcaaacagctagccactattccttgccctgggaagcaaaccaaccaaacacaggggtacggcaaggctagcaagctggcaatgagatgtttagccttgctgagccagctagccgagcgaaggatcaaacataccctagatcaacaccattggtagccttcgccctctcttctgatgctgagaatctgactgtgtgtggtttcgatgcaaaaaccattcgaatctgatgctgttgaactaccttggctgtgatgattcttcttgtcctaaggaagaaggtgtagagtgcgaaggttgcaacggcgcagggtggctgctctgcgacttctgcaaggggaagaagaacaacgtcaagtcggagagcagccggatctaccgccgctgcccgacctgcaaagccgtgagtttcgctcctctcttcaattttgcacattgccatcacctttttctgcttcgttccaacactttgaactggtgctgctgttgcaggcagggtacatcctttgcccaagatgcagggtctacaaatgcatcacttatccagagagcaatgactcatgaacagaagtgaaactgatcgagctggaaaatctggatgaagatctgatccttttgatgagcatgcttgagttgagtggatagactgcaccgatgaatatagaacaaccgcacagctctgaatctgattgtactgcgcattgaagcaaaatgactatgtacacaagtgcattctgcatagcaacatatgctgtttattgtaccttgctcttccaaacatcaggcataccctgatgttccgcctttcttgttgagtgaaatgaggatcatctttcgtccactcaacatgtcagcataccctgcactagtatatacatcaatccgttcttgccagagaatgctttttctgctagctcgtcccggaggagcttatctggccgctcaggacatgcatgaatatacagattacaccatccatcaaaattgaaggaccgcacaacttcaacatatacgcaaaaagggctataaacatatgttttttactctgctatactatgctatactttgttctttcaatcatcaggctgcaattcaaggatgatggaggagtagctgagcatggggtagagattggagttgaggaaatgagagaacaggtggacggcgtgagcacgatcaggcaggtcgtcggtgaggaagtcataaggcgctggcttgcctgtgtccaccagcggctcccagcggtagcctgggcgctctgggagtccaacaaccgccggcaaatggctggcgttgaaggccacgtagatctcgcctttcgtttcatctttctgtgatagacatggataaaagaaattatcatctagcttcaacttgattgttgtgaaaaagacggtgcttttattttttgggggaaatggctgtgttgtgtgagagcattatgtaggtaccgtggagaaggccacgaaacggcttgtctcagaccagtcaggtttcccaggctgatggccatgccaatgcaaccgttgagctgttgggaagtctgcgaggccaagggactcgcattgtctgcaatgtaaaagaaaacaaagcatgaggtcgatgtaggctatggagacggtctcacttgtttagcatgtggaagtgttccagagtagttacttgcggaatttggtcataagagagcagaaccgttgcaagtcagaggattcttctttcttgtcccagcggaaataattgacctatagaagaaccaaagatggattaagggaggggtttaatgacagctgattcgaaaaatacaccatcacattggactgacataatggtcatggcagtatgtgttgttgttgcctccttttgtatggccatattcatcgcccatgtagaacatcggaacaccctaaagaattaagagaaagtaatagtttaaaatgttaaatactgcagaagatgtgactaatgaaagtggcaagtacagaactagcatcttaacgtcatcctacattttggcaaacggtctaagataattaaagaggtcagataataaatcttacttgagaaaccatgagagaaacaaagaaattgcgcatttgcctcttcctcaatcttttgaccgacaaacctgcaaattctccttcctacattgttgacatgaaattgtaaatgcgcattctatataagattctcaactgcaaattgaaagaaaactaattactttgaaattgctaatgtatatcaggtctgcgcctctggtgaggcaaacggagcgcaaatcctagtcactgagctcacatggttttcccaccagcatcaaatcctagtgactggactcatggtttacctaccaccagtagtaaccttcatccataagtcccataactcatctcatttacaaaatacaacacacattttcatctttaagaaatacaggaagtttacagaccatgatatttggtaggggaaaccttcatcacactaatggtttagctatcgagtaaagccattgtaagattatcgggcatttgaatagaagtaaaacaagaactatgcataaacattatagtgcagtattacctccccacagttccagctgaggttatgattttctccatctctattatcctcaccatttgaagagttgtacttcttgttatatgtcaccaaatcagccagcgtaaatccatcatgcgcacacacaaagttgatactgtgccaaggtttcctcccccctgcctgattaataaaggaatattgtgtaatggcaaatacaagtgacagctttgattcttatgcaaacctaaaggaaatgtgaagtaaaaaacaaattacatagactagaatgaagctactttgcattggtacttctctgtgtatttttaagtgtcagaaatgtactagtccaaatggctatcagtatctaacataacctcttttcacaaagagaaatggacaaaagaaaata
